United States Patent 9,782,462 (MODIFIED POLYNUCLEOTIDES FOR THE PRODUCTION OF PROTEINS ASSOCIATED WITH HUMAN DISEASE) - sequence listing, part 46

SEQ ID NO: 85926 - DNA, 3774 bp, Artificial Sequence
  Description of Artificial Sequence: Synthetic coding sequence
atgaagggcggcgacagagcctacaccagaggccccagcctgggctggctgttcgccaagtgctgctgctgcttcccctgcagagacgcctacagccacagcagcagcgagaacggcggcaagagcgagagcgtggccaacctgcaggcccagcccagcctgaacagcatccacagcagccccggccccaagagaagcaccaacaccctgaagaagtggctgaccagccccgtgagaagactgaacagcggcaaggccgacggcaacatcaagaagcagaagaaggtgagagacggcagaaagagcttcgacctgggcagccccaagcccggcgacgagaccaccccccagggcgacagcgccgacgagaagagcaagaagggctggggcgaggacgagcccgacgaggagagccacacccccctgcccccccccatgaagatcttcgacaacgaccccacccaggacgagatgagcctggagggcagcagctacagaggcagcctgaaggaccccgccggctgcctgaacgagggcatggccccccccaccccccccaagaaccccgaggaggagcagaaggccaaggccctgagaggcagaatgttcgtgctgaacgagctggtgcagaccgagaaggactacgtgaaggacctgggcatcgtggtggagggcttcatgaagagaatcgaggagaagggcgtgcccgaggacatgagaggcaaggacaagatcgtgttcggcaacatccaccagatctacgactggcacaaggacttcttcctggccgagctggagaagtgcatccaggagcaggacagactggcccagctgttcatcaagcacgagagaaagctgcacatctacgtgtggtactgccagaacaagcccagaagcgagtacatcgtggccgagtacgacgcctacttcgaggaggtgaagcaggagatcaaccagagactgaccctgagcgacttcctgatcaagcccatccagagaatcaccaagtaccagctgctgctgaaggacttcctgagatacagcgagaaggccggcctggagtgcagcgacatcgagaaggccgtggagctgatgtgcctggtgcccaagagatgcaacgacatgatgaacctgggcagactgcagggcttcgagggcaccctgaccgcccagggcaagctgctgcagcaggacaccttctacgtgatcgagctggacgccggcatgcagagcagaaccaaggagagaagagtgttcctgttcgagcagatcgtgatcttcagcgagctgctgagaaagggcagcctgacccccggctacatgttcaagagaagcatcaagatgaactacctggtgctggaggagaacgtggacaacgacccctgcaagttcgccctgatgaacagagagaccagcgagagagtggtgctgcaggccgccaacgccgacatccagcaggcctgggtgcaggacatcaaccaggtgctggagacccagagagacttcctgaacgccctgcagagccccatcgagtaccagagaaaggagagaagcaccgccgtgatgagaagccagcccgccagactgccccaggccagccccagaccctacagcagcgtgcccgccggcagcgagaagccccccaagggcagcagctacaacccccccctgccccccctgaagatcagcaccagcaacggcagccccggcttcgagtaccaccagcccggcgacaagttcgaggccagcaagcagaacgacctgggcggctgcaacggcaccagcagcatggccgtgatcaaggactactacgccctgaaggagaacgagatctgcgtgagccagggcgaggtggtgcaggtgctggccgtgaaccagcagaacatgtgcctggtgtaccagcccgccagcgaccacagccccgccgccgagggctgggtgcccggcagcatcctggcccccctgaccaaggccaccgccgccgagagcagcgacggcagcatcaagaagagctgcagctggcacaccctgagaatgagaaagagagccgaggtggagaacaccggcaagaacgaggccaccggccccagaaagcccaaggacatcctgggcaacaaggtgagcgtgaaggagaccaacagcagcgaggagagcgagtgcgacgacctggaccccaacaccagcatggagatcctgaaccccaacttcatccaggaggtggcccccgagttcctggtgcccctggtggacgtgacctgcctgctgggcgacaccgtgatcctgcagtgcaaggtgtgcggcagacccaagcccaccatcacctggaagggccccgaccagaacatcctggacaccgacaacagcagcgccacctacaccgtgagcagctgcgacagcggcgagatcaccctgaagatctgcaacctgatgccccaggacagcggcatctacacctgcatcgccaccaacgaccacggcaccaccagcaccagcgccaccgtgaaggtgcagggcgtgcccgccgcccccaacagacccatcgcccaggagagaagctgcaccagcgtgatcctgagatggctgccccccagcagcaccggcaactgcaccatcagcggctacaccgtggagtacagagaggagggcagccagatctggcagcagagcgtggccagcaccctggacacctacctggtgatcgaggacctgagccccggctgcccctaccagttcagagtgagcgccagcaacccctggggcatcagcctgcccagcgagcccagcgagttcgtgagactgcccgagtacgacgccgccgccgacggcgccaccatcagctggaaggagaacttcgacagcgcctacaccgagctgaacgagatcggcagaggcagattcagcatcgtgaagaagtgcatccacaaggccaccagaaaggacgtggccgtgaagttcgtgagcaagaagatgaagaagaaggagcaggccgcccacgaggccgccctgctgcagcacctgcagcacccccagtacatcaccctgcacgacacctacgagagccccaccagctacatcctgatcctggagctgatggacgacggcagactgctggactacctgatgaaccacgacgagctgatggaggagaaggtggccttctacatcagagacatcatggaggccctgcagtacctgcacaactgcagagtggcccacctggacatcaagcccgagaacctgctgatcgacctgagaatccccgtgcccagagtgaagctgatcgacctggaggacgccgtgcagatcagcggccacttccacatccaccacctgctgggcaaccccgagttcgccgcccccgaggtgatccagggcatccccgtgagcctgggcaccgacatctggagcatcggcgtgctgacctacgtgatgctgagcggcgtgagccccttcctggacgagagcaaggaggagacctgcatcaacgtgtgcagagtggacttcagcttcccccacgagtacttctgcggcgtgagcaacgccgccagagacttcatcaacgtgatcctgcaggaggacttcagaagaagacccaccgccgccacctgcctgcagcacccctggctgcagccccacaacggcagctacagcaagatccccctggacaccagcagactggcctgcttcatcgagagaagaaagcaccagaacgacgtgagacccatccccaacgtgaagagctacatcgtgaacagagtgaaccagggcacctag

SEQ ID NO: 85927 - DNA, 4965 bp, Artificial Sequence
  Description of Artificial Sequence: Synthetic coding sequence
atgaccgacagattctgggaccagtggtacctgtggtacctgagactgctgagactgctggacagaggcagcttcagaaacgacggcctgaaggccagcgacgtgctgcccatcctgaaggagaaggtggccttcgtgagcggcggcagagacaagagaggcggccccatcctgaccttccccgccagaagcaaccacgacagaatcagacaggaggacctgagaaagctggtgacctacctggccagcgtgcccagcgaggacgtgtgcaagagaggcttcaccgtgatcatcgacatgagaggcagcaagtgggacctgatcaagcccctgctgaagaccctgcaggaggccttccccgccgagatccacgtggccctgatcatcaagcccgacaacttctggcagaagcagaagaccaacttcggcagcagcaagttcatcttcgagaccagcatggtgagcgtggagggcctgaccaagctggtggaccccagccagctgaccgaggagttcgacggcagcctggactacaaccacgaggagtggatcgagctgagactgagcctggaggagttcttcaacagcgccgtgcacctgctgagcagactggaggacctgcaggagatgctggccagaaaggagttccccgtggacgtggagggcagcagaagactgatcgacgagcacacccagctgaagaagaaggtgctgaaggcccccgtggaggagctggacagagagggccagagactgctgcagtgcatcagatgcagcgacggcttcagcggcagaaactgcatccccggcagcgccgacttccagagcctggtgcccaagatcaccagcctgctggacaagctgcacagcaccagacagcacctgcaccagatgtggcacgtgagaaagctgaagctggaccagtgcttccagctgagactgttcgagcaggacgccgagaagatgttcgactggatcagccacaacaaggagctgttcctgcagagccacaccgagatcggcgtgagctaccagtacgccctggacctgcagacccagcacaaccacttcgccatgaacagcatgaacgcctacgtgaacatcaacagaatcatgagcgtggccagcagactgagcgaggccggccactacgccagccagcagatcaagcagatcagcacccagctggaccaggagtggaagagcttcgccgccgccctggacgagagaagcaccatcctggccatgagcgccgtgttccaccagaaggccgagcagttcctgagcggcgtggacgcctggtgcaagatgtgcagcgagggcggcctgcccagcgagatgcaggacctggagctggccatccaccaccaccagaccctgtacgagcaggtgacccaggcctacaccgaggtgagccaggacggcaaggccctgctggacgtgctgcagagacccctgagccccggcaacagcgagagcctgaccgccaccgccaactacagcaaggccgtgcaccaggtgctggacgtggtgcacgaggtgctgcaccaccagagaagactggagagcatctggcagcacagaaaggtgagactgcaccagagactgcagctgtgcgtgttccagcaggacgtgcagcaggtgctggactggatcgagaaccacggcgaggccttcctgagcaagcacaccggcgtgggcaagagcctgcacagagccagagccctgcagaagagacacgacgacttcgaggaggtggcccagaacacctacaccaacgccgacaagctgctggaggccgccgagcagctggcccagaccggcgagtgcgaccccgaggagatctacaaggccgccagacacctggaggtgagaatccaggacttcgtgagaagagtggagcagagaaagctgctgctggacatgagcgtgagcttccacacccacaccaaggagctgtggacctggatggaggacctgcagaaggagatgctggaggacgtgtgcgccgacagcgtggacgccgtgcaggagctgatcaagcagttccagcagcagcagaccgccaccctggacgccaccctgaacgtgatcaaggagggcgaggacctgatccagcagctgagaagcgccccccccagcctgggcgagcccagcgaggccagagacagcgccgtgagcaacaacaagaccccccacagcagcagcatcagccacatcgagagcgtgctgcagcagctggacgacgcccaggtgcagatggaggagctgttccacgagagaaagatcaagctggacatcttcctgcagctgagaatcttcgagcagtacaccatcgaggtgaccgccgagctggacgcctggaacgaggacctgctgagacagatgaacgacttcaacaccgaggacctgaccctggccgagcagagactgcagagacacaccgagagaaagctggccatgaacaacatgaccttcgaggtgatccagcagggccaggacctgcaccagtacatcaccgaggtgcaggccagcggcatcgagctgatctgcgagaaggacatcgacctggccgcccaggtgcaggagctgctggagttcctgcacgagaagcagcacgagctggagctgaacgccgagcagacccacaagagactggagcagtgcctgcagctgagacacctgcaggccgaggtgaagcaggtgctgggctggatcagaaacggcgagagcatgctgaacgccagcctggtgaacgccagcagcctgagcgaggccgagcagctgcagagagagcacgagcagttccagctggccatcgagaagacccaccagagcgccctgcaggtgcagcagaaggccgaggtgctgctgcaggccggccactacgacgccgacgccatcagagagtgcgccgagaaggtggccctgcactggcagcagctgatgctgaagatggaggacagactgaagctggtgaacgccagcgtggccttctacaagaccagcgagcaggtgtgcagcgtgctggagagcctggagcaggagtacagaagagacgaggactggtgcggcggcagagacaagctgggccccgccgccgagatcgaccacgtgatccccctgatcagcaagcacctggagcagaaggaggccttcctgaaggcctgcaccctggccagaagaaacgccgaggtgttcctgaagtacatccacagaaacaacgtgagcatgcccagcgtggccagccacaccagaggccccgagcagcaggtgaaggccatcctgagcgagctgctgcagagagagaacagagtgctgcacttctggaccctgaagaagagaagactggaccagtgccagcagtacgtggtgttcgagagaagcgccaagcaggccctggactggatccaggagaccggcgagttctacctgagcacccacaccagcaccggcgagaccaccgaggagacccaggagctgctgaaggagtacggcgagttcagagtgcccgccaagcagaccaaggagaaggtgaagctgctgatccagctggccgacagcttcgtggagaagggccacatccacgccaccgagatcagaaagtgggtgaccaccgtggacaagcactacagagacttcagcctgagaatgggcaagtacagatacagcctggagaaggccctgggcgtgaacaccgaggacaacaaggacctggagctggacatcatccccgccagcctgagcgacagagaggtgaagctgagagacgccaaccacgaggtgaacgaggagaagagaaagagcgccagaaagaaggagttcatcatggccgagctgctgcagaccgagaaggcctacgtgagagacctgcacgagtgcctggagacctacctgtgggagatgaccagcggcgtggaggagatcccccccggcatcctgaacaaggagcacatcatcttcggcaacatccaggagatctacgacttccacaacaacatcttcctgaaggagctggagaagtacgagcagctgcccgaggacgtgggccactgcttcgtgacctgggccgacaagttccagatgtacgtgacctactgcaagaacaagcccgacagcaaccagctgatcctggagcacgccggcaccttcttcgacgagatccagcagagacacggcctggccaacagcatcagcagctacctgatcaagcccgtgcagagaatcaccaagtaccagctgctgctgaaggagctgctgacctgctgcgaggagggcaagggcgagctgaaggacggcctggaggtgatgctgagcgtgcccaagaaggccaacgacgccatgcacgtgagcatgctggagggcttcgacgagaacctggacgtgcagggcgagctgatcctgcaggacgccttccaggtgtgggaccccaagagcctgatcagaaagggcagagagagacacctgttcctgttcgagatcagcctggtgttcagcaaggagatcaaggacagcagcggccacaccaagtacgtgtacaagaacaagctgctgaccagcgagctgggcgtgaccgagcacgtggagggcgacccctgcaagttcgccctgtggagcggcagaacccccagcagcgacaacaagaccgtgctgaaggccagcaacatcgagaccaagcaggagtggatcaagaacatcagagaggtgatccaggagagaatcatccacctgaagggcgccctgaaggagcccctgcagctgcccaagacccccgccaagcagagaaacaacagcaagagagacggcgtggaggacatcgacagccagggcgacggcagcagccagcccgacaccatcagcatcgccagcagaaccagccagaacaccgtggacagcgacaaggacggcaacctggtgcccagatggcacctgggccccggcgaccccttcagcacctacgtgtag

SEQ ID NO: 85928 - DNA, 789 bp, Artificial Sequence
  Description of Artificial Sequence: Synthetic coding sequence
atgtggttcctggtgctgtgcctggccctgagcctgggcggcaccggcgccgccccccccatccagagcagaatcgtgggcggctgggagtgcgagcagcacagccagccctggcaggccgccctgtaccacttcagcaccttccagtgcggcggcatcctggtgcacagacagtgggtgctgaccgccgcccactgcatcagcgacaactaccagctgtggctgggcagacacaacctgttcgacgacgagaacaccgcccagttcgtgcacgtgagcgagagcttcccccaccccggcttcaacatgagcctgctggagaaccacaccagacaggccgacgaggactacagccacgacctgatgctgctgagactgaccgagcccgccgacaccatcaccgacgccgtgaaggtggtggagctgcccaccgaggagcccgaggtgggcagcacctgcctggccagcggctggggcagcatcgagcccgagaacttcagcttccccgacgacctgcagtgcgtggacctgaagatcctgcccaacgacgagtgcaagaaggcccacgtgcagaaggtgaccgacttcatgctgtgcgtgggccacctggagggcggcaaggacacctgcgtgggcgacagcggcggccccctgatgtgcgacggcgtgctgcagggcgtgaccagctggggctacgtgccctgcggcacccccaacaagcccagcgtggccgtgagagtgctgagctacgtgaagtggatcgaggacaccatcgccgagaacagctag

SEQ ID NO: 85929 - DNA, 483 bp, Artificial Sequence
  Description of Artificial Sequence: Synthetic coding sequence
atgagcctgctggagaaccacaccagacaggccgacgaggactacagccacgacctgatgctgctgagactgaccgagcccgccgacaccatcaccgacgccgtgaaggtggtggagctgcccaccgaggagcccgaggtgggcagcacctgcctggccagcggctggggcagcatcgagcccgagaacttcagcttccccgacgacctgcagtgcgtggacctgaagatcctgcccaacgacgagtgcaagaaggcccacgtgcagaaggtgaccgacttcatgctgtgcgtgggccacctggagggcggcaaggacacctgcgtgggcgacagcggcggccccctgatgtgcgacggcgtgctgcagggcgtgaccagctggggctacgtgccctgcggcacccccaacaagcccagcgtggccgtgagagtgctgagctacgtgaagtggatcgaggacaccatcgccgagaacagctag

SEQ ID NO: 85930 - DNA, 1917 bp, Artificial Sequence
  Description of Artificial Sequence: Synthetic coding sequence
atgatcctgttcaagcaggccacctacttcatcagcctgttcgccaccgtgagctgcggctgcctgacccagctgtacgagaacgccttcttcagaggcggcgacgtggccagcatgtacacccccaacgcccagtactgccagatgagatgcaccttccaccccagatgcctgctgttcagcttcctgcccgccagcagcatcaacgacatggagaagagattcggctgcttcctgaaggacagcgtgaccggcaccctgcccaaggtgcacagaaccggcgccgtgagcggccacagcctgaagcagtgcggccaccagatcagcgcctgccacagagacatctacaagggcgtggacatgagaggcgtgaacttcaacgtgagcaaggtgagcagcgtggaggagtgccagaagagatgcaccagcaacatcagatgccagttcttcagctacgccacccagaccttccacaaggccgagtacagaaacaactgcctgctgaagtacagccccggcggcacccccaccgccatcaaggtgctgagcaacgtggagagcggcttcagcctgaagccctgcgccctgagcgagatcggctgccacatgaacatcttccagcacctggccttcagcgacgtggacgtggccagagtgctgacccccgacgccttcgtgtgcagaaccatctgcacctaccaccccaactgcctgttcttcaccttctacaccaacgtgtggaagatcgagagccagagaaacgtgtgcctgctgaagaccagcgagagcggcacccccagcagcagcaccccccaggagaacaccatcagcggctacagcctgctgacctgcaagagaaccctgcccgagccctgccacagcaagatctaccccggcgtggacttcggcggcgaggagctgaacgtgaccttcgtgaagggcgtgaacgtgtgccaggagacctgcaccaagatgatcagatgccagttcttcacctacagcctgctgcccgaggactgcaaggaggagaagtgcaagtgcttcctgagactgagcatggacggcagccccaccagaatcgcctacggcacccagggcagcagcggctacagcctgagactgtgcaacaccggcgacaacagcgtgtgcaccaccaagaccagcaccagaatcgtgggcggcaccaacagcagctggggcgagtggccctggcaggtgagcctgcaggtgaagctgaccgcccagagacacctgtgcggcggcagcctgatcggccaccagtgggtgctgaccgccgcccactgcttcgacggcctgcccctgcaggacgtgtggagaatctacagcggcatcctgaacctgagcgacatcaccaaggacacccccttcagccagatcaaggagatcatcatccaccagaactacaaggtgagcgagggcaaccacgacatcgccctgatcaagctgcaggcccccctgaactacaccgagttccagaagcccatctgcctgcccagcaagggcgacaccagcaccatctacaccaactgctgggtgaccggctggggcttcagcaaggagaagggcgagatccagaacatcctgcagaaggtgaacatccccctggtgaccaacgaggagtgccagaagagataccaggactacaagatcacccagagaatggtgtgcgccggctacaaggagggcggcaaggacgcctgcaagggcgacagcggcggccccctggtgtgcaagcacaacggcatgtggagactggtgggcatcaccagctggggcgagggctgcgccagaagagagcagcccggcgtgtacaccaaggtggccgagtacatggactggatcctggagaagacccagagcagcgacggcaaggcccagatgcagagccccgcctag

SEQ ID NO: 85931 - DNA, 1545 bp, Artificial Sequence
  Description of Artificial Sequence: Synthetic coding sequence
atgtacacccccaacgcccagtactgccagatgagatgcaccttccaccccagatgcctgctgttcagcttcctgcccgccagcagcatcaacgacatggagaagagattcggctgcttcctgaaggacagcgtgaccggcaccctgcccaaggtgcacagaaccggcgccgtgagcggccacagcctgaagcagtgcggccaccagatcagcgcctgccacagagacatctacaagggcgtggacatgagaggcgtgaacttcaacgtgagcaaggtgagcagcgtggaggagtgccagaagagatgcaccagcaacatcagatgccagttcttcagctacgccacccagaccttccacaaggccgagtacagaaacaactgcctgctgaagtacagccccggcggcacccccaccgccatcaaggtgctgagcaacgtggagagcggcttcagcctgaagccctgcgccctgagcgagatcggctgccacatgaacatcttccagcacctggccttcagcgacgtggacgtggccagagtgctgacccccgacgccttcgtgtgcagaaccatctgcacctaccaccccaactgcctgttcttcaccttctacaccaacgtgtggaagatcgagagccagagaaacgtgtgcctgctgaagaccagcgagagcggcacccccagcagcagcaccccccaggagaacaccatcagcggctacagcctgctgacctgcaagagaaccctgcccgagccctgccacagcaagatctaccccggcgtggacttcggcggcgaggagctgaacgtgaccttcgtgaagggcgtgaacgtgtgccaggagacctgcaccaagatgatcagatgccagttcttcacctacagcctgctgcccgaggactgcaaggaggagaagtgcaagtgcttcctgagactgagcatggacggcagccccaccagaatcgcctacggcacccagggcagcagcggctacagcctgagactgtgcaacaccggcgacaacagcgtgtgcaccaccaagaccagcaccagaatcgtgggcggcaccaacagcagctggggcgagtggccctggcaggtgagcctgcaggtgaagctgaccgcccagagacacctgtgcggcggcagcctgatcggccaccagtgggtgctgaccgccgcccactgcttcgacggcctgcccctgcaggacgtgtggagaatctacagcggcatcctgaacctgagcgacatcaccaaggacacccccttcagccagatcaaggagatcatcatccaccagaactacaaggtgagcgagggcaaccacgacatcgccctgatcaagctgcaggcccccctgaactacaccgagttccagaagcccatctgcctgcccagcaagggcgacaccagcaccatctacaccaactgctgggtgaccggctggggcttcagcaaggagaagggcagattcagatggagcctgagcctgcagacccagtggaacgtggccttcggcggccaccaccagctgggctag

SEQ ID NO: 85932 - DNA, 447 bp, Artificial Sequence
  Description of Artificial Sequence: Synthetic coding sequence
atgatcctgttcaagcaggccacctacttcatcagcctgttcgccaccgtgagctgcggctgcctgacccagctgtacgagaacgccttcttcagaggcggcgacgtggccagcatgtacacccccaacgcccagtactgccagatgagatgcaccttccaccccagatgcctgctgttcagcttcctgcccgccagcagcatcaacgacatggagaagagattcggctgcttcctgaaggacagcgtgaccggcaccctgcccaaggtgcacagaaccggcgccgtgagcggccacagcctgaagcagtgcggccaccagatcagcgcctgccacagagacatctacaagggcgtggacatgagaggcgtgaacttcaacgtgagcaaggtgagcagcgtggaggagtgccagaagagatgcaccagcaacatcagatgccagtag

SEQ ID NO: 85933 - DNA, 753 bp, Artificial Sequence
  Description of Artificial Sequence: Synthetic coding sequence
atgagaatcctgcagctgatcctgctggccctggccaccggcctggtgggcggcgagaccagaatcatcaagggcttcgagtgcaagccccacagccagccctggcaggccgccctgttcgagaagaccagactgctgtgcggcgccaccctgatcgcccccagatggctgctgaccgccgcccactgcctgaagcccagatacatcgtgcacctgggccagcacaacctgcagaaggaggagggctgcgagcagaccagaaccgccaccgagagcttcccccaccccggcttcaacaacagcctgcccaacaaggaccacagaaacgacatcatgctggtgaagatggccagccccgtgagcatcacctgggccgtgagacccctgaccctgagcagcagatgcgtgaccgccggcaccagctgcctgatcagcggctggggcagcaccagcagcccccagctgagactgccccacaccctgagatgcgccaacatcaccatcatcgagcaccagaagtgcgagaacgcctaccccggcaacatcaccgacaccatggtgtgcgccagcgtgcaggagggcggcaaggacagctgccagggcgacagcggcggccccctggtgtgcaaccagagcctgcagggcatcatcagctggggccaggacccctgcgccatcaccagaaagcccggcgtgtacaccaaggtgtgcaagtacgtggactggatccaggagaccatgaagaacaactag

SEQ ID NO: 85934 - DNA, 849 bp, Artificial Sequence
  Description of Artificial Sequence: Synthetic coding sequence
atgcagagactgagatggctgagagactggaagagcagcggcagaggcctgaccgccgccaaggagcccggcgccagaagcagccccctgcaggccatgagaatcctgcagctgatcctgctggccctggccaccggcctggtgggcggcgagaccagaatcatcaagggcttcgagtgcaagccccacagccagccctggcaggccgccctgttcgagaagaccagactgctgtgcggcgccaccctgatcgcccccagatggctgctgaccgccgcccactgcctgaagcccagatacatcgtgcacctgggccagcacaacctgcagaaggaggagggctgcgagcagaccagaaccgccaccgagagcttcccccaccccggcttcaacaacagcctgcccaacaaggaccacagaaacgacatcatgctggtgaagatggccagccccgtgagcatcacctgggccgtgagacccctgaccctgagcagcagatgcgtgaccgccggcaccagctgcctgatcagcggctggggcagcaccagcagcccccagctgagactgccccacaccctgagatgcgccaacatcaccatcatcgagcaccagaagtgcgagaacgcctaccccggcaacatcaccgacaccatggtgtgcgccagcgtgcaggagggcggcaaggacagctgccagggcgacagcggcggccccctggtgtgcaaccagagcctgcagggcatcatcagctggggccaggacccctgcgccatcaccagaaagcccggcgtgtacaccaaggtgtgcaagtacgtggactggatccaggagaccatgaagaacaactag

SEQ ID NO: 85935 - DNA, 828 bp, Artificial Sequence
  Description of Artificial Sequence: Synthetic coding sequence
atgagaatcctgcagctgatcctgctggccctggccaccggcctggtgggcggcgagaccagaatcatcaagggcttcgagtgcaagccccacagccagccctggcaggccgccctgttcgagaagaccagactgctgtgcggcgccaccctgatcgcccccagatggctgctgaccgccgcccactgcctgaagccctgggtgagcctgaccagccccacccacgtgagccccgacctgagcagcagcaactactgcctgagccacctgagcagatacatcgtgcacctgggccagcacaacctgcagaaggaggagggctgcgagcagaccagaaccgccaccgagagcttcccccaccccggcttcaacaacagcctgcccaacaaggaccacagaaacgacatcatgctggtgaagatggccagccccgtgagcatcacctgggccgtgagacccctgaccctgagcagcagatgcgtgaccgccggcaccagctgcctgatcagcggctggggcagcaccagcagcccccagctgagactgccccacaccctgagatgcgccaacatcaccatcatcgagcaccagaagtgcgagaacgcctaccccggcaacatcaccgacaccatggtgtgcgccagcgtgcaggagggcggcaaggacagctgccagggcgacagcggcggccccctggtgtgcaaccagagcctgcagggcatcatcagctggggccaggacccctgcgccatcaccagaaagcccggcgtgtacaccaaggtgtgcaagtacgtggactggatccaggagaccatgaagaacaactag

SEQ ID NO: 85936 - DNA, 753 bp, Artificial Sequence; identical to SEQ ID NO: 85933
  Description of Artificial Sequence: Synthetic coding sequence

SEQ ID NO: 85937 - DNA, 849 bp, Artificial Sequence; identical to SEQ ID NO: 85934
  Description of Artificial Sequence: Synthetic coding sequence

SEQ ID NO: 85938 - DNA, 765 bp, Artificial Sequence
  Description of Artificial Sequence: Synthetic coding sequence
atgggcctgagcatcttcctgctgctgtgcgtgctgggcctgagccaggccgccacccccaagatcttcaacggcaccgagtgcggcagaaacagccagccctggcaggtgggcctgttcgagggcaccagcctgagatgcggcggcgtgctgatcgaccacagatgggtgctgaccgccgcccactgcagcggcagcagatactgggtgagactgggcgagcacagcctgagccagctggactggaccgagcagatcagacacagcggcttcagcgtgacccaccccggctacctgggcgccagcaccagccacgagcacgacctgagactgctgagactgagactgcccgtgagagtgaccagcagcgtgcagcccctgcccctgcccaacgactgcgccaccgccggcaccgagtgccacgtgagcggctggggcatcaccaaccaccccagaaaccccttccccgacctgctgcagtgcctgaacctgagcatcgtgagccacgccacctgccacggcgtgtaccccggcagaatcaccagcaacatggtgtgcgccggcggcgtgcccggccaggacgcctgccagggcgacagcggcggccccctggtgtgcggcggcgtgctgcagggcctggtgagctggggcagcgtgggcccctgcggccaggacggcatccccggcgtgtacacctacatctgcaacagcaccctggtgggcctgggcaccagctggaacttcaacagctgccagcccttctag

SEQ ID NO: 85939 - DNA, 435 bp, Artificial Sequence
  Description of Artificial Sequence: Synthetic coding sequence
atggccctgagcgtgggcgtgacccacagcagaggcagatggggctgcctgagagcccccgcctgcgccgccggcgtgagcctgctgaccaccggcggcagcagccagagactgaccgccgccgccgaccccttccccgacctgctgcagtgcctgaacctgagcatcgtgagccacgccacctgccacggcgtgtaccccggcagaatcaccagcaacatggtgtgcgccggcggcgtgcccggccaggacgcctgccagggcgacagcggcggccccctggtgtgcggcggcgtgctgcagggcctggtgagctggggcagcgtgggcccctgcggccaggacggcatccccggcgtgtacacctacatctgcaacagcaccctggtgggcctgggcaccagctggaacttcaacagctgccagcccttctag

SEQ ID NO: 85940 - DNA, 747 bp, Artificial Sequence
  Description of Artificial Sequence: Synthetic coding sequence
atgggcctgagcatcttcctgctgctgtgcgtgctgggcctgagccaggccgccacccccaagatcttcaacggcaccgagtgcggcagaaacagccagccctggcaggtgggcctgttcgagggcaccagcctgagatgcggcggcgtgctgatcgaccacagatgggtgctgaccgccgcccactgcagcggcagcagatactgggtgagactgggcgagcacagcctgagccagctggactggaccgagcagatcagacacagcggcttcagcgtgacccaccccggctacctgggcgccagcaccagccacgagcacgacctgagactgctgagactgagactgcccgtgagagtgaccagcagcgtgcagcccctgcccctgcccaacgactgcgccaccgccggcaccgagtgccacgtgagcggctggggcatcaccaaccaccccagaaaccccttccccgacctgctgcagtgcctgaacctgagcatcgtgagccacgccacctgccacggcgtgtaccccggcagaatcaccagcaacatggtgtgcgccggcggcgtgcccggccaggacgcctgccagggcgacagcggcggccccctggtgtgcggcggcgtgctgcagggcctggtgagctggggcagcgtgggcccctgcggccaggacggcatccccggcgtgtacacctacatctgcaagtacgtggactggatcagaatgatcatgagaaacaactag

SEQ ID NO: 85941 - DNA, 747 bp, Artificial Sequence; identical to SEQ ID NO: 85940
  Description of Artificial Sequence: Synthetic coding sequence

SEQ ID NO: 85942 - DNA, 336 bp, Artificial Sequence
  Description of Artificial Sequence: Synthetic coding sequence
atgggcctgagcatcttcctgctgctgtgcgtgctgggcctgagccaggccgccacccccaagatcttcaacggcaccgagtgcggcagaaacagccagccctggcaggtgggcctgttcgagggcaccagcctgagatgcggcggcgtgctgatcgaccacagatgggtgctgaccgccgcccactgcagcggcagacccatccccggcagcgcccccgtgccccagcccctgcacagactgccctgccacctgccctggtgcgtgagcagagagaaccacgagcagcacggcgtgtgcagaagaagacccggcgccggctgcctgcccggctag

SEQ ID NO: 85943 - DNA, 834 bp, Artificial Sequence
  Description of Artificial Sequence: Synthetic coding sequence
atgtggcccctggccctggtgatcgccagcctgaccctggccctgagcggcggcgtgagccaggagagcagcaaggtgctgaacaccaacggcaccagcggcttcctgcccggcggctacacctgcttcccccacagccagccctggcaggccgccctgctggtgcagggcagactgctgtgcggcggcgtgctggtgcaccccaagtgggtgctgaccgccgcccactgcctgaaggagggcctgaaggtgtacctgggcaagcacgccctgggcagagtggaggccggcgagcaggtgagagaggtggtgcacagcatcccccaccccgagtacagaagaagccccacccacctgaaccacgaccacgacatcatgctgctggagctgcagagccccgtgcagctgaccggctacatccagaccctgcccctgagccacaacaacagactgacccccggcaccacctgcagagtgagcggctggggcaccaccaccagcccccaggtgaactaccccaagaccctgcagtgcgccaacatccagctgagaagcgacgaggagtgcagacaggtgtaccccggcaagatcaccgacaacatgctgtgcgccggcaccaaggagggcggcaaggacagctgcgagggcgacagcggcggccccctggtgtgcaacagaaccctgtacggcatcgtgagctggggcgacttcccctgcggccagcccgacagacccggcgtgtacaccagagtgagcagatacgtgctgtggatcagagagaccatcagaaagtacgagacccagcagcagaagtggctgaagggcccccagtag

SEQ ID NO: 85944 - DNA, 378 bp, Artificial Sequence
  Description of Artificial Sequence: Synthetic coding sequence
atgtggcccctggccctggtgatcgccagcctgaccctggccctgagcggcgtgaactaccccaagaccctgcagtgcgccaacatccagctgagaagcgacgaggagtgcagacaggtgtaccccggcaagatcaccgacaacatgctgtgcgccggcaccaaggagggcggcaaggacagctgcgagggcgacagcggcggccccctggtgtgcaacagaaccctgtacggcatcgtgagctggggcgacttcccctgcggccagcccgacagacccggcgtgtacaccagagtgagcagatacgtgctgtggatcagagagaccatcagaaagtacgagacccagcagcagaagtggctgaagggcccccagtag

SEQ ID NO: 85945 - DNA, 297 bp, Artificial Sequence
  Description of Artificial Sequence: Synthetic coding sequence
atgggcctgatctacaagtgcctgcccgagaaggtgaccgtgaacatcgagaccagatgcctgcccggcgtgttccagggcagccagcaccagtgggaccagtgggtgagccccagatggctgcacctgctgccccccctgagcgccctggccggctgccccaccagcgccagagccgccaccctgtggggcagccccggccccccccagatgggcccccactgcagaaccctgagcaagggcggcgcccagagcctgcccagacaggccagacccagagcctgcggcagctggtag

SEQ ID NO: 85946 - DNA, 282 bp, Artificial Sequence
  Description of Artificial Sequence: Synthetic coding sequence
atgtggcccctggccctggtgatcgccagcctgaccctggccctgagcggcggcgaggacttcaaggagcccagccagggccccagagacgtgatggccgccagcagacccgaggccttccccaagggcctgaccctggagcccagacccgagaagggcggcatctgcggctgcctggcccccggcaccatcctgggcctgaaggtgggctggctgttcagcagcggcgacaccccctggatccacgccagagccacccccgagtgccacaccctgggctag

SEQ ID NO: 85947 - DNA, 834 bp, Artificial Sequence; identical to SEQ ID NO: 85943
  Description of Artificial Sequence: Synthetic coding sequence

SEQ ID NO: 85948 - DNA, 804 bp, Artificial Sequence
  Description of Artificial Sequence: Synthetic coding sequence
atgagcctgagagtgctgggcagcggcacctggcccagcgcccccaagatgttcctgctgctgaccgccctgcaggtgctggccatcgccatgacccagagccaggaggacgagaacaagatcatcggcggccacacctgcaccagaagcagccagccctggcaggccgccctgctggccggccccagaagaagattcctgtgcggcggcgccctgctgagcggccagtgggtgatcaccgccgcccactgcggcagacccatcctgcaggtggccctgggcaagcacaacctgagaagatgggaggccacccagcaggtgctgagagtggtgagacaggtgacccaccccaactacaacagcagaacccacgacaacgacctgatgctgctgcagctgcagcagcccgccagaatcggcagagccgtgagacccatcgaggtgacccaggcctgcgccagccccggcaccagctgcagagtgagcggctggggcaccatcagcagccccatcgccagataccccgccagcctgcagtgcgtgaacatcaacatcagccccgacgaggtgtgccagaaggcctaccccagaaccatcacccccggcatggtgtgcgccggcgtgccccagggcggcaaggacagctgccagggcgacagcggcggccccctggtgtgcagaggccagctgcagggcctggtgagctggggcatggagagatgcgccctgcccggctaccccggcgtgtacaccaacctgtgcaagtacagaagctggatcgaggagaccatgagagacaagtag

SEQ ID NO: 85949 - DNA, 804 bp, Artificial Sequence; identical to SEQ ID NO: 85948
  Description of Artificial Sequence: Synthetic coding sequence

SEQ ID NO: 85950 - DNA, 804 bp, Artificial Sequence; identical to SEQ ID NO: 85948
  Description of Artificial Sequence: Synthetic coding sequence

SEQ ID NO: 85951 - DNA, 486 bp, Artificial Sequence
  Description of Artificial Sequence: Synthetic coding sequence
atgtggctgctgctgaccctgagcttcctgctggccagcaccgccgcccaggacggcgacaagctgctggagggcgacgagtgcgccccccacagccagccctggcaggtggccctgtacgagagaggcagattcaactgcggcgccagcctgatcagcccccactgggtgctgagcgccgcccactgccagagcagattcatgagagtgagactgggcgagcacaacctgagaaagagagacggccccgagcagctgagaaccaccagcagagtgatcccccaccccagatacgaggccagaagccacagaaacgacatcatgctgctgagactggtgcagcccgccagactgaacccccaggtgagacccgccgtgctgcccaccagatgcccccaccccggcgaggcctgcgtggtgagcggctggggcctggtgagccacaacgagcccggcaccgccggcagccccagaagccagggctag

SEQ ID NO: 85952 - DNA, 771 bp, Artificial Sequence
  Description of Artificial Sequence: Synthetic coding sequence
atgtggctgctgctgaccctgagcttcctgctggccagcaccgccgcccaggacggcgacaagctgctggagggcgacgagtgcgccccccacagccagccctggcaggtggccctgtacgagagaggcagattcaactgcggcgccagcctgatcagcccccactgggtgctgagcgccgcccactgccagagcagattcatgagagtgagactgggcgagcacaacctgagaaagagagacggccccgagcagctgagaaccaccagcagagtgatcccccaccccagatacgaggccagaagccacagaaacgacatcatgctgctgagactggtgcagcccgccagactgaacccccaggtgagacccgccgtgctgcccaccagatgcccccaccccggcgaggcctgcgtggtgagcggctggggcctggtgagccacaacgagcccggcaccgccggcagccccagaagccaggtgagcctgcccgacaccctgcactgcgccaacatcagcatcatcagcgacaccagctgcgacaagagctaccccggcagactgaccaacaccatggtgtgcgccggcgccgagggcagaggcgccgagagctgcgagggcgacagcggcggccccctggtgtgcggcggcatcctgcagggcatcgtgagctggggcgacgtgccctgcgacaacaccaccaagcccggcgtgtacaccaaggtgtgccactacctggagtggatcagagagaccatgaagagaaactag

SEQ ID NO: 85953 - DNA, 516 bp, Artificial Sequence
  Description of Artificial Sequence: Synthetic coding sequence
atgtggctgctgctgaccctgagcttcctgctggccagcaccgccgcccaggacggcgacaagctgctggagggcgacgagtgcgccccccacagccagccctggcaggtggccctgtacgagagaggcagattcaactgcggcgccagcctgatcagcccccactgggtgctgagcgccgcccactgccagagcagattcatgagagtgagactgggcgagcacaacctgagaaagagagacggccccgagcagctgagaaccaccagcagagtgatcccccaccccagatacgaggccagaagccacagaaacgacatcatgctgctgagactggtgcagcccgccagactgaacccccagggcgacagcggcggccccctggtgtgcggcggcatcctgcagggcatcgtgagctggggcgacgtgccctgcgacaacaccaccaagcccggcgtgtacaccaaggtgtgccactacctggagtggatcagagagaccatgaagagaaactag

SEQ ID NO: 85954 - DNA, 489 bp, Artificial Sequence
  Description of Artificial Sequence: Synthetic coding sequence
atgtggctgctgctgaccctgagcttcctgctggccagcaccgccgcccaggacggcgacaagctgctggagggcgacgagtgcgccccccacagccagccctggcaggtggccctgtacgagagaggcagattcaactgcggcgccagcctgatcagcccccactgggtgctgagcgccgcccactgccagagcagattcatgagagtgagactgggcgagcacaacctgagaaagagagacggccccgagcagctgagaaccaccagcagagtgatcccccaccccagatacgaggccagaagccacagaaacgacatcatgctgctgagactggtgcagcccgccagactgaacccccaggtgagacccgccgtgctgcccaccagatgcccccaccccggcgaggcctgcgtggtgagcggctggggcctggtgagccacaacgagcccggcaccgccggcagccccagaagccagggcgcctag

SEQ ID NO: 85955 - DNA, 771 bp, Artificial Sequence; identical to SEQ ID NO: 85952
  Description of Artificial Sequence: Synthetic coding sequence

SEQ ID NO: 85956 - DNA, 786 bp, Artificial Sequence
  Description of Artificial Sequence: Synthetic coding sequence
atgtgggacctggtgctgagcatcgccctgagcgtgggctgcaccggcgccgtgcccctgatccagagcagaatcgtgggcggctgggagtgcgagaagcacagccagccctggcaggtggccgtgtacagccacggctgggcccactgcggcggcgtgctggtgcacccccagtgggtgctgaccgccgcccactgcctgaagaagaacagccaggtgtggctgggcagacacaacctgttcgagcccgaggacaccggccagagagtgcccgtgagccacagcttcccccaccccctgtacaacatgagcctgctgaagcaccagagcctgagacccgacgaggacagcagccacgacctgatgctgctgagactgagcgagcccgccaagatcaccgacgtggtgaaggtgctgggcctgcccacccaggagcccgccctgggcaccacctgctacgccagcggctggggcagcatcgagcccgaggagttcctgagacccagaagcctgcagtgcgtgagcctgcacctgctgagcaacgacatgtgcgccagagcctacagcgagaaggtgaccgagttcatgctgtgcgccggcctgtggaccggcggcaaggacacctgcggcggcgacagcggcggccccctggtgtgcaacggcgtgctgcagggcatcaccagctggggccccgagccctgcgccctgcccgagaagcccgccgtgtacaccaaggtggtgcactacagaaagtggatcaaggacaccatcgccgccaacccctag

SEQ ID NO: 85957 - DNA, 672 bp, Artificial Sequence
  Description of Artificial Sequence: Synthetic coding sequence
atgtgggacctggtgctgagcatcgccctgagcgtgggctgcaccggcgccgtgcccctgatccagagcagaatcgtgggcggctgggagtgcgagaagcacagccagccctggcaggtggccgtgtacagccacggctgggcccactgcggcggcgtgctggtgcacccccagtgggtgctgaccgccgcccactgcctgaagaagaacagccaggtgtggctgggcagacacaacctgttcgagcccgaggacaccggccagagagtgcccgtgagccacagcttcccccaccccctgtacaacatgagcctgctgaagcaccagagcctgagacccgacgaggacagcagccacgacctgatgctgctgagactgagcgagcccgccaagatcaccgacgtggtgaaggtgctgggcctgcccacccaggagcccgccctgggcaccacctgctacgccagcggctggggcagcatcgagcccgaggagttcctgagacccagaagcctgcagtgcgtgagcctgcacctgctgagcaacgacatgtgcgccagagcctacagcgagaaggtgaccgagttcatgctgtgcgccggcctgtggaccggcggcaaggacacctgcggcgtgagccacccctacagccagcacctggagggcaagggctag

SEQ ID NO: 85958 - DNA, 480 bp, Artificial Sequence
  Description of Artificial Sequence: Synthetic coding sequence
atgagcctgctgaagcaccagagcctgagacccgacgaggacagcagccacgacctgatgctgctgagactgagcgagcccgccaagatcaccgacgtggtgaaggtgctgggcctgcccacccaggagcccgccctgggcaccacctgctacgccagcggctggggcagcatcgagcccgaggagttcctgagacccagaagcctgcagtgcgtgagcctgcacctgctgagcaacgacatgtgcgccagagcctacagcgagaaggtgaccgagttcatgctgtgcgccggcctgtggaccggcggcaaggacacctgcggcggcgacagcggcggccccctggtgtgcaacggcgtgctgcagggcatcaccagctggggccccgagccctgcgccctgcccgagaagcccgccgtgtacaccaaggtggtgcactacagaaagtggatcaaggacaccatcgccgccaacccctag

SEQ ID NO: 85959 - DNA, 786 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaacaagagcgtgatcctgctgggcagacacagcctgttccaccccgaggacaccggccaggtgttccaggtgagccacagcttcccccaccccctgtacgacatgagcctgctgaagaacagattcctgagacccggcgacgacagcagccacgacctgatgctgctgagactgagcgagcccgccgagctgaccgacgccgtgaaggtgatggacctgcccacccaggagcccgccctgggcaccacctgctacgccagcggctggggcagcatcgagcccgaggagttcctgacccccaagaagctgcagtgcgtggacctgcacgtgatcagcaacgacgtgtgcgcccaggtgcacccccagaaggtgaccaagttcatgctgtgcgccggcagatggaccggcggcaagagcacctgcagcggcgacagcggcggccccctggtgtgcaacggcgtgctgcagggcatcaccagctggggcagcgagccctgcgccctgcccgagagacccagcctgtacaccaaggtggtgcactacagaaagtggatcaaggacaccatcgtggccaacccctag

SEQ ID NO: 85960 - DNA, 663 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaacaagagcgtgatcctgctgggcagacacagcctgttccaccccgaggacaccggccaggtgttccaggtgagccacagcttcccccaccccctgtacgacatgagcctgctgaagaacagattcctgagacccggcgacgacagcagcatcgagcccgaggagttcctgacccccaagaagctgcagtgcgtggacctgcacgtgatcagcaacgacgtgtgcgcccaggtgcacccccagaaggtgaccaagttcatgctgtgcgccggcagatggaccggcggcaagagcacctgcagcggcgacagcggcggccccctggtgtgcaacggcgtgctgcagggcatcaccagctggggcagcgagccctgcgccctgcccgagagacccagcctgtacaccaaggtggtgcactacagaaagtggatcaaggacaccatcgtggccaacccctag

SEQ ID NO: 85961 - DNA, 717 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaacaagagcgtgatcctgctgggcagacacagcctgttccaccccgaggacaccggccaggtgttccaggtgagccacagcttcccccaccccctgtacgacatgagcctgctgaagaacagattcctgagacccggcgacgacagcagccacgacctgatgctgctgagactgagcgagcccgccgagctgaccgacgccgtgaaggtgatggacctgcccacccaggagcccgccctgggcaccacctgctacgccagcggctggggcagcatcgagcccgaggagttcctgacccccaagaagctgcagtgcgtggacctgcacgtgatcagcaacgacgtgtgcgcccaggtgcacccccagaaggtgaccaagttcatgctgtgcgccggcagatggaccggcggcaagagcacctgcagctgggtgatcctgatcaccgagctgaccatgcccgccctgcccatggtgctgcacggcagcctggtgccctggagaggcggcgtgtag

SEQ ID NO: 85962 - DNA, 657 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaagcccggcgacgacagcagccacgacctgatgctgctgagactgagcgagcccgccgagctgaccgacgccgtgaaggtgatggacctgcccacccaggagcccgccctgggcaccacctgctacgccagcggctggggcagcatcgagcccgaggagttcctgacccccaagaagctgcagtgcgtggacctgcacgtgatcagcaacgacgtgtgcgcccaggtgcacccccagaaggtgaccaagttcatgctgtgcgccggcagatggaccggcggcaagagcacctgcagcggcgacagcggcggccccctggtgtgcaacggcgtgctgcagggcatcaccagctggggcagcgagccctgcgccctgcccgagagacccagcctgtacaccaaggtggtgcactacagaaagtggatcaaggacaccatcgtggccaacccctag

SEQ ID NO: 85963 - DNA, 210 bp, Artificial Sequence
  Description of Artificial Sequence: Synthetic coding sequence
atgtgggtgcccgtggtgttcctgaccctgagcgtgacctggatcggcgccgcccccctgatcctgagcagaatcgtgggcggctgggagtgcgagaagcacagccagccctggcaggtgctggtggccagcagaggcagagccgtgtgcggcggcgtgctggtgcacccccagtgggtgctgaccgccgcccactgcatcagaaagtag

SEQ ID NO: 85964 - DNA, 765 bp, Artificial Sequence
  Description of Artificial Sequence: Synthetic coding sequence
atggccaccgccggcaacccctggggctggttcctgggctacctgatcctgggcgtggccggcagcctggtgagcggcagctgcagccagatcatcaacggcgaggactgcagcccccacagccagccctggcaggccgccctggtgatggagaacgagctgttctgcagcggcgtgctggtgcacccccagtgggtgctgagcgccgcccactgcttccagaacagctacaccatcggcctgggcctgcacagcctggaggccgaccaggagcccggcagccagatggtggaggccagcctgagcgtgagacaccccgagtacaacagacccctgctggccaacgacctgatgctgatcaagctggacgagagcgtgagcgagagcgacaccatcagaagcatcagcatcgccagccagtgccccaccgccggcaacagctgcctggtgagcggctggggcctgctggccaacggcagaatgcccaccgtgctgcagtgcgtgaacgtgagcgtggtgagcgaggaggtgtgcagcaagctgtacgaccccctgtaccaccccagcatgttctgcgccggcggcggccacgaccagaaggacagctgcaacggcgacagcggcggccccctgatctgcaacggctacctgcagggcctggtgagcttcggcaaggccccctgcggccaggtgggcgtgcccggcgtgtacaccaacctgtgcaagttcaccgagtggatcgagaagaccgtgcaggccagctag

SEQ ID NO: 85965 - DNA, 333 bp, Artificial Sequence
  Description of Artificial Sequence: Synthetic coding sequence
atggagaacgagctgttctgcagcggcgtgctggtgcacccccagtgggtgctgagcgccgcccactgcttccagaacagctacaccatcggcctgggcctgcacagcctggaggccgaccaggagcccggcagccagatggtggaggccagcctgagcgtgagacaccccgagtacaacagacccctgctggccaacgacctgatgctgatcaagctggacgagagcgtgagcgagagcgacaccatcagaagcatcagcatcgccagccagtgccccaccgccggcaacagctgcctggtgagcggctggggcctgctggccaacggctag

SEQ ID NO: 85966 - DNA, 735 bp, Artificial Sequence
  Description of Artificial Sequence: Synthetic coding sequence
atgaagaagctgatggtggtgctgagcctgatcgccgccgcctgggccgaggagcagaacaagctggtgcacggcggcccctgcgacaagaccagccacccctaccaggccgccctgtacaccagcggccacctgctgtgcggcggcgtgctgatccaccccctgtgggtgctgaccgccgcccactgcaagaagcccaacctgcaggtgttcctgggcaagcacaacctgagacagagagagagcagccaggagcagagcagcgtggtgagagccgtgatccaccccgactacgacgccgccagccacgaccaggacatcatgctgctgagactggccagacccgccaagctgagcgagctgatccagcccctgcccctggagagagactgcagcgccaacaccaccagctgccacatcctgggctggggcaagaccgccgacggcgacttccccgacaccatccagtgcgcctacatccacctggtgagcagagaggagtgcgagcacgcctaccccggccagatcacccagaacatgctgtgcgccggcgacgagaagtacggcaaggacagctgccagggcgacagcggcggccccctggtgtgcggcgaccacctgagaggcctggtgagctggggcaacatcccctgcggcagcaaggagaagcccggcgtgtacaccaacgtgtgcagatacaccaactggatccagaagaccatccaggccaagtag

SEQ ID NO: 85967 - DNA, 735 bp, Artificial Sequence; identical to SEQ ID NO: 85966
  Description of Artificial Sequence: Synthetic coding sequence

SEQ ID NO: 85968 - DNA, 363 bp, Artificial Sequence
  Description of Artificial Sequence: Synthetic coding sequence
atgaagaagctgatggtggtgctgagcctgatcgccgccgcctgggccgaggagcagaacaagctggtgcacggcggcccctgcgacaagaccagccacccctaccaggccgccctgtacaccagcggccacctgctgtgcggcggcgtgctgatccaccccctgtgggtgctgaccgccgcccactgcaagaagcccgtgatcctgggcgtgagatggtacgtggagaccaccagcgaggccctgtgccacggcgtgaccagccccgtggaccagagaagaagccaggagagcacccccaccagcgccgacaccagaaccggcagcaagaagcccttcagacccagcgaccccgacatgtag

SEQ ID NO: 85969 - DNA, 414 bp, Artificial Sequence
  Description of Artificial Sequence: Synthetic coding sequence
atgctgctgagactggccagacccgccaagctgagcgagctgatccagcccctgcccctggagagagactgcagcgccaacaccaccagctgccacatcctgggctggggcaagaccgccgacggcgacttccccgacaccatccagtgcgcctacatccacctggtgagcagagaggagtgcgagcacgcctaccccggccagatcacccagaacatgctgtgcgccggcgacgagaagtacggcaaggacagctgccagggcgacagcggcggccccctggtgtgcggcgaccacctgagaggcctggtgagctggggcaacatcccctgcggcagcaaggagaagcccggcgtgtacaccaacgtgtgcagatacaccaactggatccagaagaccatccaggccaagtag

SEQ ID NO: 85970 - DNA, 123 bp, Artificial Sequence
  Description of Artificial Sequence: Synthetic coding sequence
atgaagaagctgatggtggtgctgagcctgatcgccgccggcatcttcagaagcagctggggcagcatcaccttcggcaagggcagagtgcccagaagcagagtgctgctgagcggcctgtag

SEQ ID NO: 85971 - DNA, 414 bp, Artificial Sequence; identical to SEQ ID NO: 85969
  Description of Artificial Sequence: Synthetic coding sequence

SEQ ID NO: 85972 - DNA, 783 bp, Artificial Sequence
  Description of Artificial Sequence: Synthetic coding sequence
atgggcagacccagacccagagccgccaagacctggatgttcctgctgctgctgggcggcgcctgggccggccacagcagagcccaggaggacaaggtgctgggcggccacgagtgccagccccacagccagccctggcaggccgccctgttccagggccagcagctgctgtgcggcggcgtgctggtgggcggcaactgggtgctgaccgccgcccactgcaagaagcccaagtacaccgtgagactgggcgaccacagcctgcagaacaaggacggccccgagcaggagatccccgtggtgcagagcatcccccacccctgctacaacagcagcgacgtggaggaccacaaccacgacctgatgctgctgcagctgagagaccaggccagcctgggcagcaaggtgaagcccatcagcctggccgaccactgcacccagcccggccagaagtgcaccgtgagcggctggggcaccgtgaccagccccagagagaacttccccgacaccctgaactgcgccgaggtgaagatcttcccccagaagaagtgcgaggacgcctaccccggccagatcaccgacggcatggtgtgcgccggcagcagcaagggcgccgacacctgccagggcgacagcggcggccccctggtgtgcgacggcgccctgcagggcatcaccagctggggcagcgacccctgcggcagaagcgacaagcccggcgtgtacaccaacatctgcagatacctggactggatcaagaagatcatcggcagcaagggctag

SEQ ID NO: 85973 - DNA, 99 bp, Artificial Sequence
  Description of Artificial Sequence: Synthetic coding sequence
atgggcagacccagacccagagccgccaagacctggatgttcctgctgctgctgggcggcgcctgggccggcagattctggagaccccccggcgtgtag

SEQ ID NO: 85974 - DNA, 360 bp, Artificial Sequence
  Description of Artificial Sequence: Synthetic coding sequence
atgggcagacccagacccagagccgccaagacctggatgttcctgctgctgctgggcggcgcctgggccgagaacttccccgacaccctgaactgcgccgaggtgaagatcttcccccagaagaagtgcgaggacgcctaccccggccagatcaccgacggcatggtgtgcgccggcagcagcaagggcgccgacacctgccagggcgacagcggcggccccctggtgtgcgacggcgccctgcagggcatcaccagctggggcagcgacccctgcggcagaagcgacaagcccggcgtgtacaccaacatctgcagatacctggactggatcaagaagatcatcggcagcaagggctag

SEQ ID NO: 85975 - DNA, 918 bp, Artificial Sequence
  Description of Artificial Sequence: Synthetic coding sequence
atgggcagacccagacccagagccgccaagacctggatgttcctgctgctgctgggcggcgcctgggccgcctgcggcagcctggacctgctgaccaagctgtacgccgagaacctgccctgcgtgcacctgaacccccagtggcccagccagcccagccactgccccagaggctggagaagcaaccccctgccccccgccgccggccacagcagagcccaggaggacaaggtgctgggcggccacgagtgccagccccacagccagccctggcaggccgccctgttccagggccagcagctgctgtgcggcggcgtgctggtgggcggcaactgggtgctgaccgccgcccactgcaagaagcccaagtacaccgtgagactgggcgaccacagcctgcagaacaaggacggccccgagcaggagatccccgtggtgcagagcatcccccacccctgctacaacagcagcgacgtggaggaccacaaccacgacctgatgctgctgcagctgagagaccaggccagcctgggcagcaaggtgaagcccatcagcctggccgaccactgcacccagcccggccagaagtgcaccgtgagcggctggggcaccgtgaccagccccagagagaacttccccgacaccctgaactgcgccgaggtgaagatcttcccccagaagaagtgcgaggacgcctaccccggccagatcaccgacggcatggtgtgcgccggcagcagcaagggcgccgacacctgccagggcgacagcggcggccccctggtgtgcgacggcgccctgcagggcatcaccagctggggcagcgacccctgcggcagaagcgacaagcccggcgtgtacaccaacatctgcagatacctggactggatcaagaagatcatcggcagcaagggctag

SEQ ID NO: 85976 - DNA, 783 bp, Artificial Sequence; identical to SEQ ID NO: 85972
  Description of Artificial Sequence: Synthetic coding sequence

SEQ ID NO: 85977 - DNA, 753 bp, Artificial Sequence
  Description of Artificial Sequence: Synthetic coding sequence
atgaagctgggcctgctgtgcgccctgctgagcctgctggccggccacggctgggccgacaccagagccatcggcgccgaggagtgcagacccaacagccagccctggcaggccggcctgttccacctgaccagactgttctgcggcgccaccctgatcagcgacagatggctgctgaccgccgcccactgcagaaagccctacctgtgggtgagactgggcgagcaccacctgtggaagtgggagggccccgagcagctgttcagagtgaccgacttcttcccccaccccggcttcaacaaggacctgagcgccaacgaccacaacgacgacatcatgctgatcagactgcccagacaggccagactgagccccgccgtgcagcccctgaacctgagccagacctgcgtgagccccggcatgcagtgcctgatcagcggctggggcgccgtgagcagccccaaggccctgttccccgtgaccctgcagtgcgccaacatcagcatcctggagaacaagctgtgccactgggcctaccccggccacatcagcgacagcatgctgtgcgccggcctgtgggagggcggcagaggcagctgccagggcgacagcggcggccccctggtgtgcaacggcaccctggccggcgtggtgagcggcggcgccgagccctgcagcagacccagaagacccgccgtgtacaccagcgtgtgccactacctggactggatccaggagatcatggagaactag

SEQ ID NO: 85978 - DNA, 753 bp, Artificial Sequence; identical to SEQ ID NO: 85977
  Description of Artificial Sequence: Synthetic coding sequence

SEQ ID NO: 85979 - DNA, 186 bp, Artificial Sequence
  Description of Artificial Sequence: Synthetic coding sequence
atgaagctgggcctgctgtgcgccctgctgagcctgctggccggcatctgcggcagcgccctggagagcaccaccagcggcaacggcagagtgagaagcagctgcagcggcctgagaaccagcagccccaccctggccagcaccagaaccagcgcccccatgaccaccatgatgaccagctgctag

SEQ ID NO: 85980 - DNA, 2043 bp, Artificial Sequence
  Description of Artificial Sequence: Synthetic coding sequence
atggtgcccggcgtgcccggcgccgtgctgaccctgtgcctgtggctggccgccagcagcggctgcctggccgccggccccggcgccgccgccgccagaagactggacgagagcctgagcgccggcagcgtgcagagagccagatgcgccagcagatgcctgagcctgcagatcaccagaatcagcgccttcttccagcacttccagaacaacggcagcctggtgtggtgccagaaccacaagcagtgcagcaagtgcctggagccctgcaaggagagcggcgacctgagaaagcaccagtgccagagcttctgcgagcccctgttccccaagaagagctacgagtgcctgaccagctgcgagttcctgaagtacatcctgctggtgaagcagggcgactgccccgcccccgagaaggccagcggcttcgccgccgcctgcgtggagagctgcgaggtggacaacgagtgcagcggcgtgaagaagtgctgcagcaacggctgcggccacacctgccaggtgcccaagaccctgtacaagggcgtgcccctgaagcccagaaaggagctgagattcaccgagctgcagagcggccagctggaggtgaagtggagcagcaagttcaacatcagcatcgagcccgtgatctacgtggtgcagagaagatggaactacggcatccaccccagcgaggacgacgccacccactggcagaccgtggcccagaccaccgacgagagagtgcagctgaccgacatcagacccagcagatggtaccagttcagagtggccgccgtgaacgtgcacggcaccagaggcttcaccgcccccagcaagcacttcagaagcagcaaggaccccagcgccccccccgcccccgccaacctgagactggccaacagcaccgtgaacagcgacggcagcgtgaccgtgaccatcgtgtgggacctgcccgaggagcccgacatccccgtgcaccactacaaggtgttctggagctggatggtgagcagcaagagcctggtgcccaccaagaagaagagaagaaagaccaccgacggcttccagaacagcgtgatcctggagaagctgcagcccgactgcgactacgtggtggagctgcaggccatcacctactggggccagaccagactgaagagcgccaaggtgagcctgcacttcaccagcacccacgccaccaacaacaaggagcagctggtgaagaccagaaagggcggcatccagacccagctgcccttccagagaagaagacccaccagacccctggaggtgggcgcccccttctaccaggacggccagctgcaggtgaaggtgtactggaagaagaccgaggaccccaccgtgaacagataccacgtgagatggttccccgaggcctgcgcccacaacagaaccaccggcagcgaggccagcagcggcatgacccacgagaactacatcatcctgcaggacctgagcttcagctgcaagtacaaggtgaccgtgcagcccatcagacccaagagccacagcaaggccgaggccgtgttcttcaccacccccccctgcagcgccctgaagggcaagagccacaagcccgtgggctgcctgggcgaggccggccacgtgctgagcaaggtgctggccaagcccgagaacctgagcgccagcttcatcgtgcaggacgtgaacatcaccggccacttcagctggaagatggccaaggccaacctgtaccagcccatgaccggcttccaggtgacctgggccgaggtgaccaccgagagcagacagaacagcctgcccaacagcatcatcagccagagccagatcctgcccagcgaccactacgtgctgaccgtgcccaacctgagacccagcaccctgtacagactggaggtgcaggtgctgacccccggcggcgagggccccgccaccatcaagaccttcagaacccccgagctgccccccagcagcgcccacagaagccacctgaagcacagacacccccaccactacaagcccagccccgagagatactag

SEQ ID NO: 85981 - DNA, 2631 bp, Artificial Sequence
  Description of Artificial Sequence: Synthetic coding sequence
atggagctgatcaccatcctggagaagaccgtgagccccgacagactggagctggaggccgcccagaagttcctggagagagccgccgtggagaacctgcccaccttcctggtggagctgagcagagtgctggccaaccccggcaacagccaggtggccagagtggccgccggcctgcagatcaagaacagcctgaccagcaaggaccccgacatcaaggcccagtaccagcagagatggctggccatcgacgccaacgccagaagagaggtgaagaactacgtgctgcagaccctgggcaccgagacctacagacccagcagcgccagccagtgcgtggccggcatcgcctgcgccgagatccccgtgaaccagtggcccgagctgatcccccagctggtggccaacgtgaccaaccccaacagcaccgagcacatgaaggagagcaccctggaggccatcggctacatctgccaggacatcgaccccgagcagctgcaggacaagagcaacgagatcctgaccgccatcatccagggcatgagaaaggaggagcccagcaacaacgtgaagctggccgccaccaacgccctgctgaacagcctggagttcaccaaggccaacttcgacaaggagagcgagagacacttcatcatgcaggtggtgtgcgaggccacccagtgccccgacaccagagtgagagtggccgccctgcagaacctggtgaagatcatgagcctgtactaccagtacatggagacctacatgggccccgccctgttcgccatcaccatcgaggccatgaagagcgacatcgacgaggtggccctgcagggcatcgagttctggagcaacgtgtgcgacgaggagatggacctggccatcgaggccagcgaggccgccgagcagggcagaccccccgagcacaccagcaagttctacgccaagggcgccctgcagtacctggtgcccatcctgacccagaccctgaccaagcaggacgagaacgacgacgacgacgactggaacccctgcaaggccgccggcgtgtgcctgatgctgctggccacctgctgcgaggacgacatcgtgccccacgtgctgcccttcatcaaggagcacatcaagaaccccgactggagatacagagacgccgccgtgatggccttcggctgcatcctggagggccccgagcccagccagctgaagcccctggtgatccaggccatgcccaccctgatcgagctgatgaaggaccccagcgtggtggtgagagacaccgccgcctggaccgtgggcagaatctgcgagctgctgcccgaggccgccatcaacgacgtgtacctggcccccctgctgcagtgcctgatcgagggcctgagcgccgagcccagagtggccagcaacgtgtgctgggccttcagcagcctggccgaggccgcctacgaggccgccgacgtggccgacgaccaggaggagcccgccacctactgcctgagcagcagcttcgagctgatcgtgcagaagctgctggagaccaccgacagacccgacggccaccagaacaacctgagaagcagcgcctacgagagcctgatggagatcgtgaagaacagcgccaaggactgctaccccgccgtgcagaagaccaccctggtgatcatggagagactgcagcaggtgctgcagatggagagccacatccagagcaccagcgacagaatccagttcaacgacctgcagagcctgctgtgcgccaccctgcagaacgtgctgagaaaggtgcagcaccaggacgccctgcagatcagcgacgtggtgatggccagcctgctgagaatgttccagagcaccgccggcagcggcggcgtgcaggaggacgccctgatggccgtgagcaccctggtggaggtgctgggcggcgagttcctgaagtacatggaggccttcaagcccttcctgggcatcggcctgaagaactacgccgagtaccaggtgtgcctggccgccgtgggcctggtgggcgacctgtgcagagccctgcagagcaacatcatccccttctgcgacgaggtgatgcagctgctgctggagaacctgggcaacgagaacgtgcacagaagcgtgaagccccagatcctgagcgtgttcggcgacatcgccctggccatcggcggcgagttcaagaagtacctggaggtggtgctgaacaccctgcagcaggccagccaggcccaggtggacaagagcgactacgacatggtggactacctgaacgagctgagagagagctgcctggaggcctacaccggcatcgtgcagggcctgaagggcgaccaggagaacgtgcaccccgacgtgatgctggtgcagcccagagtggagttcatcctgagcttcatcgaccacatcgccggcgacgaggaccacaccgacggcgtggtggcctgcgccgccggcctgatcggcgacctgtgcaccgccttcggcaaggacgtgctgaagctggtggaggccagacccatgatccacgagctgctgaccgagggcagaagaagcaagaccaacaaggccaagaccctggccacctgggccaccaaggagctgagaaagctgaagaaccaggcctag

SEQ ID NO: 85982 - DNA, 2196 bp, Artificial Sequence
  Description of Artificial Sequence: Synthetic coding sequence
atgaaggagagcaccctggaggccatcggctacatctgccaggacatcgaccccgagcagctgcaggacaagagcaacgagatcctgaccgccatcatccagggcatgagaaaggaggagcccagcaacaacgtgaagctggccgccaccaacgccctgctgaacagcctggagttcaccaaggccaacttcgacaaggagagcgagagacacttcatcatgcaggtggtgtgcgaggccacccagtgccccgacaccagagtgagagtggccgccctgcagaacctggtgaagatcatgagcctgtactaccagtacatggagacctacatgggccccgccctgttcgccatcaccatcgaggccatgaagagcgacatcgacgaggtggccctgcagggcatcgagttctggagcaacgtgtgcgacgaggagatggacctggccatcgaggccagcgaggccgccgagcagggcagaccccccgagcacaccagcaagttctacgccaagggcgccctgcagtacctggtgcccatcctgacccagaccctgaccaagcaggacgagaacgacgacgacgacgactggaacccctgcaaggccgccggcgtgtgcctgatgctgctggccacctgctgcgaggacgacatcgtgccccacgtgctgcccttcatcaaggagcacatcaagaaccccgactggagatacagagacgccgccgtgatggccttcggctgcatcctggagggccccgagcccagccagctgaagcccctggtgatccaggccatgcccaccctgatcgagctgatgaaggaccccagcgtggtggtgagagacaccgccgcctggaccgtgggcagaatctgcgagctgctgcccgaggccgccatcaacgacgtgtacctggcccccctgctgcagtgcctgatcgagggcctgagcgccgagcccagagtggccagcaacgtgtgctgggccttcagcagcctggccgaggccgcctacgaggccgccgacgtggccgacgaccaggaggagcccgccacctactgcctgagcagcagcttcgagctgatcgtgcagaagctgctggagaccaccgacagacccgacggccaccagaacaacctgagaagcagcgcctacgagagcctgatggagatcgtgaagaacagcgccaaggactgctaccccgccgtgcagaagaccaccctggtgatcatggagagactgcagcaggtgctgcagatggagagccacatccagagcaccagcgacagaatccagttcaacgacctgcagagcctgctgtgcgccaccctgcagaacgtgctgagaaaggtgcagcaccaggacgccctgcagatcagcgacgtggtgatggccagcctgctgagaatgttccagagcaccgccggcagcggcggcgtgcaggaggacgccctgatggccgtgagcaccctggtggaggtgctgggcggcgagttcctgaagtacatggaggccttcaagcccttcctgggcatcggcctgaagaactacgccgagtaccaggtgtgcctggccgccgtgggcctggtgggcgacctgtgcagagccctgcagagcaacatcatccccttctgcgacgaggtgatgcagctgctgctggagaacctgggcaacgagaacgtgcacagaagcgtgaagccccagatcctgagcgtgttcggcgacatcgccctggccatcggcggcgagttcaagaagtacctggaggtggtgctgaacaccctgcagcaggccagccaggcccaggtggacaagagcgactacgacatggtggactacctgaacgagctgagagagagctgcctggaggcctacaccggcatcgtgcagggcctgaagggcgaccaggagaacgtgcaccccgacgtgatgctggtgcagcccagagtggagttcatcctgagcttcatcgaccacatcgccggcgacgaggaccacaccgacggcgtggtggcctgcgccgccggcctgatcggcgacctgtgcaccgccttcggcaaggacgtgctgaagctggtggaggccagacccatgatccacgagctgctgaccgagggcagaagaagcaagaccaacaaggccaagaccctggccacctgggccaccaaggagctgagaaagctgaagaaccaggcctag

SEQ ID NO: 85983 - DNA, 1983 bp, Artificial Sequence
  Description of Artificial Sequence: Synthetic coding sequence
atgaaggagagcaccctggaggccatcggctacatctgccaggacatcgaccccgagcagctgcaggacaagagcaacgagatcctgaccgccatcatccagggcatgagaaaggaggagcccagcaacaacgtgaagctggccgccaccaacgccctgctgaacagcctggagttcaccaaggccaacttcgacaaggagagcgagagacacttcatcatgcaggtggtgtgcgaggccacccagtgccccgacaccagagtgagagtggccgccctgcagaacctggtgaagatcatgagcctgtactaccagtacatggagacctacatgggccccgccctgttcgccgacgagaacgacgacgacgacgactggaacccctgcaaggccgccggcgtgtgcctgatgctgctggccacctgctgcgaggacgacatcgtgccccacgtgctgcccttcatcaaggagcacatcaagaaccccgactggagatacagagacgccgccgtgatggccttcggctgcatcctggagggccccgagcccagccagctgaagcccctggtgatccaggccatgcccaccctgatcgagctgatgaaggaccccagcgtggtggtgagagacaccgccgcctggaccgtgggcagaatctgcgagctgctgcccgaggccgccatcaacgacgtgtacctggcccccctgctgcagtgcctgatcgagggcctgagcgccgagcccagagtggccagcaacgtgtgctgggccttcagcagcctggccgaggccgcctacgaggccgccgacgtggccgacgaccaggaggagcccgccacctactgcctgagcagcagcttcgagctgatcgtgcagaagctgctggagaccaccgacagacccgacggccaccagaacaacctgagaagcagcgcctacgagagcctgatggagatcgtgaagaacagcgccaaggactgctaccccgccgtgcagaagaccaccctggtgatcatggagagactgcagcaggtgctgcagatggagagccacatccagagcaccagcgacagaatccagttcaacgacctgcagagcctgctgtgcgccaccctgcagaacgtgctgagaaaggtgcagcaccaggacgccctgcagatcagcgacgtggtgatggccagcctgctgagaatgttccagagcaccgccggcagcggcggcgtgcaggaggacgccctgatggccgtgagcaccctggtggaggtgctgggcggcgagttcctgaagtacatggaggccttcaagcccttcctgggcatcggcctgaagaactacgccgagtaccaggtgtgcctggccgccgtgggcctggtgggcgacctgtgcagagccctgcagagcaacatcatccccttctgcgacgaggtgatgcagctgctgctggagaacctgggcaacgagaacgtgcacagaagcgtgaagccccagatcctgagcgtgttcggcgacatcgccctggccatcggcggcgagttcaagaagtacctggaggtggtgctgaacaccctgcagcaggccagccaggcccaggtggacaagagcgactacgacatggtggactacctgaacgagctgagagagagctgcctggaggcctacaccggcatcgtgcagggcctgaagggcgaccaggagaacgtgcaccccgacgtgatgctggtgcagcccagagtggagttcatcctgagcttcatcgaccacatcgccggcgacgaggaccacaccgacggcgtggtggcctgcgccgccggcctgatcggcgacctgtgcaccgccttcggcaaggacgtgctgaagctggtggaggccagacccatgatccacgagctgctgaccgagggcagaagaagcaagaccaacaaggccaagaccctggccacctgggccaccaaggagctgagaaagctgaagaaccaggcctag

SEQ ID NO: 85984 - DNA, 2196 bp, Artificial Sequence; identical to SEQ ID NO: 85982
  Description of Artificial Sequence: Synthetic coding sequence

SEQ ID NO: 85985 - DNA, 1617 bp, Artificial Sequence
  Description of Artificial Sequence: Synthetic coding sequence
atgaccacccccggcaaggagaacttcagactgaagagctacaagaacaagagcctgaaccccgacgagatgagaagaagaagagaggaggagggcctgcagctgagaaagcagaagagagaggagcagctgttcaagagaagaaacgtggccaccgccgaggaggagaccgaggaggaggtgatgagcgacggcggcttccacgaggcccagatcagcaacatggagatggcccccggcggcgtgatcaccagcgacatgatcgagatgatcttcagcaagagccccgagcagcagctgagcgccacccagaagttcagaaagctgctgagcaaggagcccaacccccccatcgacgaggtgatcagcacccccggcgtggtggccagattcgtggagttcctgaagagaaaggagaactgcaccctgcagttcgagagcgcctgggtgctgaccaacatcgccagcggcaacagcctgcagaccagaatcgtgatccaggccggcgccgtgcccatcttcatcgagctgctgagcagcgagttcgaggacgtgcaggagcaggccgtgtgggccctgggcaacatcgccggcgacagcaccatgtgcagagactacgtgctggactgcaacatcctgccccccctgctgcagctgttcagcaagcagaacagactgaccatgaccagaaacgccgtgtgggccctgagcaacctgtgcagaggcaagagccccccccccgagttcgccaaggtgagcccctgcctgaacgtgctgagctggctgctgttcgtgagcgacaccgacgtgctggccgacgcctgctgggccctgagctacctgagcgacggccccaacgacaagatccaggccgtgatcgacgccggcgtgtgcagaagactggtggagctgctgatgcacaacgactacaaggtggtgagccccgccctgagagccgtgggcaacatcgtgaccggcgacgacatccagacccaggtgatcctgaactgcagcgccctgcagagcctgctgcacctgctgagcagccccaaggagagcatcaagaaggaggcctgctggaccatcagcaacatcaccgccggcaacagagcccagatccagaccgtgatcgacgccaacatcttccccgccctgatcagcatcctgcagaccgccgagttcagaaccagaaaggaggccgcctgggccatcaccaacgccaccagcggcggcagcgccgagcagatcaagtacctggtggagctgggctgcatcaagcccctgtgcgacctgctgaccgtgatggacagcaagatcgtgcaggtggccctgaacggcctggagaacatcctgagactgggcgagcaggaggccaagagaaacggcaccggcatcaacccctactgcgccctgatcgaggaggcctacggcctggacaagatcgagttcctgcagagccacgagaaccaggagatctaccagaaggccttcgacctgatcgagcactacttcggcaccgaggacgaggacagcagcatcgccccccaggtggacctgaaccagcagcagtacatcttccagcagtgcgaggcccccatggagggcttccagctgtag

SEQ ID NO: 85986 - DNA, 987 bp, Artificial Sequence
  Description of Artificial Sequence: Synthetic coding sequence
atgaccacccccggcaaggagaacttcagactgaagagctacaagaacaagagcctgaaccccgacgagatgagaagaagaagagaggaggagggcctgcagctgagaaagcagaagagagaggagcagctgttcaagagaagaaacgtggccaccgccgaggaggagaccgaggaggaggtgatgagcgacggcggcttccacgaggcccagatcagcaacatggagatggcccccggcggcgtgatcaccagcgacatgatcgagatgatcttcagcaagagccccgagcagcagctgagcgccacccagaagttcagaaagctgctgagcaaggagcccaacccccccatcgacgaggtgatcagcacccccggcgtggtggccagattcgtggagttcctgaagagaaaggagaactgcaccctgcagttcgagagcgcctgggtgctgaccaacatcgccagcggcaacagcctgcagaccagaatcgtgatccaggccggcgccgtgcccatcttcatcgagctgctgagcagcgagttcgaggacgtgcaggagcaggccgtgtgggccctgggcaacatcgccggcgacagcaccatgtgcagagactacgtgctggactgcaacatcctgccccccctgctgcagctgttcagcaagcagaacagactgaccatgaccagaaacgccgtgtgggccctgagcaacctgtgcagaggcaagagccccccccccgagttcgccaaggtgagcccctgcctgaacgtgctgagctggctgctgttcgtgagcgacaccgacgtgctggccgacgcctgctgggccctgagctacctgagcgacggccccaacgacaagatccaggccgtgatcgacgccggcgtgtgcagaagactggtggagctgctgatgcacaacgactacaaggtggtgagccccgccctgagagccgtgggcaacatcgtgaccggcgacgactag

SEQ ID NO: 85987 - DNA, 648 bp, Artificial Sequence
  Description of Artificial Sequence: Synthetic coding sequence
atgaccacccccggcaaggagaacttcagactgaagagctacaagaacaagagcctgaaccccgacgagatgagaagaagaagagaggaggagggcctgcagctgagaaagcagaagagagaggagcagctgttcaagagaagaaacgtggccaccgccgaggaggagaccgaggaggaggtgatgagcgacggcggcttccacgaggcccagatcagcaacatggagatggcccccggcggcgtgatcaccagcgacatgatcgagatgatcttcagcaagagccccgagcagcagctgagcgccacccagaagttcagaaagctgctgagcaaggagcccaacccccccatcgacgaggtgatcagcacccccggcgtggtggccagattcgtggagttcctgaagagaaaggagaactgcaccctgcagttcgagagcgcctgggtgctgaccaacatcgccagcggcaacagcctgcagaccagaatcgtgatccaggccggcgccgtgcccatcttcatcgagctgctgagcagcgagttcgaggacgtgcaggagcaggccgtgtgggccctgggcaacatcgccggcgacagcaccatgtgcagagactacgtgctggactgcaacatcctgcccccctag

SEQ ID NO: 85988 - DNA, 525 bp, Artificial Sequence
  Description of Artificial Sequence: Synthetic coding sequence
atgaccacccccggcaaggagaacttcagactgaagagctacaagaacaagagcctgaaccccgacgagatgagaagaagaagagaggaggagggcctgcagctgagaaagcagaagagagaggagcagctgttcaagagaagaaacgtggccaccgccgaggaggagaccgaggaggaggtgatgagcgacggcggcttccacgaggcccagatcagcaacatggagatggcccccggcggcgtgatcaccagcgacatgatcgagatgatcttcagcaagagccccgagcagcagctgagcgccacccagaagttcagaaagctgctgagcaaggagcccaacccccccatcgacgaggtgatcagcacccccggcgtggtggccagattcgtggagttcctgaagagaaaggagaactgcaccctgcagttcgagagcgcctgggtgctgaccaacatcgccagcggcaacagcctgcagaccagaatcgtgatccaggccggcgccgtgcccatcttctag

SEQ ID NO: 85989 - DNA, 1566 bp, Artificial Sequence
  Description of Artificial Sequence: Synthetic coding sequence
atggccgagaaccccagcctggagaaccacagaatcaagagcttcaagaacaagggcagagacgtggagaccatgagaagacacagaaacgaggtgaccgtggagctgagaaagaacaagagagacgagcacctgctgaagaagagaaacgtgccccaggaggagagcctggaggacagcgacgtggacgccgacttcaaggcccagaacgtgaccctggaggccatcctgcagaacgccaccagcgacaaccccgtggtgcagctgagcgccgtgcaggccgccagaaagctgctgagcagcgacagaaacccccccatcgacgacctgatcaagagcggcatcctgcccatcctggtgaagtgcctggagagagacgacaaccccagcctgcagttcgaggccgcctgggccctgaccaacatcgccagcggcaccagcgcccagacccaggccgtggtgcagagcaacgccgtgcccctgttcctgagactgctgagaagcccccaccagaacgtgtgcgagcaggccgtgtgggccctgggcaacatcatcggcgacggcccccagtgcagagactacgtgatcagcctgggcgtggtgaagcccctgctgagcttcatcagccccagcatccccatcaccttcctgagaaacgtgacctgggtgatcgtgaacctgtgcagaaacaaggacccccccccccccatggagaccgtgcaggagatcctgcccgccctgtgcgtgctgatctaccacaccgacatcaacatcctggtggacaccgtgtgggccctgagctacctgaccgacggcggcaacgagcagatccagatggtgatcgacagcggcgtggtgcccttcctggtgcccctgctgagccaccaggaggtgaaggtgcagaccgccgccctgagagccgtgggcaacatcgtgaccggcaccgacgagcagacccaggtggtgctgaactgcgacgtgctgagccacttccccaacctgctgagccaccccaaggagaagatcaacaaggaggccgtgtggttcctgagcaacatcaccgccggcaaccagcagcaggtgcaggccgtgatcgacgccggcctgatccccatgatcatccaccagctggccaagggcgacttcggcacccagaaggaggccgcctgggccatcagcaacctgaccatcagcggcagaaaggaccaggtggagtacctggtgcagcagaacgtgatcccccccttctgcaacctgctgagcgtgaaggacagccaggtggtgcaggtggtgctggacggcctgaagaacatcctgatcatggccggcgacgaggccagcaccatcgccgagatcatcgaggagtgcggcggcctggagaagatcgaggtgctgcagcagcacgagaacgaggacatctacaagctggccttcgagatcatcgaccagtacttcagcggcgacgacatcgacgaggacccctgcctgatccccgaggccacccagggcggcacctacaacttcgaccccaccgccaacctgcagaccaaggagttcaacttctag

SEQ ID NO: 85990 - DNA, 1566 bp, Artificial Sequence
  Description of Artificial Sequence: Synthetic coding sequence
atggccgacaacgagaagctggacaaccagagactgaagaacttcaagaacaagggcagagacctggagaccatgagaagacagagaaacgaggtggtggtggagctgagaaagaacaagagagacgagcacctgctgaagagaagaaacgtgccccacgaggacatctgcgaggacagcgacatcgacggcgactacagagtgcagaacaccagcctggaggccatcgtgcagaacgccagcagcgacaaccagggcatccagctgagcgccgtgcaggccgccagaaagctgctgagcagcgacagaaacccccccatcgacgacctgatcaagagcggcatcctgcccatcctggtgcactgcctggagagagacgacaaccccagcctgcagttcgaggccgcctgggccctgaccaacatcgccagcggcaccagcgagcagacccaggccgtggtgcagagcaacgccgtgcccctgttcctgagactgctgcacagcccccaccagaacgtgtgcgagcaggccgtgtgggccctgggcaacatcatcggcgacggcccccagtgcagagactacgtgatcagcctgggcgtggtgaagcccctgctgagcttcatcagccccagcatccccatcaccttcctgagaaacgtgacctgggtgatggtgaacctgtgcagacacaaggacccccccccccccatggagaccatccaggagatcctgcccgccctgtgcgtgctgatccaccacaccgacgtgaacatcctggtggacaccgtgtgggccctgagctacctgaccgacgccggcaacgagcagatccagatggtgatcgacagcggcatcgtgccccacctggtgcccctgctgagccaccaggaggtgaaggtgcagaccgccgccctgagagccgtgggcaacatcgtgaccggcaccgacgagcagacccaggtggtgctgaactgcgacgccctgagccacttccccgccctgctgacccaccccaaggagaagatcaacaaggaggccgtgtggttcctgagcaacatcaccgccggcaaccagcagcaggtgcaggccgtgatcgacgccaacctggtgcccatgatcatccacctgctggacaagggcgacttcggcacccagaaggaggccgcctgggccatcagcaacctgaccatcagcggcagaaaggaccaggtggcctacctgatccagcagaacgtgatcccccccttctgcaacctgctgaccgtgaaggacgcccaggtggtgcaggtggtgctggacggcctgagcaacatcctgaagatggccgaggacgaggccgagaccatcggcaacctgatcgaggagtgcggcggcctggagaagatcgagcagctgcagaaccacgagaacgaggacatctacaagctggcctacgagatcatcgaccagttcttcagcagcgacgacatcgacgaggaccccagcctggtgcccgaggccatccagggcggcaccttcggcttcaacagcagcgccaacgtgcccaccgagggcttccagttctag

SEQ ID NO: 85991 - DNA, 1551 bp, Artificial Sequence
  Description of Artificial Sequence: Synthetic coding sequence
atgcccaccctggacgcccccgaggagagaagaagaaagttcaagtacagaggcaaggacgtgagcctgagaagacagcagagaatggccgtgagcctggagctgagaaaggccaagaaggacgagcagaccctgaagagaagaaacatcaccagcttctgccccgacacccccagcgagaagaccgccaagggcgtggccgtgagcctgaccctgggcgagatcatcaagggcgtgaacagcagcgaccccgtgctgtgcttccaggccacccagaccgccagaaagatgctgagccaggagaagaacccccccctgaagctggtgatcgaggccggcctgatccccagaatggtggagttcctgaagagcagcctgtacccctgcctgcagttcgaggccgcctgggccctgaccaacatcgccagcggcaccagcgagcagaccagagccgtggtggagggcggcgccatccagcccctgatcgagctgctgagcagcagcaacgtggccgtgtgcgagcaggccgtgtgggccctgggcaacatcgccggcgacggccccgagttcagagacaacgtgatcaccagcaacgccatcccccacctgctggccctgatcagccccaccctgcccatcaccttcctgagaaacatcacctggaccctgagcaacctgtgcagaaacaagaacccctacccctgcgacaccgccgtgaagcagatcctgcccgccctgctgcacctgctgcagcaccaggacagcgaggtgctgagcgacgcctgctgggccctgagctacctgaccgacggcagcaacaagagaatcggccaggtggtgaacaccggcgtgctgcccagactggtggtgctgatgaccagcagcgagctgaacgtgctgacccccagcctgagaaccgtgggcaacatcgtgaccggcaccgacgagcagacccagatggccatcgacgccggcatgctgaacgtgctgccccagctgctgcagcacaacaagcccagcatccagaaggaggccgcctgggccctgagcaacgtggccgccggcccctgccaccacatccagcagctgctggcctacgacgtgctgccccccctggtggccctgctgaagaacggcgagttcaaggtgcagaaggaggccgtgtggatggtggccaacttcgccaccggcgccaccatggaccagctgatccagctggtgcacagcggcgtgctggagcccctggtgaacctgctgaccgcccccgacgtgaagatcgtgctgatcatcctggacgtgatcagctgcatcctgcaggccgccgagaagagaagcgagaaggagaacctgtgcctgctgatcgaggagctgggcggcatcgacagaatcgaggccctgcagctgcacgagaacagacagatcggccagagcgccctgaacatcatcgagaagcacttcggcgaggaggaggacgagagccagaccctgctgagccaggtgatcgaccaggactacgagttcatcgactacgagtgcctggccaagaagtag

SEQ ID NO: 85992 - DNA, 3318 bp, Artificial Sequence
  Description of Artificial Sequence: Synthetic coding sequence
atggccgccatggcccccgccctgaccgacgccgccgccgaggcccaccacatcagattcaagctggccccccccagcagcaccctgagccccggcagcgccgagaacaacggcaacgccaacatcctgatcgccgccaacggcaccaagagaaaggccatcgccgccgaggaccccagcctggacttcagaaacaaccccaccaaggaggacctgggcaagctgcagcccctggtggccagctacctgtgcagcgacgtgaccagcgtgcccagcaaggagagcctgaagctgcagggcgtgttcagcaagcagaccgtgctgaagagccaccccctgctgagccagagctacgagctgagagccgagctgctgggcagacagcccgtgctggagttcagcctggagaacctgagaaccatgaacaccagcggccagaccgccctgccccaggcccccgtgaacggcctggccaagaagctgaccaagagcagcacccacagcgaccacgacaacagcaccagcctgaacggcggcaagagagccctgaccagcagcgccctgcacggcggcgagatgggcggcagcgagagcggcgacctgaagggcggcatgaccaactgcaccctgccccacagaagcctggacgtggagcacaccaccctgtacagcaacaacagcaccgccaacaagagcagcgtgaacagcatggagcagcccgccctgcagggcagcagcagactgagccccggcaccgacagcagcagcaacctgggcggcgtgaagctggagggcaagaagagccccctgagcagcatcctgttcagcgccctggacagcgacaccagaatcaccgccctgctgagaagacaggccgacatcgagagcagagccagaagactgcagaagagactgcaggtggtgcaggccaagcaggtggagagacacatccagcaccagctgggcggcttcctggagaagaccctgagcaagctgcccaacctggagagcctgagacccagaagccagctgatgctgaccagaaaggccgaggccgccctgagaaaggccgccagcgagaccaccaccagcgagggcctgagcaacttcctgaagagcaacagcatcagcgaggagctggagagattcaccgccagcggcatcgccaacctgagatgcagcgagcaggccttcgacagcgacgtgaccgacagcagcagcggcggcgagagcgacatcgaggaggaggagctgaccagagccgaccccgagcagagacacgtgcccctgagaagaagaagcgagtggaagtgggccgccgacagagccgccatcgtgagcagatggaactggctgcaggcccacgtgagcgacctggagtacagaatcagacagcagaccgacatctacaagcagatcagagccaacaagggcctgatcgtgctgggcgaggtgcccccccccgagcacaccaccgacctgttcctgcccctgagcagcgaggtgaagaccgaccacggcaccgacaagctgatcgagagcgtgagccagcccctggagaaccacggcgccagaatcatcggccacatcagcgagagcctgagcaccaagagctgcggcgccctgagacccgtgaacggcgtgatcaacaccctgcagcccgtgctggccgaccacatccccggcgacagcagcgacgccgaggagcagctgcacaagaagcagagactgaacctggtgagcagcagcagcgacggcacctgcgtggccgccagaaccagacccgtgctgagctgcaagaagagaagactggtgagacccaacagcatcgtgcccctgagcaagaaggtgcacagaaacagcaccatcagacccggctgcgacgtgaaccccagctgcgccctgtgcggcagcggcagcatcaacaccatgccccccgagatccactacgaggcccccctgctggagagactgagccagctggacagctgcgtgcaccccgtgctggccttccccgacgacgtgcccaccagcctgcacttccagagcatgctgaagagccagtggcagaacaagcccttcgacaagatcaagccccccaagaagctgagcctgaagcacagagcccccatgcccggcagcctgcccgacagcgccagaaaggacagacacaagctggtgagcagcttcctgaccaccgccaagctgagccaccaccagaccagacccgacagaacccacagacagcacctggacgacgtgggcgccgtgcccatggtggagagagtgaccgcccccaaggccgagagactgctgaacccccccccccccgtgcacgaccccaaccacagcaagatgagactgagagaccacagcagcgagagaagcgaggtgctgaagcaccacaccgacatgagcagcagcagctacctggccgccacccaccaccccccccacagccccctggtgagacagctgagcaccagcagcgacagccccgcccccgccagcagcagcagccaggtgaccgccagcaccagccagcagcccgtgagaagaagaagaggcgagagcagcttcgacatcaacaacatcgtgatccccatgagcgtggccgccaccaccagagtggagaagctgcagtacaaggagatcctgacccccagctggagagaggtggacctgcagagcctgaagggcagccccgacgaggagaacgaggagatcgaggacctgagcgacgccgccttcgccgccctgcacgccaagtgcgaggagatggagagagccagatggctgtggaccaccagcgtgcccccccagagaagaggcagcagaagctacagaagcagcgacggcagaaccaccccccagctgggcagcgccaaccccagcaccccccagcccgccagccccgacgtgagcagcagccacagcctgagcgagtacagccacggccagagccccagaagccccatcagccccgagctgcacagcgcccccctgacccccgtggccagagacacccccagacacctggccagcgaggacaccagatgcagcacccccgagctgggcctggacgagcagagcgtgcagccctgggagagaagaaccttccccctggcccacagcccccaggccgagtgcgaggaccagctggacgcccaggagagagccgccagatgcaccagaagaaccagcggcagcaagaccggcagagagaccgaggccgcccccaccagcccccccatcgtgcccctgaagagcagacacctggtggccgccgccaccgcccagagacccacccacagatag

SEQ ID NO: 85993 - DNA, 1200 bp, Artificial Sequence
  Description of Artificial Sequence: Synthetic coding sequence
atgccccccgagatccactacgaggcccccctgctggagagactgagccagctggacagctgcgtgcaccccgtgctggccttccccgacgacgtgcccaccagcctgcacttccagagcatgctgaagagccagtggcagaacaagcccttcgacaagatcaagccccccaagaagctgagcctgaagcacagagcccccatgcccggcagcctgcccgacagcgccagaaaggacagacacaagctggtgagcagcttcctgaccaccgccatgctgaagcaccacaccgacatgagcagcagcagctacctggccgccacccaccaccccccccacagccccctggtgagacagctgagcaccagcagcgacagccccgcccccgccagcagcagcagccaggtgaccgccagcaccagccagcagcccgtgagaagaagaagaggcgagagcagcttcgacatcaacaacatcgtgatccccatgagcgtggccgccaccaccagagtggagaagctgcagtacaaggagatcctgacccccagctggagagaggtggacctgcagagcctgaagggcagccccgacgaggagaacgaggagatcgaggacctgagcgacgccgccttcgccgccctgcacgccaagtgcgaggagatggagagagccagatggctgtggaccaccagcgtgcccccccagagaagaggcagcagaagctacagaagcagcgacggcagaaccaccccccagctgggcagcgccaaccccagcaccccccagcccgccagccccgacgtgagcagcagccacagcctgagcgagtacagccacggccagagccccagaagccccatcagccccgagctgcacagcgcccccctgacccccgtggccagagacacccccagacacctggccagcgaggacaccagatgcagcacccccgagctgggcctggacgagcagagcgtgcagccctgggagagaagaaccttccccctggcccacagcccccaggccgagtgcgaggaccagctggacgcccaggagagagccgccagatgcaccagaagaaccagcggcagcaagaccggcagagagaccgaggccgcccccaccagcccccccatcgtgcccctgaagagcagacacctggtggccgccgccaccgcccagagacccacccacagatag

SEQ ID NO: 85994 - DNA, 3318 bp, Artificial Sequence; identical to SEQ ID NO: 85992
  Description of Artificial Sequence: Synthetic coding sequence

SEQ ID NO: 85995 - DNA, 3318 bp, Artificial Sequence; identical to SEQ ID NO: 85992
  Description of Artificial Sequence: Synthetic coding sequence

SEQ ID NO: 85996 - DNA, 3318 bp, Artificial Sequence; identical to SEQ ID NO: 85992
  Description of Artificial Sequence: Synthetic coding sequence

SEQ ID NO: 85997 - DNA, 936 bp, Artificial Sequence
  Description of Artificial Sequence: Synthetic coding sequence
atgagcctgctgatgatcagcgagaacgtgaagctggccagagagtacgccctgctgggcaactacgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcccgccagcgagggcgaggtgtggagcatgcccgtgcccgtggagagaagacccagccccggccccagaaagagacagagcagccagtacagcgaccccaagagccacggcaacagacccagcaccaccgtgagagtgcacagaagcagcgcccagaacgtgcacaacgacagaggcaaggccgtgagatgcagagagaagaaggagcagaacaagggcagagaggagaagggcgtgctgatggtgggcccccccggcaccggcaagaccctgctggccaaggccgtggccaccgagtgcaagaccaccttcttcaacgtgagcagcagcaccctgaccagcaagtacagaggcgagagcgagaagctggtgagactgctgttcgagatggccagattctacagccccgccaccatcttcatcgacgagatcgacagcatctgcagcagaagaggcaccagcgaggagcacgaggccagcagaagagtgaaggccgagctgctggtgcagatggacggcgtgggcggcaccagcgagaacgacgaccccagcaagatggtgatggtgctggccgccaccaacttcccctgggacatcgacgaggccctgagaagaagactggagaagagaatctacatccccctgcccagcggcatgagaccctag

SEQ ID NO: 85998 - DNA, 1476 bp, Artificial Sequence
  Description of Artificial Sequence: Synthetic coding sequence
atgagcctgctgatgatcagcgagaacgtgaagctggccagagagtacgccctgctgggcaactacgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcccgccagcgagggcgaggtgtggagcatgcccgtgcccgtggagagaagacccagccccggccccagaaagagacagagcagccagtacagcgaccccaagagccacggcaacagacccagcaccaccgtgagagtgcacagaagcagcgcccagaacgtgcacaacgacagaggcaaggccgtgagatgcagagagaagaaggagcagaacaagggcagagaggagaagaacaagagccccgccgccgtgaccgagcccgagaccaacaagttcgacagcaccggctacgacaaggacctggtggaggccctggagagagacatcatcagccagaaccccaacgtgagatgggacgacatcgccgacctggtggaggccaagaagctgctgaaggaggccgtggtgctgcccatgtggatgcccgagttcttcaagggcatcagaagaccctggaagggcgtgctgatggtgggcccccccggcaccggcaagaccctgctggccaaggccgtggccaccgagtgcaagaccaccttcttcaacgtgagcagcagcaccctgaccagcaagtacagaggcgagagcgagaagctggtgagactgctgttcgagatggccagattctacagccccgccaccatcttcatcgacgagatcgacagcatctgcagcagaagaggcaccagcgaggagcacgaggccagcagaagagtgaaggccgagctgctggtgcagatggacggcgtgggcggcaccagcgagaacgacgaccccagcaagatggtgatggtgctggccgccaccaacttcccctgggacatcgacgaggccctgagaagaagactggagaagagaatctacatccccctgcccagcgccaagggcagagaggagctgctgagaatcagcctgagagagctggagctggccgacgacgtggacctggccagcatcgccgagaacatggagggctacagcggcgccgacatcaccaacgtgtgcagagacgccagcctgatggccatgagaagaagaatcgagggcctgacccccgaggagatcagaaacctgagcaaggaggagatgcacatgcccaccaccatggaggacttcgagatggccctgaagaaggtgagcaagagcgtgagcgccgccgacatcgagagatacgagaagtggatcttcgagttcggcagctgctag

SEQ ID NO: 85999 - DNA, 1476 bp, Artificial Sequence; identical to SEQ ID NO: 85998
  Description of Artificial Sequence: Synthetic coding sequence

SEQ ID NO: 86000 - DNA, 636 bp, Artificial Sequence
  Description of Artificial Sequence: Synthetic coding sequence
atgagcctgctgatgatcagcgagaacgtgaagctggccagagagtacgccctgctgggcaactacgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcccgccagcgagggcgaggtgtggagcatgcccgtgcccgtggagagaagacccagccccggccccagaaagagacagagcagccagtacagcgaccccaagagccacggcaacagacccagcaccaccgtgagagtgcacagaagcagcgcccagaacgtgcacaacgacagaggcaaggccgtgagatgcagagagaagaaggagcagaacaagggcagagaggagaagaacaagagccccgccgccgtgaccgagcccgagaccaacaagttcgacagcaccggctacgacaaggacctggtggaggccctggagagagacatcatcagccagaaccccaacgtgagatgggacgacatctag

SEQ ID NO: 86001 - DNA, 843 bp, Artificial Sequence
  Description of Artificial Sequence: Synthetic coding sequence
atgagcctgctgatgatcagcgagaacgtgaagctggccagagagtacgccctgctgggcaactacgacagcgccatggtgtactaccagggcgtgctggaccagatgaacaagtacctgtacagcgtgaaggacacctacctgcagcagaagtggcagcaggtgtggcaggagatcaacgtggaggccaagcacgtgaaggacatcatgaagaccctggagagcttcaagctggacagcacccccctgaaggccgcccagcacgacctgcccgccagcgagggcgaggtgtggagcatgcccgtgcccgtggagagaagacccagccccggccccagaaagagacagagcagccagtacagcgaccccaagagccacggcaacagacccagcaccaccgtgagagtgcacagaagcagcgcccagaacgtgcacaacgacagaggcaaggccgtgagatgcagagagaagaaggagcagaacaagggcagagaggagaagaacaagagccccgccgccgtgaccgagcccgagaccaacaagttcgacagcaccggctacgacaaggacctggtggaggccctggagagagacatcatcagccagaaccccaacgtgagatgggacgacatcgccgacctggtggaggccaagaagctgctgaaggaggccgtggtgctgcccatgtggatgcccgagttcttcaagggcatcagaagaccctggaagggcgtgctgatggtgggcccccccggcaccggcaagaccctgctggccaaggccgtggccaccgagtgcaagaccaccttcttcaacgtgagcagcagcaccctgaccagctag

SEQ ID NO: 86002 - DNA, 429 bp, Artificial Sequence
  Description of Artificial Sequence: Synthetic coding sequence
atgaactgcagcgagagccagagactgagaaccctgctgagcagactgctgctggagctgcaccacagaggcaacgccagcggcctgggcgccggccccagacccagcatgggcatgggcgtggtgcccgaccccttcgtgggcagagaggtgaccagcgccaagggcgacgacgcctacctgtacatcctgctgatcatgatcttctacgcctgcctggccggcggcctgatcctggcctacaccagaagcagaaagctggtggaggccaaggacgagcccagccaggcctgcgccgagcacgagtgggcccccggcggcgccctgaccgccgacgccgaggccgccgccggcagccaggccgagggcagaagacagctggccagcgagggcctgcccgccctggcccagggcgccgagagagtgtag

SEQ ID NO: 86003 - DNA, 1509 bp, Artificial Sequence
  Description of Artificial Sequence: Synthetic coding sequence
atgttcggcaccctgctgctgtactgcttcttcctggccaccgtgcccgccctggccgagaccggcggcgagagacagctgagccccgagaagagcgagatctggggccccggcctgaaggccgacgtggtgctgcccgccagatacttctacatccaggccgtggacaccagcggcaacaagttcaccagcagccccggcgagaaggtgttccaggtgaaggtgagcgcccccgaggagcagttcaccagagtgggcgtgcaggtgctggacagaaaggacggcagcttcatcgtgagatacagaatgtacgccagctacaagaacctgaaggtggagatcaagttccagggccagcacgtggccaagagcccctacatcctgaagggccccgtgtaccacgagaactgcgactgccccctgcaggacagcgccgcctggctgagagagatgaactgccccgagaccatcgcccagatccagagagacctggcccacttccccgccgtggaccccgagaagatcgccgtggagatccccaagagattcggccagagacagagcctgtgccactacaccctgaaggacaacaaggtgtacatcaagacccacggcgagcacgtgggcttcagaatcttcatggacgccatcctgctgagcctgaccagaaaggtgaagatgcccgacgtggagctgttcgtgaacctgggcgactggcccctggagaagaagaagagcaacagcaacatccaccccatcttcagctggtgcggcagcaccgacagcaaggacatcgtgatgcccacctacgacctgaccgacagcgtgctggagaccatgggcagagtgagcctggacatgatgagcgtgcaggccaacaccggccccccctgggagagcaagaacagcaccgccgtgtggagaggcagagacagcagaaaggagagactggagctggtgaagctgagcagaaagcaccccgagctgatcgacgccgccttcaccaacttcttcttcttcaagcacgacgagaacctgtacggccccatcgtgaagcacatcagcttcttcgacttcttcaagcacaagtaccagatcaacatcgacggcaccgtggccgcctacagactgccctacctgctggtgggcgacagcgtggtgctgaagcaggacagcatctactacgagcacttctacaacgagctgcagccctggaagcactacatccccgtgaagagcaacctgagcgacctgctggagaagctgaagtgggccaaggaccacgacgaggaggccaagaagatcgccaaggccggccaggagttcgccagaaacaacctgatgggcgacgacatcttctgctactacttcaagctgttccaggagtacgccaacctgcaggtgagcgagccccagatcagagagggcatgaagagagtggagccccagaccgaggacgacctgttcccctgcacctgccacagaaagaagaccaaggacgagctgtag

SEQ ID NO: 86004 - DNA, 1065 bp, Artificial Sequence
  Description of Artificial Sequence: Synthetic coding sequence
atgagcgccggcggcggcagagccttcgcctggcaggtgttcccccccatgcccacctgcagagtgtacggcaccgtggcccaccaggacggccacctgctggtgctgggcggctgcggcagagccggcctgcccctggacaccgccgagaccctggacatggccagccacacctggctggccctggcccccctgcccaccgccagagccggcgccgccgccgtggtgctgggcaagcaggtgctggtggtgggcggcgtggacgaggtgcagagccccgtggccgccgtggaggccttcctgatggacgagggcagatgggagagaagagccaccctgccccaggccgccatgggcgtggccaccgtggagagagacggcatggtgtacgccctgggcggcatgggccccgacaccgccccccaggcccaggtgagagtgtacgagcccagaagagactgctggctgagcctgcccagcatgcccaccccctgctacggcgccagcaccttcctgcacggcaacaagatctacgtgctgggcggcagacagggcaagctgcccgtgaccgccttcgaggccttcgacctggaggccagaacctggaccagacaccccagcctgcccagcagaagagccttcgccggctgcgccatggccgagggcagcgtgttcagcctgggcggcctgcagcagcccggcccccacaacttctacagcagaccccacttcgtgaacaccgtggagatgttcgacctggagcacggcagctggaccaagctgcccagaagcctgagaatgagagacaagagagccgacttcgtggtgggcagcctgggcggccacatcgtggccatcggcggcctgggcaaccagccctgccccctgggcagcgtggagagcttcagcctggccagaagaagatgggaggccctgcccgccatgcccaccgccagatgcagctgcagcagcctgcaggccggccccagactgttcgtgatcggcggcgtggcccagggccccagccaggccgtggaggccctgtgcctgagagacggcgtgtag

SEQ ID NO: 86005 - DNA, 417 bp, Artificial Sequence
  Description of Artificial Sequence: Synthetic coding sequence
atgttcgacctggagcacggcagctggaccaagctgcccagaagcctgagaatgagagacaagagagccgacttcgtggtgggcagcctgggcggccacatcgtggccatcggcggcctgggcaaccagccctgccccctgggcagcgtggagagcttcagcctggccagaagaagatgggaggccctgcccgccatgcccaccgccagatgcagctgcagcagcctgcaggccggccccagactgttcgtgatcggcggcgtggcccagggccccagccaggccgtggaggccctgtgcctgagagacggcgagggcctggtgggcgccgtgcactggagcagcagcctgcccgaggccgccatcagcatggcccccttcgccgccgaggacacccactgcggcagcgtgggctag

SEQ ID NO: 86006 - DNA, 1821 bp, Artificial Sequence
  Description of Artificial Sequence: Synthetic coding sequence
atggacagccagagagagctggccgaggagctgagactgtaccagagcaccctgctgcaggacggcctgaaggacctgctggacgagaagaagttcatcgactgcaccctgaaggccggcgacaagagcctgccctgccacagactgatcctgagcgcctgcagcccctacttcagagagtacttcctgagcgagatcgacgaggccaagaagaaggaggtggtgctggacaacgtggaccccgccatcctggacctgatcatcaagtacctgtacagcgccagcatcgacctgaacgacggcaacgtgcaggacatcttcgccctggccagcagattccagatccccagcgtgttcaccgtgtgcgtgagctacctgcagaagagactggcccccggcaactgcctggccatcctgagactgggcctgctgctggactgccccagactggccatcagcgccagagagttcgtgagcgacagattcgtgcagatctgcaaggaggaggacttcatgcagctgagcccccaggagctgatcagcgtgatcagcaacgacagcctgaacgtggagaaggaggaggccgtgttcgaggccgtgatgaagtgggtgagaaccgacaaggagaacagagtgaagaacctgagcgaggtgttcgactgcatcagattcagactgatgaccgagaagtacttcaaggaccacgtggagaaggacgacatcatcaagagcaaccccgacctgcagaagaagatcaaggtgctgaaggacgccttcgccggcaagctgcccgagcccagcaagaacgccgccaagaccggcgccggcgaggtgaacggcgacgtgggcgacgaggacctgctgcccggctacctgaacgacatccccagacacggcatgttcgtgaaggacctgatcctgctggtgaacgacaccgccgccgtggcctacgaccccaccgagaacgagtgctacctgaccgccctggccgagcagatccccagaaaccacagcagcatcgtgacccagcagaaccagatctacgtggtgggcggcctgtacgtggacgaggagaacaaggaccagcccctgcagagctacttcttccagctggacagcatcgccagcgagtgggtgggcctgccccccctgcccagcgccagatgcctgttcggcctgggcgaggtggacgacaagatctacgtggtggccggcaaggacctgcagaccgaggccagcctggacagcgtgctgtgctacgaccccgtggccgccaagtggaacgaggtgaagaagctgcccatcaaggtgtacggccacaacgtgatcagccacaagggcatgatctactgcctgggcggcaagaccgacgacaagaagtgcaccaacagagtgttcatcttcaaccccaagaagggcgactggaaggacctggcccccatgaagatccccagaagcatgttcggcgtggccgtgcacaagggcaagatcgtgatcgccggcggcgtgaccgaggacggcctgagcgccagcgtggaggccttcgacctgaccaccaacaagtgggacgtgatgaccgagttcccccaggagagaagcagcatcagcctggtgagcctggccggcagcctgtacgccatcggcggcttcgccatgatccagctggagagcaaggagttcgcccccaccgaggtgaacgacatctggaagtacgaggacgacaagaaggagtgggccggcatgctgaaggagatcagatacgccagcggcgccagctgcctggccaccagactgaacctgttcaagctgagcaagctgtag

SEQ ID NO: 86007 - DNA, 1377 bp, Artificial Sequence
  Description of Artificial Sequence: Synthetic coding sequence
atggccagaggcccccagaccctggtgcaggtgtgggtgggcggccagctgttccaggccgacagagccctgctggtggagcactgcggcttcttcagaggcctgttcagaagcggcatgagagagaccagagccgccgaggtgagactgggcgtgctgagcgccggcggcttcagagccaccctgcaggtgctgagaggcgacagacccgccctggccgccgaggacgagctgctgcaggccgtggagtgcgccgccttcctgcaggcccccgccctggccagattcctggagcacaacctgaccagcgacaactgcgccctgctgtgcgacgccgccgccgccttcggcctgagagacgtgttccacagcgccgccctgttcatctgcgacggcgagagagagctggccgccgagctggccctgcccgaggccagagcctacgtggccgccctgagacccagcagctacgccgccgtgagcacccacacccccgcccccggcttcctggaggacgccagcagaaccctgtgctacctggacgaggaggaggacgcctggagaaccctggccgccctgcccctggaggccagcaccctgctggccggcgtggccaccctgggcaacaagctgtacatcgtgggcggcgtgagaggcgccagcaaggaggtggtggagctgggcttctgctacgaccccgacggcggcacctggcacgagttccccagcccccaccagcccagatacgacaccgccctggccggcttcgacggcagactgtacgccatcggcggcgagttccagagaacccccatcagcagcgtggagagatacgaccccgccgccggctgctggagcttcgtggccgacctgccccagcccgccgccggcgtgccctgcgcccaggcctgcggcagactgttcgtgtgcctgtggagacccgccgacaccaccgccgtggtggagtacgccgtgagaaccgacgcctggctgcccgtggccgagctgagaagaccccagagctacggccactgcatggtggcccacagagacagcctgtacgtggtgagaaacggccccagcgacgacttcctgcactgcgccatcgactgcctgaacctggccaccggccagtggaccgccctgcccggccagttcgtgaacagcaagggcgccctgttcaccgccgtggtgagaggcgacaccgtgtacaccgtgaacagaatgttcaccctgctgtacgccatcgagggcggcacctggagactgctgagagagaaggccggcttccccagacccggcagcctgcagaccttcctgctgagactgccccccggcgcccccggccccgtgaccagcaccaccgccgagctgtag

SEQ ID NO: 86008 - DNA, 2247 bp, Artificial Sequence
  Description of Artificial Sequence: Synthetic coding sequence
atgagcggcagcggcagaaaggacttcgacgtgaagcacatcctgagactgagatggaagctgttcagccaccccagccccagcaccggcggccccgccggcggcggctgcctgcagcaggacggcagcggcagcttcgagcactggggccccagccagagcagactgctgaagagccaggagagaagcggcgtgagcaccttctggaagaagcccagcagcagcagcagcagcagcagcagccccagcagcagcagcagcagcttcaaccccctgaacggcaccctgctgcccgtggccaccagactgcagcagggcgcccccggccagggcacccagcagcccgccagaaccctgttctacgtggagagcctggaggaggaggtggtgcccggcatggacttccccggcccccacgagaagggcctggtgctgcaggagctgaaggtggagcccgacaacagcagccaggccaccggcgagggctgcggccacagactgagcagcaccggccacagcatgaccccccagagcgacctggacagcagcagcagcgaggagttctaccaggccgtgcaccacgccgagcagaccttcagaaagatggagagctacctgaagcagcagcagctgtgcgacgtgatcctgatcgtgggcaacagaaagatccccgcccacagactggtgctgagcagcgtgagcgactacttcgccgccatgttcaccagcgacgtgtgcgaggccaagcaggaggagatcaagatggagggcatcgaccccaacgccctgtgggacctggtgcagttcgcctacaccggctgcctggagctgaaggaggacaccatcgagaacctgctggccgccgcctgcctgctgcagctgccccaggtggtggaggtgtgctgccacttcctgatgaagctgctgcaccccagcaactgcctgggcatcagagccttcgccgacgcccagggctgcatcgagctgatgaaggtggcccacagctacaccatggagaacatcatggaggtgatcagaaaccaggagttcctgctgctgcccgccgaggagctgcacaagctgctggccagcgacgacgtgaacgtgcccgacgaggagaccatcttccacgccctgatgatgtgggtgaagtacgacatgcagagcagatgcaacgacctgagcatgctgctggccttcatcagactgcccctgctgcccccccagatcctggccgacctggagaaccacgccctgttcaagaacgacctggagtgccagaagctgatcctggaggccatgaagtaccacctgctgcccgagagaagaaccctgatgcagagccccagaaccaagcccagaaagagcaccgtgggcaccctgtacgccgtgggcggcatggacaacaacaagggcgccaccaccatcgagaagtacgacctgagaaccaacctgtggatccaggccggcatgatgaacggcagaagactgcagttcggcgtggccgtgatcgacgacaagctgttcgtgatcggcggcagagacggcctgaagaccctgaacaccgtggagtgctacaaccccaagaccaagacctggaccgtgctgccccccatgagcacccacagacacggcctgggcgtgaccgtgctggagggccccatctacgccgtgggcggccacgacggctggagctacctgaacaccgtggagagatgggacccccagagccagcagtggaccttcgtggccagcatgagcatcgccagaagcaccgtgggcgtggccgccctgaacggcaagctgtacagcgtgggcggcagagacggcagcagctgcctgagcagcatggagtactacgacccccacaccaacaagtggaacatgtgcgcccccatgtgcaagagaagaggcggcgtgggcgtggccacctgcgacggcttcctgtacgccgtgggcggccacgacgcccccgccagcaaccactgcagcagactgctggactacgtggagagatacgaccccaagaccgacacctggaccatggtggcccccctgagcatgcccagagacgccgtgggcgtgtgcctgctgggcgacagactgtacgccgtgggcggctacgacggccagacctacctgaacaccatggagagctacgacccccagaccaacgagtggacccagatggccagcctgaacatcggcagagccggcgcctgcgtggtggtgatcaagcagccctag

SEQ ID NO: 86009 - DNA, 1668 bp, Artificial Sequence
  Description of Artificial Sequence: Synthetic coding sequence
atggacttccccggcccccacgagaagggcctggtgctgcaggagctgaaggtggagcccgacaacagcagccaggccaccggcgagggctgcggccacagactggtgctgagcagcgtgagcgactacttcgccgccatgttcaccagcgacgtgtgcgaggccaagcaggaggagatcaagatggagggcatcgaccccaacgccctgtgggacctggtgcagttcgcctacaccggctgcctggagctgaaggaggacaccatcgagaacctgctggccgccgcctgcctgctgcagctgccccaggtggtggaggtgtgctgccacttcctgatgaagctgctgcaccccagcaactgcctgggcatcagagccttcgccgacgcccagggctgcatcgagctgatgaaggtggcccacagctacaccatggagaacatcatggaggtgatcagaaaccaggagttcctgctgctgcccgccgaggagctgcacaagctgctggccagcgacgacgtgaacgtgcccgacgaggagaccatcttccacgccctgatgatgtgggtgaagtacgacatgcagagcagatgcaacgacctgagcatgctgctggccttcatcagactgcccctgctgcccccccagatcctggccgacctggagaaccacgccctgttcaagaacgacctggagtgccagaagctgatcctggaggccatgaagtaccacctgctgcccgagagaagaaccctgatgcagagccccagaaccaagcccagaaagagcaccgtgggcaccctgtacgccgtgggcggcatggacaacaacaagggcgccaccaccatcgagaagtacgacctgagaaccaacctgtggatccaggccggcatgatgaacggcagaagactgcagttcggcgtggccgtgatcgacgacaagctgttcgtgatcggcggcagagacggcctgaagaccctgaacaccgtggagtgctacaaccccaagaccaagacctggaccgtgctgccccccatgagcacccacagacacggcctgggcgtgaccgtgctggagggccccatctacgccgtgggcggccacgacggctggagctacctgaacaccgtggagagatgggacccccagagccagcagtggaccttcgtggccagcatgagcatcgccagaagcaccgtgggcgtggccgccctgaacggcaagctgtacagcgtgggcggcagagacggcagcagctgcctgagcagcatggagtactacgacccccacaccaacaagtggaacatgtgcgcccccatgtgcaagagaagaggcggcgtgggcgtggccacctgcgacggcttcctgtacgccgtgggcggccacgacgcccccgccagcaaccactgcagcagactgctggactacgtggagagatacgaccccaagaccgacacctggaccatggtggcccccctgagcatgcccagagacgccgtgggcgtgtgcctgctgggcgacagactgtacgccgtgggcggctacgacggccagacctacctgaacaccatggagagctacgacccccagaccaacgagtggacccagatggccagcctgaacatcggcagagccggcgcctgcgtggtggtgatcaagcagccctag

SEQ ID NO: 86010 - DNA, 1167 bp, Artificial Sequence
  Description of Artificial Sequence: Synthetic coding sequence
atgagcagaagcggcgacagaaccagcaccttcgaccccagccacagcgacaacctgctgcacggcctgaacctgctgtggagaaagcagctgttctgcgacgtgaccctgaccgcccagggccagcagttccactgccacaaggccgtgctggccagctgcagccagtacttcagaagcctgttcagcagccacccccccctgggcggcggcgtgggcggccaggacggcctgggcgcccccaaggaccagcagcagcccccccagcagcagcccagccagcagcagcagccccccccccaggaggagcccggcacccccagcagcagccccgacgacaagctgctgaccagccccagagccatcaacaacctggtgctgcagggctgcagcagcatcggcctgagactggtgctggagtacctgtacaccgccaacgtgaccctgagcctggacaccgtggaggaggtgctgagcgtgagcaagatcctgcacatcccccaggtgaccaagctgtgcgtgcagttcctgaacgaccagatcagcgtgcagaactacaagcaggtgtgcaagatcgccgccctgcacggcctggaggagaccaagaagctggccaacaagtacctggtggaggacgtgctgctgctgaacttcgaggagatgagagccctgctggacagcctgcccccccccgtggagagcgagctggccctgttccagatgagcgtgctgtggctggagcacgacagagagaccagaatgcagtacgcccccgacctgatgaagagactgagattcgccctgatccccgcccccgagctggtggagagagtgcagagcgtggacttcatgagaaccgaccccgtgtgccagaagctgctgctggacgccatgaactaccacctgatgcccttcagacagcactgcagacagagcctggccagcagaatcagaagcaacaagaagatgctgctgctggtgggcggcctgccccccggccccgacagactgcccagcaacctggtgcagtactacgacgacgagaagaagacctggaagatcctgaccatcaccggcccccaccccatcagcggcaagcaggagagcgccagcagccccgagttcagaagaagaaagaccagagagttcagcaacaacaccatgtag

SEQ ID NO: 86011 - DNA, 1887 bp, Artificial Sequence
  Description of Artificial Sequence: Synthetic coding sequence
atgagcagaagcggcgacagaaccagcaccttcgaccccagccacagcgacaacctgctgcacggcctgaacctgctgtggagaaagcagctgttctgcgacgtgaccctgaccgcccagggccagcagttccactgccacaaggccgtgctggccagctgcagccagtacttcagaagcctgttcagcagccacccccccctgggcggcggcgtgggcggccaggacggcctgggcgcccccaaggaccagcagcagcccccccagcagcagcccagccagcagcagcagccccccccccaggaggagcccggcacccccagcagcagccccgacgacaagctgctgaccagccccagagccatcaacaacctggtgctgcagggctgcagcagcatcggcctgagactggtgctggagtacctgtacaccgccaacgtgaccctgagcctggacaccgtggaggaggtgctgagcgtgagcaagatcctgcacatcccccaggtgaccaagctgtgcgtgcagttcctgaacgaccagatcagcgtgcagaactacaagcaggtgtgcaagatcgccgccctgcacggcctggaggagaccaagaagctggccaacaagtacctggtggaggacgtgctgctgctgaacttcgaggagatgagagccctgctggacagcctgcccccccccgtggagagcgagctggccctgttccagatgagcgtgctgtggctggagcacgacagagagaccagaatgcagtacgcccccgacctgatgaagagactgagattcgccctgatccccgcccccgagctggtggagagagtgcagagcgtggacttcatgagaaccgaccccgtgtgccagaagctgctgctggacgccatgaactaccacctgatgcccttcagacagcactgcagacagagcctggccagcagaatcagaagcaacaagaagatgctgctgctggtgggcggcctgccccccggccccgacagactgcccagcaacctggtgcagtactacgacgacgagaagaagacctggaagatcctgaccatcatgccctacaacagcgcccaccactgcgtggtggaggtggagaacttcctgttcgtgctgggcggcgaggaccagtggaaccccaacggcaagcacagcaccaacttcgtgagcagatacgaccccagattcaacagctggatccagctgccccccatgcaggagagaagagccagcttctacgcctgcagactggacaagcacctgtacgtgatcggcggcagaaacgagaccggctacctgagcagcgtggagtgctacaacctggagaccaacgagtggagatacgtgagcagcctgccccagcccctggccgcccacgccggcgccgtgcacaacggcaagatctacatcagcggcggcgtgcacaacggcgagtacgtgccctggctgtactgctacgaccccgtgatggacgtgtgggccagaaagcaggacatgaacaccaagagagccatccacaccctggccgtgatgaacgacagactgtacgccatcggcggcaaccacctgaagggcttcagccacctggacgtgatgctggtggagtgctacgaccccaagggcgaccagtggaacatcctgcagacccccatcctggagggcagaagcggccccggctgcgccgtgctggacgacagcatctacctggtgggcggctacagctggagcatgggcgcctacaagagcagcaccatctgctactgccccgagaagggcacctggaccgagctggagggcgacgtggccgagcccctggccggccccgcctgcgtgaccgtgatcctgcccagctgcgtgccctacaacaagtag

SEQ ID NO: 86012 - DNA, 1794 bp, Artificial Sequence
  Description of Artificial Sequence: Synthetic coding sequence
atggtgtggctggaggccagaccccagatcctgttcgtgtgcaccaagcagggccaccagaagcccctggacagcaaggacgacaacaccgagaagcactgccccgtgaccgtgaacccctggcacatgaagaaggccttcaaggtgatgaacgagctgagaagccagaacctgctgtgcgacgtgaccatcgtggccgaggacatggagatcagcgcccacagagtggtgctggccgcctgcagcccctacttccacgccatgttcaccggcgagatgagcgagagcagagccaagagagtgagaatcaaggaggtggacggctggaccctgagaatgctgatcgactacgtgtacaccgccgagatccaggtgaccgaggagaacgtgcaggtgctgctgcccgccgccggcctgctgcagctgcaggacgtgaagaagacctgctgcgagttcctggagagccagctgcaccccgtgaactgcctgggcatcagagccttcgccgacatgcacgcctgcaccgacctgctgaacaaggccaacacctacgccgagcagcacttcgccgacgtggtgctgagcgaggagttcctgaacctgggcatcgagcaggtgtgcagcctgatcagcagcgacaagctgaccatcagcagcgaggagaaggtgttcgaggccgtgatcgcctgggtgaaccacgacaaggacgtgagacaggagttcatggccagactgatggagcacgtgagactgcccctgctgcccagagagtacctggtgcagagagtggaggaggaggccctggtgaagaacagcagcgcctgcaaggactacctgatcgaggccatgaagtaccacctgctgcccaccgagcagagaatcctgatgaagagcgtgagaaccagactgagaacccccatgaacctgcccaagctgatggtggtggtgggcggccaggcccccaaggccatcagaagcgtggagtgctacgacttcaaggaggagagatggcaccaggtggccgagctgcccagcagaagatgcagagccggcatggtgtacatggccggcctggtgttcgccgtgggcggcttcaacggcagcctgagagtgagaaccgtggacagctacgaccccgtgaaggaccagtggaccagcgtggccaacatgagagacagaagaagcaccctgggcgccgccgtgctgaacggcctgctgtacgccgtgggcggcttcgacggcagcaccggcctgagcagcgtggaggcctacaacatcaagagcaacgagtggttccacgtggcccccatgaacaccagaagaagcagcgtgggcgtgggcgtggtgggcggcctgctgtacgccgtgggcggctacgacggcgccagcagacagtgcctgagcaccgtggagtgctacaacgccaccaccaacgagtggacctacatcgccgagatgagcaccagaagaagcggcgccggcgtgggcgtgctgaacaacctgctgtacgccgtgggcggccacgacggccccctggtgagaaagagcgtggaggtgtacgaccccaccaccaacgcctggagacaggtggccgacatgaacatgtgcagaagaaacgccggcgtgtgcgccgtgaacggcctgctgtacgtggtgggcggcgacgacggcagctgcaacctggccagcgtggagtactacaaccccaccaccgacaagtggaccgtggtgagcagctgcatgagcaccggcagaagctacgccggcgtgaccgtgatcgacaagcccctgtag

SEQ ID NO: 86013 - DNA, 2640 bp, Artificial Sequence
  Description of Artificial Sequence: Synthetic coding sequence
atgagactgcacctgctgctgctgctggccctgtgcggcgccggcaccaccgccgccgagctgagctacagcctgagaggcaactggagcatctgcaacggcaacggcagcctggagctgcccggcgccgtgcccggctgcgtgcacagcgccctgttccagcagggcctgatccaggacagctactacagattcaacgacctgaactacagatgggtgagcctggacaactggacctacagcaaggagttcaagatccccttcgagatcagcaagtggcagaaggtgaacctgatcctggagggcgtggacaccgtgagcaagatcctgttcaacgaggtgaccatcggcgagaccgacaacatgttcaacagatacagcttcgacatcaccaacgtggtgagagacgtgaacagcatcgagctgagattccagagcgccgtgctgtacgccgcccagcagagcaaggcccacaccagataccaggtgccccccgactgcccccccctggtgcagaagggcgagtgccacgtgaacttcgtgagaaaggagcagtgcagcttcagctgggactggggccccagcttccccacccagggcatctggaaggacgtgagaatcgaggcctacaacatctgccacctgaactacttcaccttcagccccatctacgacaagagcgcccaggagtggaacctggagatcgagagcaccttcgacgtggtgagcagcaagcccgtgggcggccaggtgatcgtggccatccccaagctgcagacccagcagacctacagcatcgagctgcagcccggcaagagaatcgtggagctgttcgtgaacatcagcaagaacatcaccgtggagacctggtggccccacggccacggcaaccagaccggctacaacatgaccgtgctgttcgagctggacggcggcctgaacatcgagaagagcgccaaggtgtacttcagaaccgtggagctgatcgaggagcccatcaagggcagccccggcctgagcttctacttcaagatcaacggcttccccatcttcctgaagggcagcaactggatccccgccgacagcttccaggacagagtgaccagcgagctgctgagactgctgctgcagagcgtggtggacgccaacatgaacaccctgagagtgtggggcggcggcatctacgagcaggacgagttctacgagctgtgcgacgagctgggcatcatggtgtggcaggacttcatgttcgcctgcgccctgtaccccaccgaccagggcttcctggacagcgtgaccgccgaggtggcctaccagatcaagagactgaagagccaccccagcatcatcatctggagcggcaacaacgagaacgaggaggccctgatgatgaactggtaccacatcagcttcaccgacagacccatctacatcaaggactacgtgaccctgtacgtgaagaacatcagagagctggtgctggccggcgacaagagcagacccttcatcaccagcagccccaccaacggcgccgagaccgtggccgaggcctgggtgagccagaaccccaacagcaactacttcggcgacgtgcacttctacgactacatcagcgactgctggaactggaaggtgttccccaaggccagattcgccagcgagtacggctaccagagctggcccagcttcagcaccctggagaaggtgagcagcaccgaggactggagcttcaacagcaagttcagcctgcacagacagcaccacgagggcggcaacaagcagatgctgtaccaggccggcctgcacttcaagctgccccagagcaccgaccccctgagaaccttcaaggacaccatctacctgacccaggtgatgcaggcccagtgcgtgaagaccgagaccgagttctacagaagaagcagaagcgagatcgtggaccagcagggccacaccatgggcgccctgtactggcagctgaacgacatctggcaggcccccagctgggccagcctggagtacggcggcaagtggaagatgctgcactacttcgcccagaacttcttcgcccccctgctgcccgtgggcttcgagaacgagaacaccttctacatctacggcgtgagcgacctgcacagcgactacagcatgaccctgagcgtgagagtgcacacctggagcagcctggagcccgtgtgcagcagagtgaccgagagattcgtgatgaagggcggcgaggccgtgtgcctgtacgaggagcccgtgagcgagctgctgagaagatgcggcaactgcaccagagagagctgcgtggtgagcttctacctgagcgccgaccacgagctgctgagccccaccaactaccacttcctgagcagccccaaggaggccgtgggcctgtgcaaggcccagatcaccgccatcatcagccagcagggcgacatcttcgtgttcgacctggagaccagcgccgtggcccccttcgtgtggctggacgtgggcagcatccccggcagattcagcgacaacggcttcctgatgaccgagaagaccagaaccatcctgttctacccctgggagcccaccagcaagaacgagctggagcagagcttccacgtgaccagcctgaccgacatctactag

SEQ ID NO: 86014 - DNA, 1518 bp, Artificial Sequence
  Description of Artificial Sequence: Synthetic coding sequence
atgagcgagagcagagccaagagagtgagaatcaaggaggtggacggctggaccctgagaatgctgatcgactacgtgtacaccgccgagatccaggtgaccgaggagaacgtgcaggtgctgctgcccgccgccggcctgctgcagctgcaggacgtgaagaagacctgctgcgagttcctggagagccagctgcaccccgtgaactgcctgggcatcagagccttcgccgacatgcacgcctgcaccgacctgctgaacaaggccaacacctacgccgagcagcacttcgccgacgtggtgctgagcgaggagttcctgaacctgggcatcgagcaggtgtgcagcctgatcagcagcgacaagctgaccatcagcagcgaggagaaggtgttcgaggccgtgatcgcctgggtgaaccacgacaaggacgtgagacaggagttcatggccagactgatggagcacgtgagactgcccctgctgcccagagagtacctggtgcagagagtggaggaggaggccctggtgaagaacagcagcgcctgcaaggactacctgatcgaggccatgaagtaccacctgctgcccaccgagcagagaatcctgatgaagagcgtgagaaccagactgagaacccccatgaacctgcccaagctgatggtggtggtgggcggccaggcccccaaggccatcagaagcgtggagtgctacgacttcaaggaggagagatggcaccaggtggccgagctgcccagcagaagatgcagagccggcatggtgtacatggccggcctggtgttcgccgtgggcggcttcaacggcagcctgagagtgagaaccgtggacagctacgaccccgtgaaggaccagtggaccagcgtggccaacatgagagacagaagaagcaccctgggcgccgccgtgctgaacggcctgctgtacgccgtgggcggcttcgacggcagcaccggcctgagcagcgtggaggcctacaacatcaagagcaacgagtggttccacgtggcccccatgaacaccagaagaagcagcgtgggcgtgggcgtggtgggcggcctgctgtacgccgtgggcggctacgacggcgccagcagacagtgcctgagcaccgtggagtgctacaacgccaccaccaacgagtggacctacatcgccgagatgagcaccagaagaagcggcgccggcgtgggcgtgctgaacaacctgctgtacgccgtgggcggccacgacggccccctggtgagaaagagcgtggaggtgtacgaccccaccaccaacgcctggagacaggtggccgacatgaacatgtgcagaagaaacgccggcgtgtgcgccgtgaacggcctgctgtacgtggtgggcggcgacgacggcagctgcaacctggccagcgtggagtactacaaccccaccaccgacaagtggaccgtggtgagcagctgcatgagcaccggcagaagctacgccggcgtgaccgtgatcgacaagcccctgtag

SEQ ID NO: 86015 - DNA, 1764 bp, Artificial Sequence
  Description of Artificial Sequence: Synthetic coding sequence
atggagggcgagagcgtgaagctgagcagccagaccctgatccaggccggcgacgacgagaagaaccagagaaccatcaccgtgaaccccgcccacatgggcaaggccttcaaggtgatgaacgagctgagaagcaagcagctgctgtgcgacgtgatgatcgtggccgaggacgtggagatcgaggcccacagagtggtgctggccgcctgcagcccctacttctgcgccatgttcaccggcgacatgagcgagagcaaggccaagaagatcgagatcaaggacgtggacggccagaccctgagcaagctgatcgactacatctacaccgccgagatcgaggtgaccgaggagaacgtgcaggtgctgctgcccgccgccagcctgctgcagctgatggacgtgagacagaactgctgcgacttcctgcagagccagctgcaccccaccaactgcctgggcatcagagccttcgccgacgtgcacacctgcaccgacctgctgcagcaggccaacgcctacgccgagcagcacttccccgaggtgatgctgggcgaggagttcctgagcctgagcctggaccaggtgtgcagcctgatcagcagcgacaagctgaccgtgagcagcgaggagaaggtgttcgaggccgtgatcagctggatcaactacgagaaggagaccagactggagcacatggccaagctgatggagcacgtgagactgcccctgctgcccagagactacctggtgcagaccgtggaggaggaggccctgatcaagaacaacaacacctgcaaggacttcctgatcgaggccatgaagtaccacctgctgcccctggaccagagactgctgatcaagaaccccagaaccaagcccagaacccccgtgagcctgcccaaggtgatgatcgtggtgggcggccaggcccccaaggccatcagaagcgtggagtgctacgacttcgaggaggacagatgggaccagatcgccgagctgcccagcagaagatgcagagccggcgtggtgttcatggccggccacgtgtacgccgtgggcggcttcaacggcagcctgagagtgagaaccgtggacgtgtacgacggcgtgaaggaccagtggaccagcatcgccagcatgcaggagagaagaagcaccctgggcgccgccgtgctgaacgacctgctgtacgccgtgggcggcttcgacggcagcaccggcctggccagcgtggaggcctacagctacaagaccaacgagtggttcttcgtggcccccatgaacaccagaagaagcagcgtgggcgtgggcgtggtggagggcaagctgtacgccgtgggcggctacgacggcgccagcagacagtgcctgagcaccgtggagcagtacaaccccgccaccaacgagtggatctacgtggccgacatgagcaccagaagaagcggcgccggcgtgggcgtgctgagcggccagctgtacgccaccggcggccacgacggccccctggtgagaaagagcgtggaggtgtacgaccccggcaccaacacctggaagcaggtggccgacatgaacatgtgcagaagaaacgccggcgtgtgcgccgtgaacggcctgctgtacgtggtgggcggcgacgacggcagctgcaacctggccagcgtggagtactacaaccccgtgaccgacaagtggaccctgctgcccaccaacatgagcaccggcagaagctacgccggcgtggccgtgatccacaagagcctgtag

SEQ ID NO: 86016 - DNA, 906 bp, Artificial Sequence
  Description of Artificial Sequence: Synthetic coding sequence
atggagggcgagagcgtgaagctgagcagccagaccctgatccaggccggcgacgacgagaagaaccagagaaccatcaccgtgaaccccgcccacatgggcaaggccttcaaggtgatgaacgagctgagaagcaagcagctgctgtgcgacgtgatgatcgtggccgaggacgtggagatcgaggcccacagagtggtgctggccgcctgcagcccctacttctgcgccatgttcaccggcgacatgagcgagagcaaggccaagaagatcgagatcaaggacgtggacggccagaccctgagcaagctgatcgactacatctacaccgccgagatcgaggtgaccgaggagaacgtgcaggtgctgctgcccgccgccagcctgctgcagctgatggacgtgagacagaactgctgcgacttcctgcagagccagctgcaccccaccaactgcctgggcatcagagccttcgccgacgtgcacacctgcaccgacctgctgcagcaggccaacgcctacgccgagcagcacttccccgaggtgatgctgggcgaggagttcctgagcctgagcctggaccaggtgtgcagcctgatcagcagcgacaagctgaccgtgagcagcgaggagaaggtgttcgaggccgtgatcagctggatcaactacgagaaggagaccagactggagcacatggccaagctgatggagcacgtgagactgcccctgctgcccagagactacctggtgcagaccgtggaggaggaggccctgatcaagaacaacaacacctgcaaggacttcctgatcgaggccatgaagtaccacctgctgcccctggaccagagactgctgatcaagaaccccagaaccaagcccagaacccccgtgagcctgcccaagtag

SEQ ID NO: 86017 - DNA, 1518 bp, Artificial Sequence
  Description of Artificial Sequence: Synthetic coding sequence
atgagcgagagcaaggccaagaagatcgagatcaaggacgtggacggccagaccctgagcaagctgatcgactacatctacaccgccgagatcgaggtgaccgaggagaacgtgcaggtgctgctgcccgccgccagcctgctgcagctgatggacgtgagacagaactgctgcgacttcctgcagagccagctgcaccccaccaactgcctgggcatcagagccttcgccgacgtgcacacctgcaccgacctgctgcagcaggccaacgcctacgccgagcagcacttccccgaggtgatgctgggcgaggagttcctgagcctgagcctggaccaggtgtgcagcctgatcagcagcgacaagctgaccgtgagcagcgaggagaaggtgttcgaggccgtgatcagctggatcaactacgagaaggagaccagactggagcacatggccaagctgatggagcacgtgagactgcccctgctgcccagagactacctggtgcagaccgtggaggaggaggccctgatcaagaacaacaacacctgcaaggacttcctgatcgaggccatgaagtaccacctgctgcccctggaccagagactgctgatcaagaaccccagaaccaagcccagaacccccgtgagcctgcccaaggtgatgatcgtggtgggcggccaggcccccaaggccatcagaagcgtggagtgctacgacttcgaggaggacagatgggaccagatcgccgagctgcccagcagaagatgcagagccggcgtggtgttcatggccggccacgtgtacgccgtgggcggcttcaacggcagcctgagagtgagaaccgtggacgtgtacgacggcgtgaaggaccagtggaccagcatcgccagcatgcaggagagaagaagcaccctgggcgccgccgtgctgaacgacctgctgtacgccgtgggcggcttcgacggcagcaccggcctggccagcgtggaggcctacagctacaagaccaacgagtggttcttcgtggcccccatgaacaccagaagaagcagcgtgggcgtgggcgtggtggagggcaagctgtacgccgtgggcggctacgacggcgccagcagacagtgcctgagcaccgtggagcagtacaaccccgccaccaacgagtggatctacgtggccgacatgagcaccagaagaagcggcgccggcgtgggcgtgctgagcggccagctgtacgccaccggcggccacgacggccccctggtgagaaagagcgtggaggtgtacgaccccggcaccaacacctggaagcaggtggccgacatgaacatgtgcagaagaaacgccggcgtgtgcgccgtgaacggcctgctgtacgtggtgggcggcgacgacggcagctgcaacctggccagcgtggagtactacaaccccgtgaccgacaagtggaccctgctgcccaccaacatgagcaccggcagaagctacgccggcgtggccgtgatccacaagagcctgtag

SEQ ID NO: 86018 - DNA, 603 bp, Artificial Sequence
  Description of Artificial Sequence: Synthetic coding sequence
atgagcagatgctgcagcagacagcccgcctgctgcagcagctggatgttcggcagaaccgccgtgaccagctgcagcctgagctgcatcccccccatcgcctgggccagcgtgcacctgcagatgtacacccccgccctgaccttctgcagcagacccatgcccacccagcacttccccgaggtgatgctgggcgaggagttcctgagcctgagcctggaccaggtgtgcagcctgatcagcagcgacaagctgaccgtgagcagcgaggagaaggtgttcgaggccgtgatcagctggatcaactacgagaaggagaccagactggagcacatggccaagctgatggagcacgtgagactgcccctgctgcccagagactacctggtgcagaccgtggaggaggaggccctgatcaagaacaacaacacctgcaaggacttcctgatcgaggccatgaagtaccacctgctgcccctggaccagagactgctgatcaagaaccccagaaccaagcccagaacccccgtgagcctgcccaagggcctggagtgcctggccgacagctgcaccccccaggtgggcatgatgggcctgtggtag

SEQ ID NO: 86019 - DNA, 1668 bp, Artificial Sequence
  Description of Artificial Sequence: Synthetic coding sequence
atgggcaaggccttcaaggtgatgaacgagctgagaagcaagcagctgctgtgcgacgtgatgatcgtggccgaggacgtggagatcgaggcccacagagtggtgctggccgcctgcagcccctacttctgcgccatgttcaccggcgacatgagcgagagcaaggccaagaagatcgagatcaaggacgtggacggccagaccctgagcaagctgatcgactacatctacaccgccgagatcgaggtgaccgaggagaacgtgcaggtgctgctgcccgccgccagcctgctgcagctgatggacgtgagacagaactgctgcgacttcctgcagagccagctgcaccccaccaactgcctgggcatcagagccttcgccgacgtgcacacctgcaccgacctgctgcagcaggccaacgcctacgccgagcagcacttccccgaggtgatgctgggcgaggagttcctgagcctgagcctggaccaggtgtgcagcctgatcagcagcgacaagctgaccgtgagcagcgaggagaaggtgttcgaggccgtgatcagctggatcaactacgagaaggagaccagactggagcacatggccaagctgatggagcacgtgagactgcccctgctgcccagagactacctggtgcagaccgtggaggaggaggccctgatcaagaacaacaacacctgcaaggacttcctgatcgaggccatgaagtaccacctgctgcccctggaccagagactgctgatcaagaaccccagaaccaagcccagaacccccgtgagcctgcccaaggtgatgatcgtggtgggcggccaggcccccaaggccatcagaagcgtggagtgctacgacttcgaggaggacagatgggaccagatcgccgagctgcccagcagaagatgcagagccggcgtggtgttcatggccggccacgtgtacgccgtgggcggcttcaacggcagcctgagagtgagaaccgtggacgtgtacgacggcgtgaaggaccagtggaccagcatcgccagcatgcaggagagaagaagcaccctgggcgccgccgtgctgaacgacctgctgtacgccgtgggcggcttcgacggcagcaccggcctggccagcgtggaggcctacagctacaagaccaacgagtggttcttcgtggcccccatgaacaccagaagaagcagcgtgggcgtgggcgtggtggagggcaagctgtacgccgtgggcggctacgacggcgccagcagacagtgcctgagcaccgtggagcagtacaaccccgccaccaacgagtggatctacgtggccgacatgagcaccagaagaagcggcgccggcgtgggcgtgctgagcggccagctgtacgccaccggcggccacgacggccccctggtgagaaagagcgtggaggtgtacgaccccggcaccaacacctggaagcaggtggccgacatgaacatgtgcagaagaaacgccggcgtgtgcgccgtgaacggcctgctgtacgtggtgggcggcgacgacggcagctgcaacctggccagcgtggagtactacaaccccgtgaccgacaagtggaccctgctgcccaccaacatgagcaccggcagaagctacgccggcgtggccgtgatccacaagagcctgtag

SEQ ID NO: 86020 - DNA, 1905 bp, Artificial Sequence
  Description of Artificial Sequence: Synthetic coding sequence
atggcccccaagaagaagatcgtgaagaagaacaagggcgacatcaacgagatgaccatcatcgtggaggacagccccctgaacaagctgaacgccctgaacggcctgctggagggcggcaacggcctgagctgcatcagcagcgagctgaccgacgccagctacggccccaacctgctggagggcctgagcaagatgagacaggagaacttcctgtgcgacctggtgatcggcaccaagaccaagagcttcgacgtgcacaagagcgtgatggccagctgcagcgagtacttctacaacatcctgaagaaggaccccagcatccagagagtggacctgaacgacatcagccccctgggcctggccaccgtgatcgcctacgcctacaccggcaagctgaccctgagcctgtacaccatcggcagcatcatcagcgccgccgtgtacctgcagatccacaccctggtgaagatgtgcagcgacttcctgatcagagagatgagcgtggagaactgcatgtacgtggtgaacatcgccgagacctacagcctgaagaacgccaaggccgccgcccagaagttcatcagagacaacttcctggagttcgccgagagcgaccagttcatgaagctgaccttcgagcagatcaacgagctgctgatcgacgacgacctgcagctgcccagcgagatcgtggccttccagatcgccatgaagtggctggagttcgaccagaagagagtgaagtacgccgccgacctgctgagcaacatcagattcggcaccatcagcgcccaggacctggtgaactacgtgcagagcgtgcccagaatgatgcaggacgccgactgccacagactgctggtggacgccatgaactaccacctgctgccctaccaccagaacaccctgcagagcagaagaaccagaatcagaggcggctgcagagtgctggtgaccgtgggcggcagacccggcctgaccgagaagagcctgagcagagacatcctgtacagagaccccgagaacggctggagcaagctgaccgagatgcccgccaagagcttcaaccagtgcgtggccgtgatggacggcttcctgtacgtggccggcggcgaggaccagaacgacgccagaaaccaggccaagcacgccgtgagcaacttctgcagatacgaccccagattcaacacctggatccacctggccagcatgaaccagaagagaacccacttcagcctgagcgtgttcaacggcctggtgtacgccgccggcggcagaaacgccgagggcagcctggccagcctggagtgctacgtgcccagcaccaaccagtggcagcccaagacccccctggaggtggccagatgctgccacgccagcgccgtggccgacggcagagtgctggtgaccggcggctacatcgccaacgcctacagcagaagcgtgtgcgcctacgaccccgccagcgacagctggcaggagctgcccaacctgagcacccccagaggctggcactgcgccgtgaccctgagcgacagagtgtacgtgatgggcggcagccagctgggccccagaggcgagagagtggacgtgctgaccgtggagtgctacagccccgccaccggccagtggagctacgccgcccccctgcaggtgggcgtgagcaccgccggcgtgagcgccctgcacggcagagcctacctggtgggcggctggaacgagggcgagaagaagtacaagaagtgcatccagtgcttcagccccgagctgaacgagtggaccgaggacgacgagctgcccgaggccaccgtgggcgtgagctgctgcaccctgagcatgcccaacaacgtgaccagagagagcagagccagcagcgtgagcagcgtgcccgtgagcatctag

SEQ ID NO: 86021 - DNA, 1905 bp, Artificial Sequence; identical to SEQ ID NO: 86020
  Description of Artificial Sequence: Synthetic coding sequence

SEQ ID NO: 86022 - DNA, 2313 bp, Artificial Sequence
  Description of Artificial Sequence: Synthetic coding sequence
atgaacgtgatctacttccccctgcacatcttcgtggtgtacagcagagcctacaccagcctggtgctggtgggctgcaccaacctgtgcgccgtgctgttcgccagatgcctggacgaccacctggtgagcctgagaatgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagaaccagcaacagcagccagaccctgagcagctgccacaccatggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtgttcagccacaccttcgaggacagcaaggaccacctggtggccatcaagcagaccatctggagacagaacagcctgagcgaggagttcagaagccactag

SEQ ID NO: 86023 - DNA, 2274 bp, Artificial Sequence
  Description of Artificial Sequence: Synthetic coding sequence
atgaacgtgatctacttccccctgcacatcttcgtggtgtacagcagagcctacaccagcctggtgctggtgggctgcaccaacctgtgcgccgtgctgttcgccagatgcctggacgaccacctggtgagcctgagaatgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagaaccagcaacagcagccagaccctgagcagctgccacaccatggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtgtggcacagctgcttcatcatcaccctgaccctgttcctgctgaagcagttcctgtggtag

SEQ ID NO: 86024 - DNA, 2268 bp, Artificial Sequence
  Description of Artificial Sequence: Synthetic coding sequence
atgaacgtgatctacttccccctgcacatcttcgtggtgtacagcagagcctacaccagcctggtgctggtgggctgcaccaacctgtgcgccgtgctgttcgccagatgcctggacgaccacctggtgagcctgagaatgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagaaccagcaacagcagccagaccctgagcagctgccacaccatggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86025 - DNA, 849 bp, Artificial Sequence
  Description of Artificial Sequence: Synthetic coding sequence
tgaagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtgttcagccacaccttcgaggacagcaaggaccacctggtggccatcaagcagaccatctggagacagaacagcctgagcgaggagttcagaagccactag

SEQ ID NO: 86026 - DNA, 2370 bp, Artificial Sequence
  Description of Artificial Sequence: Synthetic coding sequence
atgagactgcccggccagggcctgggcgccagagagggccccagcatccccctgagcagccccgcccccgcccccgccagccccgccccccccgcctggccccccagacccgccgtgacccacggcagactgagaagccccaccagaagagcctacaccagcctggtgctggtgggctgcaccaacctgtgcgccgtgctgttcgccagatgcctggacgaccacctggtgagcctgagaatgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagaaccagcaacagcagccagaccctgagcagctgccacaccatggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86027 - DNA, 1050 bp, Artificial Sequence
  Description of Artificial Sequence: Synthetic coding sequence
aagaagcaccccagcaccgtgatggtgccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86028 - DNA, 2130 bp, Artificial Sequence
  Description of Artificial Sequence: Synthetic coding sequence
atgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagaaccagcaacagcagccagaccctgagcagctgccacaccatggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86029 - DNA, 2085 bp, Artificial Sequence
  Description of Artificial Sequence: Synthetic coding sequence
atgaacgtgatctacttccccctgcacatcttcgtggtgtacagcagagcctacaccagcctggtgctggtgggctgcaccaacctgtgcgccgtgctgttcgccagatgcctggacgaccacctggtgagcctgagaatgagcggcagcagaaaggagttcgacgtgaagcagatcctgaagatcagatggagatggttcggccaccaggccagcagccccaacagcaccgtggacagccagcagggcgagttctggaacagaggccagaccggcgccaacggcggcagaaagttcctggacccctgcagcctgcagctgcccctggccagcatcggctacagaagaagcagccagctggacttccagaacagccccagctggcccatggccagcaccagcgaggtgcccgccttcgagttcaccgccgaggactgcggcggcgcccactggctggacagacccgaggtggacgacggcaccagcgaggaggagaacgagagcgacagcagcagctgcagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86030 - DNA, 1707 bp, Artificial Sequence
  Description of Artificial Sequence: Synthetic coding sequence
atggagccctgcaccagcgacgagttcttccaggccctgaaccacgccgagcagaccttcaagaagatggagaactacctgagacacaagcagctgtgcgacgtgatcctggtggccggcgacagaagaatccccgcccacagactggtgctgagcagcgtgagcgactacttcgccgccatgttcaccaacgacgtgagagaggccagacaggaggagatcaagatggagggcgtggagcccaacagcctgtggagcctgatccagtacgcctacaccggcagactggagctgaaggaggacaacatcgagtgcctgctgagcaccgcctgcctgctgcagctgagccaggtggtggaggcctgctgcaagttcctgatgaagcagctgcaccccagcaactgcctgggcatcagaagcttcgccgacgcccagggctgcaccgacctgcacaaggtggcccacaactacaccatggagcacttcatggaggtgatcagaaaccaggagttcgtgctgctgcccgccagcgagatcgccaagctgctggccagcgacgacatgaacatccccaacgaggagaccatcctgaacgccctgctgacctgggtgagacacgacctggagcagagaagaaaggacctgagcaagctgctggcctacatcagactgcccctgctggccccccagttcctggccgacatggagaacaacgtgctgttcagagacgacatcgagtgccagaagctgatcatggaggccatgaagtaccacctgctgcccgagagaagacccatgctgcagagccccagaaccaagcccagaaagagcaccgtgggcaccctgttcgccgtgggcggcatggacagcaccaagggcgccaccagcatcgagaagtacgacctgagaaccaacatgtggacccccgtggccaacatgaacggcagaagactgcagttcggcgtggccgtgctggacgacaagctgtacgtggtgggcggcagagacggcctgaagaccctgaacaccgtggagtgctacaaccccaagaccaagacctggagcgtgatgccccccatgagcacccacagacacggcctgggcgtggccgtgctggagggccccatgtacgccgtgggcggccacgacggctggagctacctgaacaccgtggagagatgggacccccaggccagacagtggaacttcgtggccaccatgagcacccccagaagcaccgtgggcgtggccgtgctgagcggcaagctgtacgccgtgggcggcagagacggcagcagctgcctgaagagcgtggagtgcttcgacccccacaccaacaagtggaccctgtgcgcccagatgagcaagagaagaggcggcgtgggcgtgaccacctggaacggcctgctgtacgccatcggcggccacgacgcccccgccagcaacctgaccagcagactgagcgactgcgtggagagatacgaccccaagaccgacatgtggaccgccgtggccagcatgagcatcagcagagacgccgtgggcgtgtgcctgctgggcgacaagctgtacgccgtgggcggctacgacggccaggcctacctgaacaccgtggaggcctacgacccccagaccaacgagtggacccaggtggcccccctgtgcctgggcagagccggcgcctgcgtggtgaccgtgaagctgtag

SEQ ID NO: 86031 - DNA, 1866 bp, Artificial Sequence
  Description of Artificial Sequence: Synthetic coding sequence
atgctgatggccggccagagaggcgcctggaccatgggcgacgtggtggagaagagcctggagggccccctggcccccagcaccgacgagcccagccagaagaccggcgacctggtggagatcctgaacggcgagaaggtgaagttcgacgacgccggcctgagcctgatcctgcagaacggcctggagaccctgagaatggagaacgccctgaccgacgtgatcctgtgcgtggacatccaggagttcagctgccacagagtggtgctggccgccgccagcaactacttcagagccatgttctgcaacgacctgaaggagaagtacgagaagagaatcatcatcaagggcgtggacgccgagaccatgcacaccctgctggactacacctacaccagcaaggccctgatcaccaagcagaacgtgcagagagtgctggaggccgccaacctgttccagttcctgagaatggtggacgcctgcgccagcttcctgaccgaggccctgaaccccgagaactgcgtgggcatcctgagactggccgacacccacagcctggacagcctgaagaagcaggtgcagagctacatcatccagaacttcgtgcagatcctgaacagcgaggagttcctggacctgcccgtggacaccctgcaccacatcctgaagagcgacgacctgtacgtgaccgaggaggcccaggtgttcgagaccgtgatgagctgggtgagacacaagcccagcgagagactgtgcctgctgccctacgtgctggagaacgtgagactgcccctgctggacccctggtacttcgtggagaccgtggaggccgaccccctgatcagacagtgccccgaggtgttccccctgctgcaggaggccagaatgtaccacctgagcggcaacgagatcatcagcgagagaaccaagcccagaatgcacgagttccagagcgaggtgttcatgatcatcggcggctgcaccaaggacgagagattcgtggccgaggtgacctgcctggaccccctgagaagaagcagactggaggtggccaagctgcccctgaccgagcacgagctggagagcgagaacaagaagtgggtggagttcgcctgcgtgaccctgaagaacgaggtgtacatcagcggcggcaaggagacccagcacgacgtgtggaagtacaacagcagcatcaacaagtggatccagatcgagtacctgaacatcggcagatggagacacaagatggtggtgctgggcggcaaggtgtacgtgatcggcggcttcgacggcctgcagagaatcaacaacgtggagacctacgaccccttccacaactgctggagcgaggccgcccccctgctggtgcacgtgagcagcttcgccgccaccagccacaagaagaagctgtacgtgatcggcggcggccccaacggcaagctggccaccgacaagacccagtgctacgaccccagcaccaacaagtggagcctgaaggccgccatgcccgtggaggccaagtgcatcaacgccgtgagcttcagagacagaatctacgtggtgggcggcgccatgagagccctgtacgcctacagccccctggaggacagctggtgcctggtgacccagctgagccacgagagagccagctgcggcatcgccccctgcaacaacagactgtacatcaccggcggcagagacgagaagaacgaggtgatcgccaccgtgctgtgctgggaccccgaggcccagaagctgaccgaggagtgcgtgctgcccagaggcgtgagccaccacggcagcgtgaccatcagaaagagctacacccacatcagaagaatcgtgcccggcgccgtgagcgtgtag

SEQ ID NO: 86032 - DNA, 1695 bp, Artificial Sequence
  Description of Artificial Sequence: Synthetic coding sequence
atgctgggcggcaccgactgcagaaccttcctgaccagccacatcaacctgaagaagaccctgtgcgacgtgatcctgatggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcatcagcgtgctggccgagtgcctggactgccccgagctgaaggccaccgccgacgacttcatccaccagcacttcaccgaggtgtacaagaccgacgagttcctgcagctggacgtgaagagagtgacccacctgctgaaccaggacaccctgaccgtgagagccgaggaccaggtgtacgacgccgccgtgagatggctgaagtacgacgagcccaacagacagcccttcatggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86033 - DNA, 1761 bp, Artificial Sequence
  Description of Artificial Sequence: Synthetic coding sequence
atggccgccagcggcgtggagaagagcagcaagaagaagaccgagaagaagctggccgccagagaggaggccaagctgctggccggcttcatgggcgtgatgaacaacatgagaaagcagaagaccctgtgcgacgtgatcctgatggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcatcagcgtgctggccgagtgcctggactgccccgagctgaaggccaccgccgacgacttcatccaccagcacttcaccgaggtgtacaagaccgacgagttcctgcagctggacgtgaagagagtgacccacctgctgaaccaggacaccctgaccgtgagagccgaggaccaggtgtacgacgccgccgtgagatggctgaagtacgacgagcccaacagacagcccttcatggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86034 - DNA, 1617 bp, Artificial Sequence
  Description of Artificial Sequence: Synthetic coding sequence
atggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcatcagcgtgctggccgagtgcctggactgccccgagctgaaggccaccgccgacgacttcatccaccagcacttcaccgaggtgtacaagaccgacgagttcctgcagctggacgtgaagagagtgacccacctgctgaaccaggacaccctgaccgtgagagccgaggaccaggtgtacgacgccgccgtgagatggctgaagtacgacgagcccaacagacagcccttcatggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86035 - DNA, 1161 bp, Artificial Sequence
  Description of Artificial Sequence: Synthetic coding sequence
atggccgccagcggcgtggagaagagcagcaagaagaagaccgagaagaagctggccgccagagaggaggccaagctgctggccggcttcatgggcgtgatgaacaacatgagaaagcagaagaccctgtgcgacgtgatcctgatggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctgctgcactacaagttcttcaagatgaagaacagaaaggacggcagagtgagcgtgagctacgccatcctgatccagggcctgaagatctacgagatctacagcaccaacttccccgagcacttcaccgaggtgtacaagaccgacgagttcctgcagctggacgtgaagagagtgacccacctgctgaaccaggacaccctgaccgtgagagccgaggaccaggtgtacgacgccgccgtgagatggctgaagtacgacgagcccaacagacagcccttcatggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttctgcctgatccccgtgaagttcatgatcctgccccagaagcacggcctgagctgcgtgcagtag

SEQ ID NO: 86036 - DNA, 1284 bp, Artificial Sequence
  Description of Artificial Sequence: Synthetic coding sequence
atggccgccagcggcgtggagaagagcagcaagaagaagaccgagaagaagctggccgccagagaggaggccaagctgctggccggcttcatgggcgtgatgaacaacatgagaaagcagaagaccctgtgcgacgtgatcctgatggtgcaggagagaaagatccccgcccacagagtggtgctggccgccgccagccacttcttcaacctgatgttcaccaccaacatgctggagagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86037 - DNA, 1533 bp, Artificial Sequence
  Description of Artificial Sequence: Synthetic coding sequence
atgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcatcagcgtgctggccgagtgcctggactgccccgagctgaaggccaccgccgacgacttcatccaccagcacttcaccgaggtgtacaagaccgacgagttcctgcagctggacgtgaagagagtgacccacctgctgaaccaggacaccctgaccgtgagagccgaggaccaggtgtacgacgccgccgtgagatggctgaagtacgacgagcccaacagacagcccttcatggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86038 - DNA, 1086 bp, Artificial Sequence
  Description of Artificial Sequence: Synthetic coding sequence
atggtggacatcctggccaaggtgagattccccctgatcagcaagaacttcctgagcaagaccgtgcaggccgagcccctgatccaggacaaccccgagtgcctgaagatggtgatcagcggcatgagataccacctgctgagccccgaggacagagaggagctggtggacggcaccagacccagaagaaagaagcacgactacagaatcgccctgttcggcggcagccagccccagagctgcagatacttcaaccccaaggactacagctggaccgacatcagatgccccttcgagaagagaagagacgccgcctgcgtgttctgggacaacgtggtgtacatcctgggcggcagccagctgttccccatcaagagaatggactgctacaacgtggtgaaggacagctggtacagcaagctgggcccccccacccccagagacagcctggccgcctgcgccgccgagggcaagatctacaccagcggcggcagcgaggtgggcaacagcgccctgtacctgttcgagtgctacgacaccagaaccgagagctggcacaccaagcccagcatgctgacccagagatgcagccacggcatggtggaggccaacggcctgatctacgtgtgcggcggcagcctgggcaacaacgtgagcggcagagtgctgaacagctgcgaggtgtacgaccccgccaccgagacctggaccgagctgtgccccatgatcgaggccagaaagaaccacggcctggtgttcgtgaaggacaagatcttcgccgtgggcggccagaacggcctgggcggcctggacaacgtggagtactacgacatcaagctgaacgagtggaagatggtgagccccatgccctggaagggcgtgaccgtgaagtgcgccgccgtgggcagcatcgtgtacgtgctggccggcttccagggcgtgggcagactgggccacatcctggagtacaacaccgagaccgacaagtgggtggccaacagcaaggtgagagccttccccgtgaccagctgcctgatctgcgtggtggacacctgcggcgccaacgaggagaccctggagacctag

SEQ ID NO: 86039 - DNA, 1695 bp, Artificial Sequence; identical to SEQ ID NO: 86032
  Description of Artificial Sequence: Synthetic coding sequence

SEQ ID NO: 86040 - DNA, 432 bp, Artificial Sequence
  Description of Artificial Sequence: Synthetic coding sequence
atgctgggcggcaccgactgcagaaccttcctgaccagccacatcaacctgaagaagaccctgtgcgacgtgatcctgatggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcaagaagtaccagatccccgtggtgtgcctgttctgcttcatcctgtacttctag

SEQ ID NO: 86041 - DNA, 501 bp, Artificial Sequence
  Description of Artificial Sequence: Synthetic coding sequence
atggccgccagcggcgtggagaagagcagcaagaagaagaccgagaagaagctggccgccagagaggaggccaagctgctggccggcttcatgggcgtgatgaacaacatgagaaagcagaagaccctgtgcgacgtgatcctgatggtgcaggagagaaagatccccgcccacagagtggtgctggccgccgccagccacttcttcaacctgatgttcaccaccaacatgctggagagcaagagcttcgaggtggagctgaaggacgccgagcccgacatcatcgagcagctggtggagttcgcctacaccgccagaatcagcgtgaacagcaacaacgtgcagagcctgctggacgccgccaaccagtaccagatcgagcccgtgaagaagatgtgcgtggacttcctgaaggagcaggtggacgccagcaactgcctgggcgaggccgagaaggtggaccagagcctgcccgagtgcggcatgctgttcaccgtgtag

SEQ ID NO: 86042 - DNA, 1863 bp, Artificial Sequence
  Description of Artificial Sequence: Synthetic coding sequence
atggccagcgacagcatgagcagcaagcaggccagaaaccacatcaccaagggcaagagacagcagcagcaccagcagatcaagaacagaagcagcatcagcgacggcgacggcgaggacagcttcatcttcgaggccaacgaggcctggaaggacttccacggcagcctgctgagattctacgagaacggcgagctgtgcgacgtgaccctgaaggtgggcagcaagctgatcagctgccacaagctggtgctggcctgcgtgatcccctacttcagagccatgttcctgagcgagatggccgaggccaagcagaccctgatcgagatcagagacttcgacggcgacgccatcgaggacctggtgaagttcgtgtacagcagcagactgaccctgaccgtggacaacgtgcagcccctgctgtacgccgcctgcatcctgcaggtggagctggtggccagagcctgctgcgagtacatgaagctgcacttccaccccagcaactgcctggccgtgagagccttcgccgagagccacaacagaatcgacctgatggacatggccgaccagtacgcctgcgaccacttcaccgaggtggtggagtgcgaggacttcgtgagcgtgagcccccagcacctgcacaagctgctgagcagcagcgacctgaacatcgagaacgagaagcaggtgtacaacgccgccatcaagtggctgctggccaacccccagcaccacagcaagtggctggacgagaccctggcccaggtgagactgcccctgctgcccgtggacttcctgatgggcgtggtggccaaggagcagatcgtgaagcagaacctgaagtgcagagacctgctggacgaggccagaaactaccacctgcacctgagcagcagagccgtgcccgacttcgagtacagcatcagaaccacccccagaaagcacaccgccggcgtgctgttctgcgtgggcggcagaggcggcagcggcgaccccttcagaagcatcgagtgctacagcatcaacaagaacagctggttcttcggccccgagatgaacagcagaagaagacacgtgggcgtgatcagcgtggagggcaaggtgtacgccgtgggcggccacgacggcaacgagcacctgggcagcatggagatgttcgaccccctgaccaacaagtggatgatgaaggccagcatgaacaccaagagaagaggcatcgccctggccagcctgggcggccccatctacgccatcggcggcctggacgacaacacctgcttcaacgacgtggagagatacgacatcgagagcgaccagtggagcaccgtggcccccatgaacacccccagaggcggcgtgggcagcgtggccctggtgaaccacgtgtacgccgtgggcggcaacgacggcatggccagcctgagcagcgtggagagatacgacccccacctggacaagtggatcgaggtgaaggagatgggccagagaagagccggcaacggcgtgagcaagctgcacggctgcctgtacgtggtgggcggcttcgacgacaacagccccctgagcagcgtggagagatacgaccccagaagcaacaagtgggactacgtggccgccctgaccacccccagaggcggcgtgggcatcgccaccgtgatgggcaagatcttcgccgtgggcggccacaacggcaacgcctacctgaacaccgtggaggccttcgaccccgtgctgaacagatgggagctggtgggcagcgtgagccactgcagagccggcgccggcgtggccgtgtgcagctgcctgaccagccagatcagagacgtgggccacggcagcaacaacgtggtggactgcatgtag

SEQ ID NO: 86043 - DNA, 1863 bp, Artificial Sequence; identical to SEQ ID NO: 86042
  Description of Artificial Sequence: Synthetic coding sequence

SEQ ID NO: 86044 - DNA, 810 bp, Artificial Sequence
  Description of Artificial Sequence: Synthetic coding sequence
atgaacagcagaagaagacacgtgggcgtgatcagcgtggagggcaaggtgtacgccgtgggcggccacgacggcaacgagcacctgggcagcatggagatgttcgaccccctgaccaacaagtggatgatgaaggccagcatgaacaccaagagaagaggcatcgccctggccagcctgggcggccccatctacgccatcggcggcctggacgacaacacctgcttcaacgacgtggagagatacgacatcgagagcgaccagtggagcaccgtggcccccatgaacacccccagaggcggcgtgggcagcgtggccctggtgaaccacgtgtacgccgtgggcggcaacgacggcatggccagcctgagcagcgtggagagatacgacccccacctggacaagtggatcgaggtgaaggagatgggccagagaagagccggcaacggcgtgagcaagctgcacggctgcctgtacgtggtgggcggcttcgacgacaacagccccctgagcagcgtggagagatacgaccccagaagcaacaagtgggactacgtggccgccctgaccacccccagaggcggcgtgggcatcgccaccgtgatgggcaagatcttcgccgtgggcggccacaacggcaacgcctacctgaacaccgtggaggccttcgaccccgtgctgaacagatgggagctggtgggcagcgtgagccactgcagagccggcgccggcgtggccgtgtgcagctgcctgaccagccagatcagagacgtgggccacggcagcaacaacgtggtggactgcatgtag

SEQ ID NO: 86045 - DNA, 1875 bp, Artificial Sequence
  Description of Artificial Sequence: Synthetic coding sequence
atgcagcccgaccccagacccagcggcgccggcgcctgctgcagattcctgcccctgcagagccagtgccccgagggcgccggcgacgccgtgatgtacgccagcaccgagtgcaaggccgaggtgacccccagccagcacggcaacagaaccttcagctacaccctggaggaccacaccaagcaggccttcggcatcatgaacgagctgagactgagccagcagctgtgcgacgtgaccctgcaggtgaagtaccaggacgcccccgccgcccagttcatggcccacaaggtggtgctggccagcagcagccccgtgttcaaggccatgttcaccaacggcctgagagagcagggcatggaggtggtgagcatcgagggcatccaccccaaggtgatggagagactgatcgagttcgcctacaccgccagcatcagcatgggcgagaagtgcgtgctgcacgtgatgaacggcgccgtgatgtaccagatcgacagcgtggtgagagcctgcagcgacttcctggtgcagcagctggaccccagcaacgccatcggcatcgccaacttcgccgagcagatcggctgcgtggagctgcaccagagagccagagagtacatctacatgcacttcggcgaggtggccaagcaggaggagttcttcaacctgagccactgccagctggtgaccctgatcagcagagacgacctgaacgtgagatgcgagagcgaggtgttccacgcctgcatcaactgggtgaagtacgactgcgagcagagaagattctacgtgcaggccctgctgagagccgtgagatgccacagcctgacccccaacttcctgcagatgcagctgcagaagtgcgagatcctgcagagcgacagcagatgcaaggactacctggtgaagatcttcgaggagctgaccctgcacaagcccacccaggtgatgccctgcagagcccccaaggtgggcagactgatctacaccgccggcggctacttcagacagagcctgagctacctggaggcctacaaccccagcgacggcacctggctgagactggccgacctgcaggtgcccagaagcggcctggccggctgcgtggtgggcggcctgctgtacgccgtgggcggcagaaacaacagccccgacggcaacaccgacagcagcgccctggactgctacaaccccatgaccaaccagtggagcccctgcgcccccatgagcgtgcccagaaacagaatcggcgtgggcgtgatcgacggccacatctacgccgtgggcggcagccacggctgcatccaccacaacagcgtggagagatacgagcccgagagagacgagtggcacctggtggcccccatgctgaccagaagaatcggcgtgggcgtggccgtgctgaacagactgctgtacgccgtgggcggcttcgacggcaccaacagactgaacagcgccgagtgctactaccccgagagaaacgagtggagaatgatcaccgccatgaacaccatcagaagcggcgccggcgtgtgcgtgctgcacaactgcatctacgccgccggcggctacgacggccaggaccagctgaacagcgtggagagatacgacgtggagaccgagacctggaccttcgtggcccccatgaagcacagaagaagcgccctgggcatcaccgtgcaccagggcagaatctacgtgctgggcggctacgacggccacaccttcctggacagcgtggagtgctacgaccccgacaccgacacctggagcgaggtgaccagaatgaccagcggcagaagcggcgtgggcgtggccgtgaccatggagccctgcagaaagcagatcgaccagcagaactgcacctgctag

SEQ ID NO: 86046 - DNA, 1875 bp, Artificial Sequence; identical to SEQ ID NO: 86045
  Description of Artificial Sequence: Synthetic coding sequence

SEQ ID NO: 86047 - DNA, 2199 bp, Artificial Sequence
  Description of Artificial Sequence: Synthetic coding sequence
atggagggcggcgaccagagcgaggaggagcccagagagagaagccaggccggcggcatgggcaccctgtggagccaggagagcacccccgaggagagactgcccgtggagggcagcagaccctgggccgtggccagaagagtgctgaccgccatcctgatcctgggcctgctgctgtgcttcagcgtgctgctgttctacaacttccagaactgcggccccagaccctgcgagaccagcgtgtgcctggacctgagagaccactacctggccagcggcaacaccagcgtggccccctgcaccgacttcttcagcttcgcctgcggcagagccaaggagaccaacaacagcttccaggagctggccaccaagaacaagaacagactgagaagaatcctggaggtgcagaacagctggcaccccggcagcggcgaggagaaggccttccagttctacaacagctgcatggacaccctggccatcgaggccgccggcaccggccccctgagacaggtgatcgaggagctgggcggctggagaatcagcggcaagtggaccagcctgaacttcaacagaaccctgagactgctgatgagccagtacggccacttccccttcttcagagcctacctgggcccccaccccgccagcccccacacccccgtgatccagatcgaccagcccgagttcgacgtgcccctgaagcaggaccaggagcagaagatctacgcccagatcttcagagagtacctgacctacctgaaccagctgggcaccctgctgggcggcgaccccagcaaggtgcaggagcacagcagcctgagcatcagcatcaccagcagactgttccagttcctgagacccctggagcagagaagagcccagggcaagctgttccagatggtgaccatcgaccagctgaaggagatggcccccgccatcgactggctgagctgcctgcaggccaccttcacccccatgagcctgagccccagccagagcctggtggtgcacgacgtggagtacctgaagaacatgagccagctggtggaggagatgctgctgaagcagagagacttcctgcagagccacatgatcctgggcctggtggtgaccctgagccccgccctggacagccagttccaggaggccagaagaaagctgagccagaagctgagagagctgaccgagcagccccccatgcccgccagacccagatggatgaagtgcgtggaggagaccggcaccttcttcgagcccaccctggccgccctgttcgtgagagaggccttcggccccagcaccagaagcgccgccatgaagctgttcaccgccatcagagacgccctgatcaccagactgagaaacctgccctggatgaacgaggagacccagaacatggcccaggacaaggtggcccagctgcaggtggagatgggcgccagcgagtgggccctgaagcccgagctggccagacaggagtacaacgacatccagctgggcagcagcttcctgcagagcgtgctgagctgcgtgagaagcctgagagccagaatcgtgcagagcttcctgcagccccacccccagcacagatggaaggtgagcccctgggacgtgaacgcctactacagcgtgagcgaccacgtggtggtgttccccgccggcctgctgcagccccccttcttccaccccggctaccccagagccgtgaacttcggcgccgccggcagcatcatggcccacgagctgctgcacatcttctaccagctgctgctgcccggcggctgcctggcctgcgacaaccacgccctgcaggaggcccacctgtgcctgaagagacactacgccgccttccccctgcccagcagaaccagcttcaacgacagcctgaccttcctggagaacgccgccgacgtgggcggcctggccatcgccctgcaggcctacagcaagagactgctgagacaccacggcgagaccgtgctgcccagcctggacctgagcccccagcagatcttcttcagaagctacgcccaggtgatgtgcagaaagcccagcccccaggacagccacgacacccacagccccccccacctgagagtgcacggccccctgagcagcacccccgccttcgccagatacttcagatgcgccagaggcgccctgctgaaccccagcagcagatgccagctgtggtag

SEQ ID NO: 86048 - DNA, 1935 bp, Artificial Sequence
  Description of Artificial Sequence: Synthetic coding sequence
atgagcagacagttcagcagcagaagcggctacagaagcggcggcggcttcagcagcggcagcgccggcatcatcaactaccagagaagaaccaccagcagcagcaccagaagaagcggcggcggcggcggcagattcagcagctgcggcggcggcggcggcagcttcggcgccggcggcggcttcggcagcagaagcctggtgaacctgggcggcagcaagagcatcagcatcagcgtggccagaggcggcggcagaggcagcggcttcggcggcggctacggcggcggcggcttcggcggcggcggcttcggcggcggcggcttcggcggcggcggcatcggcggcggcggcttcggcggcttcggcagcggcggcggcggcttcggcggcggcggcttcggcggcggcggctacggcggcggctacggccccgtgtgcccccccggcggcatccaggaggtgaccatcaaccagagcctgctgcagcccctgaacgtggagatcgaccccgagatccagaaggtgaagagcagagagagagagcagatcaagagcctgaacaaccagttcgccagcttcatcgacaaggtgagattcctggagcagcagaaccaggtgctgcagaccaagtgggagctgctgcagcaggtggacaccagcaccagaacccacaacctggagccctacttcgagagcttcatcaacaacctgagaagaagagtggaccagctgaagagcgaccagagcagactggacagcgagctgaagaacatgcaggacatggtggaggactacagaaacaagtacgaggacgagatcaacaagagaaccaacgccgagaacgagttcgtgaccatcaagaaggacgtggacggcgcctacatgaccaaggtggacctgcaggccaagctggacaacctgcagcaggagatcgacttcctgaccgccctgtaccaggccgagctgagccagatgcagacccagatcagcgagaccaacgtgatcctgagcatggacaacaacagaagcctggacctggacagcatcatcgccgaggtgaaggcccagtacgaggacatcgcccagaagagcaaggccgaggccgagagcctgtaccagagcaagtacgaggagctgcagatcaccgccggcagacacggcgacagcgtgagaaacagcaagatcgagatcagcgagctgaacagagtgatccagagactgagaagcgagatcgacaacgtgaagaagcagatcagcaacctgcagcagagcatcagcgacgccgagcagagaggcgagaacgccctgaaggacgccaagaacaagctgaacgacctggaggacgccctgcagcaggccaaggaggacctggccagactgctgagagactaccaggagctgatgaacaccaagctggccctggacctggagatcgccacctacagaaccctgctggagggcgaggagagcagaatgagcggcgagtgcgcccccaacgtgagcgtgagcgtgagcaccagccacaccaccatcagcggcggcggcagcagaggcggcggcggcggcggctacggcagcggcggcagcagctacggcagcggcggcggcagctacggcagcggcggcggcggcggcggcggcagaggcagctacggcagcggcggcagcagctacggcagcggcggcggcagctacggcagcggcggcggcggcggcggccacggcagctacggcagcggcagcagcagcggcggctacagaggcggcagcggcggcggcggcggcggcagcagcggcggcagaggcagcggcggcggcagcagcggcggcagcatcggcggcagaggcagcagcagcggcggcgtgaagagcagcggcggcagcagcagcgtgaagttcgtgagcaccacctacagcggcgtgaccagatag

SEQ ID NO: 86049 - DNA, 1755 bp, Artificial Sequence
  Description of Artificial Sequence: Synthetic coding sequence
atgagcgtgagatacagcagcagcaagcactacagcagcagcagaagcggcggcggcggcggcggcggcggctgcggcggcggcggcggcgtgagcagcctgagaatcagcagcagcaagggcagcctgggcggcggcttcagcagcggcggcttcagcggcggcagcttcagcagaggcagcagcggcggcggctgcttcggcggcagcagcggcggctacggcggcctgggcggcttcggcggcggcagcttcagaggcagctacggcagcagcagcttcggcggcagctacggcggcatcttcggcggcggcagcttcggcggcggcagcttcggcggcggcagcttcggcggcggcggcttcggcggcggcggcttcggcggcggcttcggcggcggcttcggcggcgacggcggcctgctgagcggcaacgagaaggtgaccatgcagaacctgaacgacagactggccagctacctggacaaggtgagagccctggaggagagcaactacgagctggagggcaagatcaaggagtggtacgagaagcacggcaacagccaccagggcgagcccagagactacagcaagtactacaagaccatcgacgacctgaagaaccagatcctgaacctgaccaccgacaacgccaacatcctgctgcagatcgacaacgccagactggccgccgacgacttcagactgaagtacgagaacgaggtggccctgagacagagcgtggaggccgacatcaacggcctgagaagagtgctggacgagctgaccctgaccaaggccgacctggagatgcagatcgagagcctgaccgaggagctggcctacctgaagaagaaccacgaggaggagatgaaggacctgagaaacgtgagcaccggcgacgtgaacgtggagatgaacgccgcccccggcgtggacctgacccagctgctgaacaacatgagaagccagtacgagcagctggccgagcagaacagaaaggacgccgaggcctggttcaacgagaagagcaaggagctgaccaccgagatcgacaacaacatcgagcagatcagcagctacaagagcgagatcaccgagctgagaagaaacgtgcaggccctggagatcgagctgcagagccagctggccctgaagcagagcctggaggccagcctggccgagaccgagggcagatactgcgtgcagctgagccagatccaggcccagatcagcgccctggaggagcagctgcagcagatcagagccgagaccgagtgccagaacaccgagtaccagcagctgctggacatcaagatcagactggagaacgagatccagacctacagaagcctgctggagggcgagggcagcagcggcggcggcggcagaggcggcggcagcttcggcggcggctacggcggcggcagcagcggcggcggcagcagcggcggcggccacggcggcggccacggcggcagcagcggcggcggctacggcggcggcagcagcggcggcggcagcagcggcggcggctacggcggcggcagcagcagcggcggccacggcggcagcagcagcggcggctacggcggcggcagcagcggcggcggcggcggcggctacggcggcggcagcagcggcggcggcagcagcagcggcggcggctacggcggcggcagcagcagcggcggccacaagagcagcagcagcggcagcgtgggcgagagcagcagcaagggccccagatactag

SEQ ID NO: 86050 - DNA, 1485 bp, Artificial Sequence
  Description of Artificial Sequence: Synthetic coding sequence
atggacctgagcaacaacaccatgagcctgagcgtgagaacccccggcctgagcagaagactgagcagccagagcgtgatcggcagacccagaggcatgagcgccagcagcgtgggcagcggctacggcggcagcgccttcggcttcggcgccagctgcggcggcggcttcagcgccgccagcatgttcggcagcagcagcggcttcggcggcggcagcggcagcagcatggccggcggcctgggcgccggctacggcagagccctgggcggcggcagcttcggcggcctgggcatgggcttcggcggcagccccggcggcggcagcctgggcatcctgagcggcaacgacggcggcctgctgagcggcagcgagaaggagaccatgcagaacctgaacgacagactggccagctacctggacaaggtgagagccctggaggaggccaacaccgagctggagaacaagatcagagagtggtacgagaccagaggcaccggcaccgccgacgccagccagagcgactacagcaagtactaccccctgatcgaggacctgagaaacaagatcatcagcgccagcatcggcaacgcccagctgctgctgcagatcgacaacgccagactggccgccgaggacttcagaatgaagtacgagaacgagctggccctgagacagggcgtggaggccgacatcaacggcctgagaagagtgctggacgagctgaccctgaccagaaccgacctggagatgcagatcgagagcctgaacgaggagctggcctacatgaagaagaaccacgaggacgagctgcagagcttcagagtgggcggccccggcgaggtgagcgtggagatggacgccgcccccggcgtggacctgaccagactgctgaacgacatgagagcccagtacgagaccatcgccgagcagaacagaaaggacgccgaggcctggttcatcgagaagagcggcgagctgagaaaggagatcagcaccaacaccgagcagctgcagagcagcaagagcgaggtgaccgacctgagaagagccttccagaacctggagatcgagctgcagagccagctggccatgaagaagagcctggaggacagcctggccgaggccgagggcgactactgcgcccagctgagccaggtgcagcagctgatcagcaacctggaggcccagctgctgcaggtgagagccgacgccgagagacagaacgtggaccaccagagactgctgaacgtgaaggccagactggagctggagatcgagacctacagaagactgctggacggcgaggcccagggcgacggcctggaggagagcctgttcgtgaccgacagcaagagccaggcccagagcaccgacagcagcaaggaccccaccaagaccagaaagatcaagaccgtggtgcaggagatggtgaacggcgaggtggtgagcagccaggtgcaggagatcgaggagctgatgtag

SEQ ID NO: 86051 - DNA, 1068 bp, Artificial Sequence
  Description of Artificial Sequence: Synthetic coding sequence
atgagcctgagactgcagagcagcagcgccagctacggcggcggcttcggcggcggcagctgccagctgggcggcggcagaggcgtgagcacctgcagcaccagattcgtgagcggcggcagcgccggcggctacggcggcggcgtgagctgcggcttcggcggcggcgccggcagcggcttcggcggcggcctgggcggcggcttcggcggcggcttcgccggcggcttcgtggacttcggcgcctgcgacggcggcctgctgaccggcaacgagaagatcaccatgcagaacctgaacgacagactggccagctacctggagaaggtgagagccctggaggaggccaacgccgacctggaggtgaagatcagagactggcacctgaagcagagccccgccagccccgagagagactacagcccctactacaagaccatcgaggagctgagagacaagatcctgaccgccaccatcgagaacaacagagtgatcctggagatcgacaacgccagactggccgccgacgacttcagactgaagtacgagaacgagctggccctgagacagagcgtggaggccgacatcaacggcctgagaagagtgctggacgagctgaccctgagcaagaccgacctggagatgcagatcgagagcctgaacgaggagctggcctacatgaagaagaaccacgaggaggagatgaaggagttcagcaaccaggtggtgggccaggtgaacgtggagatggacgccacccccggcatcgacctgaccagagtgctggccgagatgagagagcagtacgaggccatggccgagagaaacagaagagacgccgaggagtggttccacaccaagagcgccgagctgaacaaggaggtgagcaccaacaccgccatgatccagaccagcaagaccgagatcaccgagctgagaagaaccctgcagggcctggagatcgagctgcagagccagctgagcatgaaggccggcctggagaacaccgccgccgaccccggcacccaccagcagcacagaggccccgccgagagagccccccagtag

SEQ ID NO: 86052 - DNA, 1377 bp, Artificial Sequence
  Description of Artificial Sequence: Synthetic coding sequence
atgagcctgagactgcagagcagcagcgccagctacggcggcggcttcggcggcggcagctgccagctgggcggcggcagaggcgtgagcacctgcagcaccagattcgtgagcggcggcagcgccggcggctacggcggcggcgtgagctgcggcttcggcggcggcgccggcagcggcttcggcggcggctacggcggcggcctgggcggcggctacggcggcggcctgggcggcggcttcggcggcggcttcgccggcggcttcgtggacttcggcgcctgcgacggcggcctgctgaccggcaacgagaagatcaccatgcagaacctgaacgacagactggccagctacctggagaaggtgagagccctggaggaggccaacgccgacctggaggtgaagatcagagactggcacctgaagcagagccccgccagccccgagagagactacagcccctactacaagaccatcgaggagctgagagacaagatcctgaccgccaccatcgagaacaacagagtgatcctggagatcgacaacgccagactggccgccgacgacttcagactgaagtacgagaacgagctggccctgagacagagcgtggaggccgacatcaacggcctgagaagagtgctggacgagctgaccctgagcaagaccgacctggagatgcagatcgagagcctgaacgaggagctggcctacatgaagaagaaccacgaggaggagatgaaggagttcagcaaccaggtggtgggccaggtgaacgtggagatggacgccacccccggcatcgacctgaccagagtgctggccgagatgagagagcagtacgaggccatggccgagagaaacagaagagacgccgaggagtggttccacaccaagagcgccgagctgaacaaggaggtgagcaccaacaccgccatgatccagaccagcaagaccgagatcaccgagctgagaagaaccctgcagggcctggagatcgagctgcagagccagctgagcatgaaggccggcctggagaacaccgtggccgagaccgagtgcagatacgccctgcagctgcagcagatccagggcctgatcagcagcatcgaggcccagctgagcgagctgagaagcgagatggagtgccagaaccaggagtacaagatgctgctggacatcaagaccagactggagcaggagatcgccacctacagaagcctgctggagggccaggacgccaagatgatcggcttccccagcagcgccggcagcgtgagccccagaagcaccagcgtgaccaccaccagcagcgccagcgtgaccaccaccagcaacgccagcggcagaagaaccagcgacgtgagaagaccctag

SEQ ID NO: 86053 - DNA, 1263 bp, Artificial Sequence
  Description of Artificial Sequence: Synthetic coding sequence
atgagcctgagactgcagagcagcagcgccagctacggcggcggcttcggcggcggcagctgccagctgggcggcggcagaggcgtgagcacctgcagcaccagattcgtgagcggcggcagcgccggcggctacggcggcggcgtgagctgcggcttcggcggcggcgccggcagcggcttcggcggcggctacggcggcggcctgggcggcggctacggcggcggcctgggcggcggcttcggcggcggcttcgccggcggcttcgtggacttcggcgcctgcgacggcggcctgctgaccggcaacgagaagatcaccatgcagaacctgaacgacagactggccagctacctggagaaggtgagagccctggaggaggccaacgccgacctggaggtgaagatcagagactggcacctgaagcagagccccgccagccccgagagagactacagcccctactacaagaccatcgaggagctgagagacaagatcctgaccgccaccatcgagaacaacagagtgatcctggagatcgacaacgccagactggccgccgacgacttcagactgaagtacgagaacgagctggccctgagacagagcgtggaggccgacatcaacggcctgagaagagtgctggacgagctgaccctgagcaagaccgacctggagatgcagatcgagagcctgaacgaggagctggcctacatgaagaagaaccacgaggaggagatgaaggagttcagcaaccaggtggtgggccaggtgaacgtggagatggacgccacccccggcatcgacctgaccagagtgctggccgagatgagagagcagtacgaggccatggccgagagaaacagaagagacgccgaggagtggttccacaccaagagcgccgagctgaacaaggaggtgagcaccaacaccgccatgatccagaccagcaagaccgagatcaccgagctgagaagaaccctgcagggcctggagatcgagctgcagagccagctgagcatgaaggccggcctggagaacaccgtggccgagaccgagtgcagatacgccctgcagctgcagcagatccagggcctgatcagcagcatcgaggcccagctgagcgagctgagaagcgagatggagtgccagaaccaggagtacaagatgctgctggacatcaagaccagactggagcaggagatcgccacctacagaagcctgctggagggccaggacgccaagaagagacagcccccctag

SEQ ID NO: 86054 - DNA, 1371 bp, Artificial Sequence
  Description of Artificial Sequence: Synthetic coding sequence
atgaccaccaccttcctgcagaccagcagcagcaccttcggcggcggcagcaccagaggcggcagcctgctggccggcggcggcggcttcggcggcggcagcctgagcggcggcggcggcagcagaagcatcagcgccagcagcgccagattcgtgagcagcggcagcggcggcggctacggcggcggcatgagagtgtgcggcttcggcggcggcgccggcagcgtgttcggcggcggcttcggcggcggcgtgggcggcggcttcggcggcggcttcggcggcggcgacggcggcctgctgagcggcaacgagaagatcaccatgcagaacctgaacgacagactggccagctacctggacaaggtgagagccctggaggaggccaacgccgacctggaggtgaagatccacgactggtaccagaagcagacccccaccagccccgagtgcgactacagccagtacttcaagaccatcgaggagctgagagacaagatcatggccaccaccatcgacaacagcagagtgatcctggagatcgacaacgccagactggccgccgacgacttcagactgaagtacgagaacgagctggccctgagacagggcgtggaggccgacatcaacggcctgagaagagtgctggacgagctgaccctggccagaaccgacctggagatgcagatcgagggcctgaacgaggagctggcctacctgaagaagaaccacgaggaggagatgaaggagttcagcagccagctggccggccaggtgaacgtggagatggacgccgcccccggcgtggacctgaccagagtgctggccgagatgagagagcagtacgaggccatggccgagaagaacagaagagacgtggaggcctggttcttcagcaagaccgaggagctgaacaaggaggtggccagcaacaccgagatgatccagaccagcaagaccgagatcaccgacctgagaagaaccatgcaggagctggagatcgagctgcagagccagctgagcatgaaggccggcctggagaacagcctggccgagaccgagtgcagatacgccacccagctgcagcagatccagggcctgatcggcggcctggaggcccagctgagcgagctgagatgcgagatggaggcccagaaccaggagtacaagatgctgctggacatcaagaccagactggagcaggagatcgccacctacagaagcctgctggagggccaggacgccaagatggccggcatcgccatcagagaggccagcagcggcggcggcggcagcagcagcaacttccacatcaacgtggaggagagcgtggacggccaggtggtgagcagccacaagagagagatctag

SEQ ID NO: 86055 - DNA, 876 bp, Artificial Sequence
  Description of Artificial Sequence: Synthetic coding sequence
atgaccggcaccagaagcagaccccagcccgcccagaacgccaccaccgccaacaccagcagacccctgaagagcagcggcaccagatacgagaacgagctggccctgagacagggcgtggaggccgacatcaacggcctgagaagagtgctggacgagctgaccctggccagaaccgacctggagatgcagatcgagggcctgaacgaggagctggcctacctgaagaagaaccacgaggaggagatgaaggagttcagcagccagctggccggccaggtgaacgtggagatggacgccgcccccggcgtggacctgaccagagtgctggccgagatgagagagcagtacgaggccatggccgagaagaacagaagagacgtggaggcctggttcttcagcaagaccgaggagctgaacaaggaggtggccagcaacaccgagatgatccagaccagcaagaccgagatcaccgacctgagaagaaccatgcaggagctggagatcgagctgcagagccagctgagcatgaaggccggcctggagaacagcctggccgagaccgagtgcagatacgccacccagctgcagcagatccagggcctgatcggcggcctggaggcccagctgagcgagctgagatgcgagatggaggcccagaaccaggagtacaagatgctgctggacatcaagaccagactggagcaggagatcgccacctacagaagcctgctggagggccaggacgccaagatggccggcatcgccatcagagaggccagcagcggcggcggcggcagcagcagcaacttccacatcaacgtggaggagagcgtggacggccaggtggtgagcagccacaagagagagatctag

SEQ ID NO: 86056 - DNA, 1371 bp, Artificial Sequence; identical to SEQ ID NO: 86054
  Description of Artificial Sequence: Synthetic coding sequence

SEQ ID NO: 86057 - DNA, 756 bp, Artificial Sequence
  Description of Artificial Sequence: Synthetic coding sequence
atgaccggcaccagaagcagaccccagcccgcccagaacgccaccaccgccaacaccagcagacccctgaagagcagcggcaccagatacgagaacgagctggccctgagacagggcgtggaggccgacatcaacggcctgagaagagtgctggacgagctgaccctggccagaaccgacctggagatgcagatcgagggcctgaacgaggagctggcctacctgaagaagaaccacgaggaggagatgaaggagttcagcagccagctggccggccaggtgaacgtggagatggacgccgcccccggcgtggacctgaccagagtgctggccgagatgagagagcagtacgaggccatggccgagaagaacagaagagacgtggaggcctggttcttcagcaagaccgaggagctgaacaaggaggtggccagcaacaccgagatgatccagaccagcaagaccgagatcaccgacctgagaagaaccatgcaggagctggagatcgagctgcagagccagctgagcatgaaggccggcctggagaacagcctggccgagaccgagtgcagatacgccacccagctgcagcagatccagggcctgatcggcggcctggaggcccagctgagcgagctgagatgcgagatggaggcccagaaccaggagtacaagatgctgctggacatcaagaccagactggagcaggagatcgccacctacagaagcctgctggagggccaggacgccaagtag

SEQ ID NO: 86058 - DNA, 663 bp, Artificial Sequence
  Description of Artificial Sequence: Synthetic coding sequence
atgaccggcaccagaagcagaccccagcccgcccagaacgccaccaccgccaacaccagcagacccctgaagagcagcggcaccagatacgagaacgagctggccctgagacagggcgtggaggccgacatcaacggcctgagaagagtgctggacgagctgaccctggccagaaccgacctggagatgcagatcgagggcctgaacgaggagctggcctacctgaagaagaaccacgaggaggagatgaaggagttcagcagccagctggccggccaggtgaacgtggagatggacgccgcccccggcgtggacctgaccagagtgctggccgagatgagagagcagtacgaggccatggccgagaagaacagaagagacgtggaggcctggttcttcagcaagaccgaggagctgaacaaggaggtggccagcaacaccgagatgatccagaccagcaagaccgagatcaccgacctgagaagaaccatgcaggagctggagatcgagctgcagagccagctgagcatgaaggccggcctggagaacagcctggccgagaccgagtgcagatacgccacccagctgcagcagatccagggcctgatcggcggcctggaggcccagctgagcgagctgagatgcgagatggaggcccagtag

SEQ ID NO: 86059 - DNA, 1422 bp, Artificial Sequence
  Description of Artificial Sequence: Synthetic coding sequence
atgaccacctgcagcagacagttcaccagcagcagcagcatgaagggcagctgcggcatcggcggcggcatcggcggcggcagcagcagaatcagcagcgtgctggccggcggcagctgcagagcccccagcacctacggcggcggcctgagcgtgagcagcagattcagcagcggcggcgcctgcggcctgggcggcggctacggcggcggcttcagcagcagcagcagcttcggcagcggcttcggcggcggctacggcggcggcctgggcgccggcttcggcggcggcctgggcgccggcttcggcggcggcttcgccggcggcgacggcctgctggtgggcagcgagaaggtgaccatgcagaacctgaacgacagactggccagctacctggacaaggtgagagccctggaggaggccaacgccgacctggaggtgaagatcagagactggtaccagagacagagacccagcgagatcaaggactacagcccctacttcaagaccatcgaggacctgagaaacaagatcatcgccgccaccatcgagaacgcccagcccatcctgcagatcgacaacgccagactggccgccgacgacttcagaaccaagtacgagcacgagctggccctgagacagaccgtggaggccgacgtgaacggcctgagaagagtgctggacgagctgaccctggccagaaccgacctggagatgcagatcgagggcctgaaggaggagctggcctacctgagaaagaaccacgaggaggagatgctggccctgagaggccagaccggcggcgacgtgaacgtggagatggacgccgcccccggcgtggacctgagcagaatcctgaacgagatgagagaccagtacgagcagatggccgagaagaacagaagagacgccgagacctggttcctgagcaagaccgaggagctgaacaaggaggtggccagcaacagcgagctggtgcagagcagcagaagcgaggtgaccgagctgagaagagtgctgcagggcctggagatcgagctgcagagccagctgagcatgaaggccagcctggagaacagcctggaggagaccaagggcagatactgcatgcagctgagccagatccagggcctgatcggcagcgtggaggagcagctggcccagctgagatgcgagatggagcagcagagccaggagtaccagatcctgctggacgtgaagaccagactggagcaggagatcgccacctacagaagactgctggagggcgaggacgcccacctgagcagccagcaggccagcggccagagctacagcagcagagaggtgttcaccagcagcagcagcagcagcagcagacagaccagacccatcctgaaggagcagagcagcagcagcttcagccagggccagagcagctag

SEQ ID NO: 86060 - DNA, 1299 bp, Artificial Sequence
  Description of Artificial Sequence: Synthetic coding sequence
atgaccaccagcatcagacagttcaccagcagcagcagcatcaagggcagcagcggcctgggcggcggcagcagcagaaccagctgcagactgagcggcggcctgggcgccggcagctgcagactgggcagcgccggcggcctgggcagcaccctgggcggcagcagctacagcagctgctacagcttcggcagcggcggcggctacggcagcagcttcggcggcgtggacggcctgctggccggcggcgagaaggccaccatgcagaacctgaacgacagactggccagctacctggacaaggtgagagccctggaggaggccaacaccgagctggaggtgaagatcagagactggtaccagagacaggcccccggccccgccagagactacagccagtactacagaaccatcgaggagctgcagaacaagatcctgaccgccaccgtggacaacgccaacatcctgctgcagatcgacaacgccagactggccgccgacgacttcagaaccaagttcgagaccgagcaggccctgagactgagcgtggaggccgacatcaacggcctgagaagagtgctggacgagctgaccctggccagagccgacctggagatgcagatcgagaacctgaaggaggagctggcctacctgaagaagaaccacgaggaggagatgaacgccctgagaggccaggtgggcggcgagatcaacgtggagatggacgccgcccccggcgtggacctgagcagaatcctgaacgagatgagagaccagtacgagaagatggccgagaagaacagaaaggacgccgaggactggttcttcagcaagaccgaggagctgaacagagaggtggccaccaacagcgagctggtgcagagcggcaagagcgagatcagcgagctgagaagaaccatgcaggccctggagatcgagctgcagagccagctgagcatgaaggccagcctggagggcaacctggccgagaccgagaacagatactgcgtgcagctgagccagatccagggcctgatcggcagcgtggaggagcagctggcccagctgagatgcgagatggagcagcagaaccaggagtacaagatcctgctggacgtgaagaccagactggagcaggagatcgccacctacagaagactgctggagggcgaggacgcccacctgacccagtacaagaaggagcccgtgaccaccagacaggtgagaaccatcgtggaggaggtgcaggacggcaaggtgatcagcagcagagagcaggtgcaccagaccaccagatag

SEQ ID NO: 86061 - DNA, 1920 bp, Artificial Sequence
  Description of Artificial Sequence: Synthetic coding sequence
atgagctgccagatcagctgcaagagcagaggcagaggcggcggcggcggcggcttcagaggcttcagcagcggcagcgccgtggtgagcggcggcagcagaagaagcaccagcagcttcagctgcctgagcagacacggcggcggcggcggcggcttcggcggcggcggcttcggcagcagaagcctggtgggcctgggcggcaccaagagcatcagcatcagcgtggccggcggcggcggcggcttcggcgccgccggcggcttcggcggcagaggcggcggcttcggcggcggcagcagcttcggcggcggcagcggcttcagcggcggcggcttcggcggcggcggcttcggcggcggcagattcggcggcttcggcggccccggcggcgtgggcggcctgggcggccccggcggcttcggccccggcggctaccccggcggcatccacgaggtgagcgtgaaccagagcctgctgcagcccctgaacgtgaaggtggaccccgagatccagaacgtgaaggcccaggagagagagcagatcaagaccctgaacaacaagttcgccagcttcatcgacaaggtgagattcctggagcagcagaaccaggtgctgcagaccaagtgggagctgctgcagcagatgaacgtgggcaccagacccatcaacctggagcccatcttccagggctacatcgacagcctgaagagatacctggacggcctgaccgccgagagaaccagccagaacagcgagctgaacaacatgcaggacctggtggaggactacaagaagaagtacgaggacgagatcaacaagagaaccgccgccgagaacgacttcgtgaccctgaagaaggacgtggacaacgcctacatgatcaaggtggagctgcagagcaaggtggacctgctgaaccaggagatcgagttcctgaaggtgctgtacgacgccgagatcagccagatccaccagagcgtgaccgacaccaacgtgatcctgagcatggacaacagcagaaacctggacctggacagcatcatcgccgaggtgaaggcccagtacgaggagatcgcccagagaagcaaggaggaggccgaggccctgtaccacagcaagtacgaggagctgcaggtgaccgtgggcagacacggcgacagcctgaaggagatcaagatcgagatcagcgagctgaacagagtgatccagagactgcagggcgagatcgcccacgtgaagaagcagtgcaagaacgtgcaggacgccatcgccgacgccgagcagagaggcgagcacgccctgaaggacgccagaaacaagctgaacgacctggaggaggccctgcagcaggccaaggaggacctggccagactgctgagagactaccaggagctgatgaacgtgaagctggccctggacgtggagatcgccacctacagaaagctgctggagggcgaggagtgcagaatgagcggcgacctgagcagcaacgtgaccgtgagcgtgaccagcagcaccatcagcagcaacgtggccagcaaggccgccttcggcggcagcggcggcagaggcagcagcagcggcggcggctacagcagcggcagcagcagctacggcagcggcggcagacagagcggcagcagaggcggcagcggcggcggcggcagcatcagcggcggcggctacggcagcggcggcggcagcggcggcagatacggcagcggcggcggcagcaagggcggcagcatcagcggcggcggctacggcagcggcggcggcaagcacagcagcggcggcggcagcagaggcggcagcagcagcggcggcggctacggcagcggcggcggcggcagcagcagcgtgaagggcagcagcggcgaggccttcggcagcagcgtgaccttcagcttcagatag

SEQ ID NO: 86062 - DNA, 1275 bp, Artificial Sequence
  Description of Artificial Sequence: Synthetic coding sequence
atggacttcagcagaagaagcttccacagaagcctgagcagcagcctgcaggcccccgtggtgagcaccgtgggcatgcagagactgggcaccacccccagcgtgtacggcggcgccggcggcagaggcatcagaatcagcaacagcagacacaccgtgaactacggcagcgacctgaccggcggcggcgacctgttcgtgggcaacgagaagatggccatgcagaacctgaacgacagactggccagctacctggagaaggtgagaaccctggagcagagcaacagcaagctggaggtgcagatcaagcagtggtacgagaccaacgcccccagagccggcagagactacagcgcctactacagacagatcgaggagctgagaagccagatcaaggacgcccagctgcagaacgccagatgcgtgctgcagatcgacaacgccaagctggccgccgaggacttcagactgaagtacgagaccgagagaggcatcagactgaccgtggaggccgacctgcagggcctgaacaaggtgttcgacgacctgaccctgcacaagaccgacctggagatccagatcgaggagctgaacaaggacctggccctgctgaagaaggagcaccaggaggaggtggacggcctgcacaagcacctgggcaacaccgtgaacgtggaggtggacgccgcccccggcctgaacctgggcgtgatcatgaacgagatgagacagaagtacgaggtgatggcccagaagaacctgcaggaggccaaggagcagttcgagagacagaccgccgtgctgcagcagcaggtgaccgtgaacaccgaggagctgaagggcaccgaggtgcagctgaccgagctgagaagaaccagccagagcctggagatcgagctgcagagccacctgagcatgaaggagagcctggagcacaccctggaggagaccaaggccagatacagcagccagctggccaacctgcagagcctgctgagcagcctggaggcccagctgatgcagatcagaagcaacatggagagacagaacaacgagtaccacatcctgctggacatcaagaccagactggagcaggagatcgccacctacagaagactgctggagggcgaggacgtgaagaccaccgagtaccagctgagcaccctggaggagagagacatcaagaagaccagaaagatcaagaccgtggtgcaggaggtggtggacggcaaggtggtgagcagcgaggtgaaggaggtggaggagaacatctag

SEQ ID NO: 86063 - DNA, 1578 bp, Artificial Sequence
  Description of Artificial Sequence: Synthetic coding sequence
atgagctgcagcagcagagccagcagcagcagagccggcggcagcagcagcgccagagtgagcgccggcggcagcagcttcagcagcggcagcagatgcggcctgggcggcagcagcgcccagggcttcagaggcggcgccagcagctgcagcctgagcggcggcagcagcggcgccttcggcggcagcttcggcggcggcttcggcagctgcagcgtgggcggcggcttcggcggcgccagcggcagcggcaccggcttcggcggcggcagcagcttcggcggcgtgagcggcttcggcagaggcagcggcttctgcggcagcagcagattcagcagcggcgccaccggcggcttctacagctacggcggcggcatgggcggcggcgtgggcgacggcggcctgttcagcggcggcgagaagcagaccatgcagaacctgaacgacagactggccaactacctggacaaggtgagagccctggaggaggccaacaccgacctggagaacaagatcaaggagtggtacgacaagtacggccccggcagcggcgacggcggcagcggcagagactacagcaagtactacagcatcatcgaggacctgagaaaccagatcatcgccgccaccgtggagaacgccggcatcatcctgcacatcgacaacgccagactggccgccgacgacttcagactgaagtacgagaacgagctgtgcctgagacagagcgtggaggccgacatcaacggcctgagaaaggtgctggacgacctgaccatgaccagaagcgacctggagatgcagatcgagagcttcaccgaggagctggcctacctgagaaagaaccacgaggaggagatgaagaacatgcagggcagcagcggcggcgaggtgaccgtggagatgaacgccgcccccggcaccgacctgaccaagctgctgaacgacatgagagcccagtacgaggagctggccgagcagaacagaagagaggccgaggagagattcaacaagcagagcgccagcctgcaggcccagatcagcaccgacgccggcgccgccaccagcgccaagaacgagatcaccgagctgaagagaaccctgcaggccctggagatcgagctgcagagccagctggccatgaagagcagcctggagggcaccctggccgacaccgaggccggctacgtggcccagctgagcgagatccagacccagatcagcgccctggaggaggagatctgccagatctggggcgagaccaagtgccagaacgccgagtacaagcagctgctggacatcaagaccagactggaggtggagatcgagacctacagaagactgctggacggcgagggcggcggcagcagcttcgccgagttcggcggcagaaacagcggcagcgtgaacatgggcagcagagacctggtgagcggcgacagcagaagcggcagctgcagcggccagggcagagacagcagcaagaccagagtgaccaagaccatcgtggaggagctggtggacggcaaggtggtgagcagccaggtgagcagcatcagcgaggtgaaggtgaagtag

SEQ ID NO: 86064 - DNA, 1890 bp, Artificial Sequence
  Description of Artificial Sequence: Synthetic coding sequence
atgagcagacaggccagcaagaccagcggcggcggcagccagggcttcagcggcagaagcgccgtggtgagcggcagcagcagaatgagctgcgtggcccacagcggcggcgccggcggcggcgcctacggcttcagaagcggcgccggcggcttcggcagcagaagcctgtacaacctgggcggcaacaagagcatcagcatcagcgtggccgccggcggcagcagagccggcggcttcggcggcggcagaagcagctgcgccttcgccggcggctacggcggcggcttcggcagcggctacggcggcggcttcggcggcggcttcggcggcggcagaggcatgggcggcggcttcggcggcgccggcggcttcggcggcgccggcggcttcggcggcgccggcggcttcggcggccccggcggcttcggcggcagcggcggcttcggcggccccggcagcctgggcagccccggcggcttcggccccggcggcttccccggcggcatccaggaggtgaccatcaaccagagcctgctgcagcccctgaacgtggagatcgacccccagatcggccaggtgaaggcccaggagagagagcagatcaagaccctgaacaacaagttcgccagcttcatcgacaaggtgagattcctggagcagcagaacaaggtgctggagaccaagtggaacctgctgcagcagcagggcaccagcagcatcagcggcaccaacaacctggagcccctgttcgagaaccacatcaactacctgagaagctacctggacaacatcctgggcgagagaggcagactggacagcgagctgaagaacatggaggacctggtggaggacttcaagaagaagtacgaggacgagatcaacaagagaaccgccgccgagaacgagttcgtgaccctgaagaaggacgtggacagcgcctacatgaacaaggtggagctgcaggccaaggtggacgccctgatcgacgagatcgacttcctgagaaccctgtacgacgccgagctgagccagatgcagagccacatcagcgacaccagcgtggtgctgagcatggacaacaacagaagcctggacctggacagcatcatcgccgaggtgagagcccagtacgaggacatcgcccagagaagcaaggccgaggccgaggccctgtaccagaccaagctgggcgagctgcagaccaccgccggcagacacggcgacgacctgagaaacaccaagagcgagatcatcgagctgaacagaatgatccagagactgagagccgagatcgagggcgtgaagaagcagaacgccaacctgcagaccgccatcgccgaggccgagcagcacggcgagatggccctgaaggacgccaacgccaagctgcaggagctgcaggccgccctgcagcaggccaaggacgacctggccagactgctgagagactaccaggagctgatgaacgtgaagctggccctggacgtggagatcgccacctacagaaagctgctggagggcgaggagtacagcagaatgagcggcgagtgccccagcgccgtgagcatcagcgtggtgagcagcagcaccaccagcgccagcgccggcggctacggcggcggctacggcggcggcatgggcggcggcctgggcggcggcttcagcgccggcggcggcagcggcagcggcttcggcagaggcggcggcggcggcatcggcggcggcttcggcggcggcagcagcggcttcagcggcggcagcggcttcggcagcatcagcggcgccagatacggcgtgagcggcggcggcttcagcagcgccagcaacagaggcggcagcatcaagttcagccagagcagccagagcagccagagatacagcagatag

SEQ ID NO: 86065 - DNA, 1887 bp, Artificial Sequence
  Description of Artificial Sequence: Synthetic coding sequence
atgagcagacaggccagcaagaccagcggcggcggcagccagggcttcagcggcagaagcgccgtggtgagcggcagcagcagaatgagctgcgtggcccacagcggcggcgccggcggcggcgcctacggcttcagaagcggcgccggcggcttcggcagcagaagcctgtacaacctgggcggcaacaagagcatcagcatcagcgtggccgccggcggcagcagagccggcggcttcggcggcggcagaagcagctgcgccttcgccggcggctacggcggcggcttcggcagcggctacggcggcggcttcggcggcggcttcggcggcggcagaggcatgggcggcggcttcggcggcgccggcggcttcggcggcgccggcggcttcggcggcgccggcggcttcggcggccccggcggcttcggcggcagcggcggcttcggcggccccggcagcctgggcagccccggcggcttcggccccggcggcttccccggcggcatccaggaggtgaccatcaaccagagcctgctgcagcccctgaacgtggagatcgacccccagatcggccaggtgaaggcccaggagagagagcagatcaagaccctgaacaacaagttcgccagcttcatcgacaaggtgagattcctggagcagcagaacaaggtgctggagaccaagtggaacctgctgcagcagcagggcaccagcagcatcagcggcaccaacaacctggagcccctgttcgagaaccacatcaactacctgagaagctacctggacaacatcctgggcgagagaggcagactggacagcgagctgaagaacatggaggacctggtggaggacttcaagaagaagtacgaggacgagatcaacaagagaaccgccgccgagaacgagttcgtgaccctgaagaaggacgtggacagcgcctacatgaacaaggtggagctgcaggccaaggtggacgccctgatcgacgagatcgacttcctgagaaccctgtacgacgccgagctgagccagatgcagagccacatcagcgacaccagcgtggtgctgagcatggacaacaacagaagcctggacctggacagcatcatcgccgaggtgagagcccagtacgaggacatcgcccagagaagcaaggccgaggccgaggccctgtaccagaccaagctgggcgagctgcagaccaccgccggcagacacggcgacgacctgagaaacaccaagagcgagatcatcgagctgaacagaatgatccagagactgagagccgagatcgagggcgtgaagaagcagaacgccaacctgcagaccgccatcgccgaggccgagcagcacggcgagatggccctgaaggacgccaacgccaagctgcaggagctgcaggccgccctgcagcaggccaaggacgacctggccagactgctgagagactaccaggagctgatgaacgtgaagctggccctggacgtggagatcgccacctacagaaagctgctggagggcgaggagtacagaatgagcggcgagtgccccagcgccgtgagcatcagcgtggtgagcagcagcaccaccagcgccagcgccggcggctacggcggcggctacggcggcggcatgggcggcggcctgggcggcggcttcagcgccggcggcggcagcggcagcggcttcggcagaggcggcggcggcggcatcggcggcggcttcggcggcggcagcagcggcttcagcggcggcagcggcttcggcagcatcagcggcgccagatacggcgtgagcggcggcggcttcagcagcgccagcaacagaggcggcagcatcaagttcagccagagcagccagagcagccagagatacagcagatag

SEQ ID NO: 86066 - DNA, 1251 bp, Artificial Sequence
  Description of Artificial Sequence: Synthetic coding sequence
atgccctacaacttctgcctgcccagcctgagctgcagaaccagctgcagcagcagaccctgcgtgccccccagctgccacagctgcaccctgcccggcgcctgcaacatccccgccaacgtgagcaactgcaactggttctgcgagggcagcttcaacggcagcgagaaggagaccatgcagttcctgaacgacagactggccagctacctggagaaggtgagacagctggagagagacaacgccgagctggagaacctgatcagagagagaagccagcagcaggagcccctgctgtgccccagctaccagagctacttcaagaccatcgaggagctgcagcagaagatcctgtgcaccaagagcgagaacgccagactggtggtgcagatcgacaacgccaagctggccgccgacgacttcagaaccaagtaccagaccgagctgagcctgagacagctggtggagagcgacatcaacggcctgagaagaatcctggacgagctgaccctgtgcaagagcgacctggaggcccaggtggagagcctgaaggaggagctgctgtgcctgaagagcaaccacgagcaggaggtgaacaccctgagatgccagctgggcgacagactgaacgtggaggtggacgccgcccccaccgtggacctgaacagagtgctgaacgagaccagaagccagtacgaggccctggtggagaccaacagaagagaggtggagcagtggttcaccacccagaccgaggagctgaacaagcaggtggtgagcagcagcgagcagctgcagagctaccaggccgagatcatcgagctgagaagaaccgtgaacgccctggagatcgagctgcaggcccagcacaacctgagagacagcctggagaacaccctgaccgagagcgaggccagatacagcagccagctgagccaggtgcagagcctgatcaccaacgtggagagccagctggccgagatcagaagcgacctggagagacagaaccaggagtaccaggtgctgctggacgtgagagccagactggagtgcgagatcaacacctacagaagcctgctggagagcgaggactgcaacctgcccagcaacccctgcgccaccaccaacgcctgcagcaagcccatcggcccctgcctgagcaacccctgcaccagctgcgtgccccccgccccctgcaccccctgcgcccccagacccagatgcggcccctgcaacagcttcgtgagatag

SEQ ID NO: 86067 - DNA, 1674 bp, Artificial Sequence
  Description of Artificial Sequence: Synthetic coding sequence
atggtgagcaagctgaccagcctgcagcaggagctgctgagcgccctgctgagcagcggcgtgaccaaggaggtgctggtgcaggccctggaggagctgctgcccagccccaacttcggcgtgaagctggagaccctgcccctgagccccggcagcggcgccgagcccgacaccaagcccgtgttccacaccctgaccaacggccacgccaagggcagactgagcggcgacgagggcagcgaggacggcgacgactacgacaccccccccatcctgaaggagctgcaggccctgaacaccgaggaggccgccgagcagagagccgaggtggacagaatgctgagcgaggacccctggagagccgccaagatgatcaagggctacatgcagcagcacaacatcccccagagagaggtggtggacgtgaccggcctgaaccagagccacctgagccagcacctgaacaagggcacccccatgaagacccagaagagagccgccctgtacacctggtacgtgagaaagcagagagagatcctgagacagttcaaccagaccgtgcagagcagcggcaacatgaccgacaagagcagccaggaccagctgctgttcctgttccccgagttcagccagcagagccacggccccggccagagcgacgacgcctgcagcgagcccaccaacaagaagatgagaagaaacagattcaagtggggccccgccagccagcagatcctgtaccaggcctacgacagacagaagaaccccagcaaggaggagagagaggccctggtggaggagtgcaacagagccgagtgcctgcagagaggcgtgagccccagcaaggcccacggcctgggcagcaacctggtgaccgaggtgagagtgtacaactggttcgccaacagaagaaaggaggaggccttcagacagaagctggccatggacgcctacagcagcaaccagacccacagcctgaaccccctgctgagccacggcagcccccaccaccagcccagcagcagcccccccaacaagctgagcggcgtgagatacagccagcagggcaacaacgagatcaccagcagcagcaccatcagccaccacggcaacagcgccatggtgaccagccagagcgtgctgcagcaggtgagccccgccagcctggaccccggccacaacctgctgagccccgacggcaagatgatcagcgtgagcggcggcggcctgccccccgtgagcaccctgaccaacatccacagcctgagccaccacaacccccagcagagccagaacctgatcatgacccccctgagcggcgtgatggccatcgcccagagcctgaacaccagccaggcccagagcgtgcccgtgatcaacagcgtggccggcagcctggccgccctgcagcccgtgcagttcagccagcagctgcacagcccccaccagcagcccctgatgcagcagagccccggcagccacatggcccagcagcccttcatggccgccgtgacccagctgcagaacagccacatgtacgcccacaagcaggagcccccccagtacagccacaccagcagattccccagcgccatggtggtgaccgacaccagcagcatcagcaccctgaccaacatgagcagcagcaagcagtgccccctgcaggcctggtag

SEQ ID NO: 86068 - DNA, 1215 bp, Artificial Sequence
  Description of Artificial Sequence: Synthetic coding sequence
atgagctacagctgcggcctgcccagcctgagctgcagaaccagctgcagcagcagaccctgcgtgccccccagctgccacggctgcaccctgcccggcgcctgcaacatccccgccaacgtgagcaactgcaactggttctgcgagggcagcttcaacggcagcgagaaggagaccatgcagttcctgaacgacagactggccagctacctggagaaggtgagacagctggagagagacaacgccgagctggagaacctgatcagagagagaagccagcagcaggagcccctggtgtgcgccagctaccagagctacttcaagaccatcgaggagctgcagcagaagatcctgtgcagcaagagcgagaacgccagactggtggtgcagatcgacaacgccaagctggccagcgacgacttcagaaccaagtacgagaccgagctgagcctgagacagctggtggagagcgacatcaacggcctgagaagaatcctggacgagctgaccctgtgcagaagcgacctggaggcccaggtggagagcctgaaggaggagctgctgtgcctgaagcagaaccacgagcaggaggtgaacaccctgagatgccagctgggcgacagactgaacgtggaggtggacgccgcccccaccgtggacctgaaccaggtgctgaacgagaccagaagccagtacgaggccctggtggagaccaacagaagagaggtggagcagtggttcgccacccagaccgaggagctgaacaagcaggtggtgagcagcagcgagcagctgcagagctaccaggccgagatcatcgagctgagaagaaccgtgaacgccctggagatcgagctgcaggcccagcacaacctgagagacagcctggagaacaccctgaccgagagcgaggccagatacagcagccagctgagccaggtgcagagactgatcaccaacgtggagagccagctggccgagatcagaagcgacctggagagacagaaccaggagtaccaggtgctgctggacgtgagagccagactggagtgcgagatcaacacctacagaagcctgctggagagcgaggactgcaagctgcccagcaacccctgcgccaccaccaacgcctgcgacaagagcaccggcccctgcatcagcaacccctgcggcctgagagccagatgcggcccctgcaacaccttcggctactag

SEQ ID NO: 86069 - DNA, 1215 bp, Artificial Sequence
  Description of Artificial Sequence: Synthetic coding sequence
atgccctacaacttctgcctgcccagcctgagctgcagaaccagctgcagcagcagaccctgcgtgccccccagctgccacggctacaccctgcccggcgcctgcaacatccccgccaacgtgagcaactgcaactggttctgcgagggcagcttcaacggcagcgagaaggagaccatgcagttcctgaacgacagactggccagctacctggagaaggtgagacagctggagagagacaacgccgagctggagaacctgatcagagagagaagccagcagcaggagcccctgctgtgccccagctaccagagctacttcaagaccatcgaggagctgcagcagaagatcctgtgcagcaagagcgagaacgccagactggtggtgcagatcgacaacgccaagctggccgccgacgacttcagaaccaagtaccagaccgagcagagcctgagacagctggtggagagcgacatcaacagcctgagaagaatcctggacgagctgaccctgtgcagaagcgacctggaggcccagatggagagcctgaaggaggagctgctgagcctgaagcagaaccacgagcaggaggtgaacaccctgagatgccagctgggcgacagactgaacgtggaggtggacgccgcccccgccgtggacctgaaccaggtgctgaacgagaccagaaaccagtacgaggccctggtggagaccaacagaagagaggtggagcagtggttcgccacccagaccgaggagctgaacaagcaggtggtgagcagcagcgagcagctgcagagctaccaggccgagatcatcgagctgagaagaaccgtgaacgccctggagatcgagctgcaggcccagcacaacctgagatacagcctggagaacaccctgaccgagagcgaggccagatacagcagccagctgagccaggtgcagagcctgatcaccaacgtggagagccagctggccgagatcagaagcgacctggagagacagaaccaggagtaccaggtgctgctggacgtgagagccagactggagtgcgagatcaacacctacagaagcctgctggagagcgaggactgcaagctgcccagcaacccctgcgccaccaccaacgcctgcgagaagcccatcggcagctgcgtgaccaacccctgcggccccagaagcagatgcggcccctgcaacaccttcggctactag

SEQ ID NO: 86070 - DNA, 1311 bp, Artificial Sequence
  Description of Artificial Sequence: Synthetic coding sequence
atgctgtacgccaagcccccccccaccatcaacggcatcaagggcctgcagagaaaggagagactgaagcccgcccacatccacctgcagcagctgacctgcttcagcatcacctgcagcagcaccatgagctacagctgctgcctgcccagcctgggctgcagaaccagctgcagcagcagaccctgcgtgccccccagctgccacggctacaccctgcccggcgcctgcaacatccccgccaacgtgagcaactgcaactggttctgcgagggcagcttcaacggcagcgagaaggagaccatgcagttcctgaacgacagactggccagctacctggagaaggtgagacagctggagagagacaacgccgagctggagaagctgatccaggagagaagccagcagcaggagcccctgctgtgccccagctaccagagctacttcaagaccatcgaggagctgcagcagaagatcctgtgcgccaaggccgagaacgccagactggtggtgaacatcgacaacgccaagctggccagcgacgacttcagaagcaagtaccagaccgagcagagcctgagactgctggtggagagcgacatcaacagcatcagaagaatcctggacgagctgaccctgtgcaagagcgacctggagagccaggtggagagcctgagagaggagctgatctgcctgaagaagaaccacgaggaggaggtgaacaccctgagaagccagctgggcgacagactgaacgtggaggtggacaccgcccccaccgtggacctgaaccaggtgctgaacgagaccagaagccagtacgaggccctggtggagatcaacagaagagaggtggagcagtggttcgccacccagaccgaggagctgaacaagcaggtggtgagcagcagcgagcagctgcagagctgccaggccgagatcatcgagctgagaagaaccgtgaacgccctggagatcgagctgcaggcccagcacaacctgagagacagcctggagaacaccctgaccgagagcgaggcccactacagcagccagctgagccaggtgcagagcctgatcaccaacgtggagagccagctggccgagatcagatgcgacctggagagacagaaccaggagtaccaggtgctgctggacgtgagagccagactggagtgcgagatcaacacctacagaagcctgctggagagcgaggactgcaagctgccctgcaacccctgcgccaccaccaacgccagcggcaacagctgcggcccctgcggcaccagccagaagggctgctgcaactag

SEQ ID NO: 86071 - DNA, 1185 bp, Artificial Sequence
  Description of Artificial Sequence: Synthetic coding sequence
atgagctacagctgctgcctgcccagcctgggctgcagaaccagctgcagcagcagaccctgcgtgccccccagctgccacggctacaccctgcccggcgcctgcaacatccccgccaacgtgagcaactgcaactggttctgcgagggcagcttcaacggcagcgagaaggagaccatgcagttcctgaacgacagactggccagctacctggagaaggtgagacagctggagagagacaacgccgagctggagaagctgatccaggagagaagccagcagcaggagcccctgctgtgccccagctaccagagctacttcaagaccatcgaggagctgcagcagaagatcctgtgcgccaaggccgagaacgccagactggtggtgaacatcgacaacgccaagctggccagcgacgacttcagaagcaagtaccagaccgagcagagcctgagactgctggtggagagcgacatcaacagcatcagaagaatcctggacgagctgaccctgtgcaagagcgacctggagagccaggtggagagcctgagagaggagctgatctgcctgaagaagaaccacgaggaggaggtgaacaccctgagaagccagctgggcgacagactgaacgtggaggtggacaccgcccccaccgtggacctgaaccaggtgctgaacgagaccagaagccagtacgaggccctggtggagatcaacagaagagaggtggagcagtggttcgccacccagaccgaggagctgaacaagcaggtggtgagcagcagcgagcagctgcagagctgccaggccgagatcatcgagctgagaagaaccgtgaacgccctggagatcgagctgcaggcccagcacaacctgagagacagcctggagaacaccctgaccgagagcgaggcccactacagcagccagctgagccaggtgcagagcctgatcaccaacgtggagagccagctggccgagatcagatgcgacctggagagacagaaccaggagtaccaggtgctgctggacgtgagagccagactggagtgcgagatcaacacctacagaagcctgctggagagcgaggactgcaagctgccctgcaacccctgcgccaccaccaacgccagcggcaacagctgcggcccctgcggcaccagccagaagggctgctgcaactag

SEQ ID NO: 86072 - DNA, 1278 bp, Artificial Sequence
  Description of Artificial Sequence: Synthetic coding sequence
atgtacagcagcagcagctgcaagctgcccagcctgagccccgtggccagaagcttcagcgcctgcagcgtgggcctgggcagaagcagctacagagccaccagctgcctgcccgccctgtgcctgcccgccggcggcttcgccaccagctacagcggcggcggcggctggttcggcgagggcatcctgaccggcaacgagaaggagaccatgcagagcctgaacgacagactggccggctacctggagaaggtgagacagctggagcaggagaacgccagcctggagagcagaatcagagagtggtgcgagcagcaggtgccctacatgtgccccgactaccagagctacttcagaaccatcgaggagctgcagaagaagaccctgtgcagcaaggccgagaacgccagactggtggtggagatcgacaacgccaagctggccgccgacgacttcagaaccaagtacgagaccgaggtgagcctgagacagctggtggagagcgacatcaacggcctgagaagaatcctggacgacctgaccctgtgcaagagcgacctggaggcccaggtggagagcctgaaggaggagctgctgtgcctgaagaagaaccacgaggaggaggtgaacagcctgagatgccagctgggcgacagactgaacgtggaggtggacgccgccccccccgtggacctgaacagagtgctggaggagatgagatgccagtacgagaccctggtggagaacaacagaagagacgccgaggactggctggacacccagagcgaggagctgaaccagcaggtggtgagcagcagcgagcagctgcagagctgccaggccgagatcatcgagctgagaagaaccgtgaacgccctggagatcgagctgcaggcccagcacagcatgagagacgccctggagagcaccctggccgagaccgaggccagatacagcagccagctggcccagatgcagtgcatgatcaccaacgtggaggcccagctggccgagatcagagccgacctggagagacagaaccaggagtaccaggtgctgctggacgtgagagccagactggagtgcgagatcaacacctacagaggcctgctggagagcgaggacagcaagctgccctgcaacccctgcgcccccgactacagccccagcaagagctgcctgccctgcctgcccgccgccagctgcggccccagcgccgccagaaccaactgcagccccagacccatctgcgtgccctgccccggcggcagattctag

SEQ ID NO: 86073 - DNA, 1368 bp, Artificial Sequence
  Description of Artificial Sequence: Synthetic coding sequence
atggccagcaagtgcctgaaggccggcttcagcagcggcagcctgaagagccccggcggcgccagcggcggcagcaccagagtgagcgccatgtacagcagcagcagctgcaagctgcccagcctgagccccgtggccagaagcttcagcgcctgcagcgtgggcctgggcagaagcagctacagagccaccagctgcctgcccgccctgtgcctgcccgccggcggcttcgccaccagctacagcggcggcggcggctggttcggcgagggcatcctgaccggcaacgagaaggagaccatgcagagcctgaacgacagactggccggctacctggagaaggtgagacagctggagcaggagaacgccagcctggagagcagaatcagagagtggtgcgagcagcaggtgccctacatgtgccccgactaccagagctacttcagaaccatcgaggagctgcagaagaagaccctgtgcagcaaggccgagaacgccagactggtggtggagatcgacaacgccaagctggccgccgacgacttcagaaccaagtacgagaccgaggtgagcctgagacagctggtggagagcgacatcaacggcctgagaagaatcctggacgacctgaccctgtgcaagagcgacctggaggcccaggtggagagcctgaaggaggagctgctgtgcctgaagaagaaccacgaggaggaggtgaacagcctgagatgccagctgggcgacagactgaacgtggaggtggacgccgccccccccgtggacctgaacagagtgctggaggagatgagatgccagtacgagaccctggtggagaacaacagaagagacgccgaggactggctggacacccagagcgaggagctgaaccagcaggtggtgagcagcagcgagcagctgcagagctgccaggccgagatcatcgagctgagaagaaccgtgaacgccctggagatcgagctgcaggcccagcacagcatgagagacgccctggagagcaccctggccgagaccgaggccagatacagcagccagctggcccagatgcagtgcatgatcaccaacgtggaggcccagctggccgagatcagagccgacctggagagacagaaccaggagtaccaggtgctgctggacgtgagagccagactggagtgcgagatcaacacctacagaggcctgctggagagcgaggacagcaagctgccctgcaacccctgcgcccccgactacagccccagcaagagctgcctgccctgcctgcccgccgccagctgcggccccagcgccgccagaaccaactgcagccccagacccatctgcgtgccctgccccggcggcagattctag

SEQ ID NO: 86074 - DNA, 1404 bp, Artificial Sequence
  Description of Artificial Sequence: Synthetic coding sequence
atggccacccagacctgcacccccaccttcagcaccggcagcatcaagggcctgtgcggcaccgccggcggcatcagcagagtgagcagcatcagaagcgtgggcagctgcagagtgcccagcctggccggcgccgccggctacatcagcagcgccagaagcggcctgagcggcctgggcagctgcctgcccggcagctacctgagcagcgagtgccacaccagcggcttcgtgggcagcggcggctggttctgcgagggcagcttcaacggcagcgagaaggagaccatgcagttcctgaacgacagactggccaactacctggagaaggtgagacagctggagagagagaacgccgagctggagagcagaatccaggagtggtacgagttccagatcccctacatctgccccgactaccagagctacttcaagaccatcgaggacttccagcagaagatcctgctgaccaagagcgagaacgccagactggtgctgcagatcgacaacgccaagctggccgccgacgacttcagaaccaagtacgagaccgagctgagcctgagacagctggtggaggccgacatcaacggcctgagaagaatcctggacgagctgaccctgtgcaaggccgacctggaggcccaggtggagagcctgaaggaggagctgatgtgcctgaagaagaaccacgaggaggaggtgagcgtgctgagatgccagctgggcgacagactgaacgtggaggtggacgccgccccccccgtggacctgaacaagatcctggaggacatgagatgccagtacgaggccctggtggagaacaacagaagagacgtggaggcctggttcaacacccagaccgaggagctgaaccagcaggtggtgagcagcagcgagcagctgcagtgctgccagaccgagatcatcgagctgagaagaaccgtgaacgccctggagatcgagctgcaggcccagcacagcatgagaaacagcctggagagcaccctggccgagaccgaggccagatacagcagccagctggcccagatgcagtgcctgatcagcaacgtggaggcccagctgagcgagatcagatgcgacctggagagacagaaccaggagtaccaggtgctgctggacgtgaaggccagactggagggcgagatcgccacctacagacacctgctggagggcgaggactgcaagctgcccccccagccctgcgccaccgcctgcaagcccgtgatcagagtgcccagcgtgccccccgtgccctgcgtgcccagcgtgccctgcacccccgccccccaggtgggcacccagatcagaaccatcaccgaggagatcagagacggcaaggtgatcagcagcagagagcacgtgcagagcagacccctgtag

SEQ ID NO: 86075 - DNA, 1254 bp, Artificial Sequence
  Description of Artificial Sequence: Synthetic coding sequence
atgctgagaagcggcctgagcggcctgggcagctgcctgcccggcagctacctgagcagcgagtgccacaccagcggcttcgtgggcagcggcggctggttctgcgagggcagcttcaacggcagcgagaaggagaccatgcagttcctgaacgacagactggccaactacctggagaaggtgagacagctggagagagagaacgccgagctggagagcagaatccaggagtggtacgagttccagatcccctacatctgccccgactaccagagctacttcaagaccatcgaggacttccagcagaagatcctgctgaccaagagcgagaacgccagactggtgctgcagatcgacaacgccaagctggccgccgacgacttcagaaccaagtacgagaccgagctgagcctgagacagctggtggaggccgacatcaacggcctgagaagaatcctggacgagctgaccctgtgcaaggccgacctggaggcccaggtggagagcctgaaggaggagctgatgtgcctgaagaagaaccacgaggaggaggtgagcgtgctgagatgccagctgggcgacagactgaacgtggaggtggacgccgccccccccgtggacctgaacaagatcctggaggacatgagatgccagtacgaggccctggtggagaacaacagaagagacgtggaggcctggttcaacacccagaccgaggagctgaaccagcaggtggtgagcagcagcgagcagctgcagtgctgccagaccgagatcatcgagctgagaagaaccgtgaacgccctggagatcgagctgcaggcccagcacagcatgagaaacagcctggagagcaccctggccgagaccgaggccagatacagcagccagctggcccagatgcagtgcctgatcagcaacgtggaggcccagctgagcgagatcagatgcgacctggagagacagaaccaggagtaccaggtgctgctggacgtgaaggccagactggagggcgagatcgccacctacagacacctgctggagggcgaggactgcaagctgcccccccagccctgcgccaccgcctgcaagcccgtgatcagagtgcccagcgtgccccccgtgccctgcgtgcccagcgtgccctgcacccccgccccccaggtgggcacccagatcagaaccatcaccgaggagatcagagacggcaaggtgatcagcagcagagagcacgtgcagagcagacccctgtag

SEQ ID NO: 86076 - DNA, 1200 bp, Artificial Sequence
  Description of Artificial Sequence: Synthetic coding sequence
atggccagaagattccaggaggagctggccgccttcctgttcgagtacgacacccccagaatggtgctggtgagaaacaagaaggtgggcgtgatcttcagactgatccagctggtggtgctggtgtacgtgatcggctgggtgttcctgtacgagaagggctaccagaccagcagcggcctgatcagcagcgtgagcgtgaagctgaagggcctggccgtgacccagctgcccggcctgggcccccaggtgtgggacgtggccgactacgtgttccccgcccagggcgacaacagcttcgtggtgatgaccaacttcatcgtgacccccaagcagacccagggctactgcgccgagcaccccgagggcggcatctgcaaggaggacagcggctgcacccccggcaaggccaagagaaaggcccagggcatcagaaccggcaagtgcgtggccttcaacgacaccgtgaagacctgcgagatcttcggctggtgccccgtggaggtggacgacgacatccccagacccgccctgctgagagaggccgagaacttcaccctgttcatcaagaacagcatcagcttccccagattcaaggtgaacagaagaaacctggtggaggaggtgaacgccgcccacatgaagacctgcctgttccacaagaccctgcaccccctgtgccccgtgttccagctgggctacgtggtgcaggagagcggccagaacttcagcaccctggccgagaagggcggcgtggtgggcatcaccatcgactggcactgcgacctggactggcacgtgagacactgcagacccatctacgagttccacggcctgtacgaggagaagaacctgagccccggcttcaacttcagattcgccagacacttcgtggagaacggcaccaactacagacacctgttcaaggtgttcggcatcagattcgacatcctggtggacggcaaggccggcaagttcgacatcatccccaccatgaccaccatcggcagcggcatcggcatcttcggcgtggccaccgtgctgtgcgacctgctgctgctgcacatcctgcccaagagacactactacaagcagaagaagttcaagtacgccgaggacatgggccccggcgccgccgagagagacctggccgccaccagcagcaccctgggcctgcaggagaacatgagaaccagctag

SEQ ID NO: 86077 - DNA, 1371 bp, Artificial Sequence
  Description of Artificial Sequence: Synthetic coding sequence
atgaccagcagctacagcagcagcagctgccccctgggctgcaccatggcccccggcgccagaaacgtgagcgtgagccccatcgacatcggctgccagcccggcgccgaggccaacatcgcccccatgtgcctgctggccaacgtggcccacgccaacagagtgagagtgggcagcacccccctgggcagacccagcctgtgcctgccccccacctgccacaccgcctgccccctgcccggcacctgccacatccccggcaacatcggcatctgcggcgcctacggcgagaacaccctgaacggccacgagaaggagaccatgcagttcctgaacgacagactggccaactacctggagaaggtgagacagctggagcaggagaacgccgagctggaggccaccctgctggagagaagcaagtgccacgagagcaccgtgtgccccgactaccagagctacttccacaccatcgaggagctgcagcagaagatcctgtgcagcaaggccgagaacgccagactgatcgtgcagatcgacaacgccaagctggccgccgacgacttcagaatcaagctggagagcgagagaagcctgagacagctggtggaggccgacaagtgcggcacccagaagctgctggacgacgccaccctggccaaggccgacctggaggcccagcaggagagcctgaaggaggagcagctgagcctgaagagcaaccacgagcaggaggtgaagatcctgagaagccagctgggcgagaagctgagaatcgagctggacatcgagcccaccatcgacctgaacagagtgctgggcgagatgagagcccagtacgaggccatgctggagaccaacagacaggacgtggagcagtggttccaggcccagagcgagggcatcagcctgcaggacatgagctgcagcgaggagctgcagtgctgccagagcgagatcctggagctgagatgcaccgtgaacgccctggaggtggagagacaggcccagcacaccctgaaggactgcctgcagaacagcctgtgcgaggccgaggacagattcggcaccgagctggcccagatgcagagcctgatcagcaacgtggaggagcagctgagcgagatcagagccgacctggagagacagaaccaggagtaccaggtgctgctggacgtgaagaccagactggagaacgagatcgccacctacagaaacctgctggagagcgaggactgcaagctgccctgcaacccctgcagcaccagccccagctgcgtgaccgccccctgcgcccccagacccagctgcggcccctgcaccacctgcggccccacctgcggcgccagcaccaccggcagcagattctag

SEQ ID NO: 86078 - DNA, 1785 bp, Artificial Sequence
  Description of Artificial Sequence: Synthetic coding sequence
atgaccagcgtgggcgtgttcagcgacatgctgaacggctgcggcaaggacggcctggtgcccagagccaagcccagagacgtgagcgacttcagcctgtacgcccccgccaccaagccctgctgcagcagaacctacaagagaagaagactgagagcccccgccctgaccggcctgggccccgtgaccagcctgatcgcccccagcagcctgagcgccgccatgatcgccagacagcagtgcgtgagaggcggccccagaggcttcagctgcggcagcgccatcgtgggcggcggcaagagaggcgccttcagcagcgtgagcatgagcggcggcgccggcagatgcagcagcggcggcttcggcagcagaagcctgtacaacctgagaggcaacaagagcatcagcatgagcgtggccggcagcagacagggcgcctgcttcggcggcgccggcggcttcggcaccggcggcttcggcggcggcttcggcggcagcttcagcggcaagggcggccccggcttccccgtgtgccccgccggcggcatccaggaggtgaccatcaaccagagcctgctgacccccctgcacgtggagatcgaccccgagatccagaaggtgagaaccgaggagagagagcagatcaagctgctgaacaacaagttcgccagcttcatcgacaaggtgcagttcctggagcagcagaacaaggtgctggagaccaagtggaacctgctgcagcagcagaccaccaccaccagcagcaagaacctggagcccctgttcgagacctacctgagcgtgctgagaaagcagctggacaccctgggcaacgacaagggcagactgcagagcgagctgaagaccatgcaggacagcgtggaggacttcaagaccaagtacgaggaggagatcaacaagagaaccgccgccgagaacgacttcgtggtgctgaagaaggacgtggacgccgcctacctgaacaaggtggagctggaggccaaggtggacagcctgaacgacgagatcaacttcctgaaggtgctgtacgacgccgagctgagccagatgcagacccacgtgagcgacaccagcgtggtgctgagcatggacaacaacagaaacctggacctggacagcatcatcgccgaggtgagagcccagtacgaggagatcgcccagagaagcaaggccgaggccgaggccctgtaccagaccaaggtgcagcagctgcagatcagcgtggaccagcacggcgacaacctgaagaacaccaagagcgagatcgccgagctgaacagaatgatccagagactgagagccgagatcgagaacatcaagaagcagtgccagaccctgcaggtgagcgtggccgacgccgagcagagaggcgagaacgccctgaaggacgcccacagcaagagagtggagctggaggccgccctgcagcaggccaaggaggagctggccagaatgctgagagagtaccaggagctgatgagcgtgaagctggccctggacatcgagatcgccacctacagaaagctgctggagggcgaggagtacagaatgagcggcgagtgccagagcgccgtgagcatcagcgtggtgagcggcagcaccagcaccggcggcatcagcggcggcctgggcagcggcagcggcttcggcctgagcagcggcttcggcagcggcagcggcagcggcttcggcttcggcggcagcgtgagcggcagcagcagcagcaagatcatcagcaccaccaccctgaacaagagaagatag

SEQ ID NO: 86079 - DNA, 1503 bp, Artificial Sequence
  Description of Artificial Sequence: Synthetic coding sequence
atgatcgccagacagcagtgcgtgagaggcggccccagaggcttcagctgcggcagcgccatcgtgggcggcggcaagagaggcgccttcagcagcgtgagcatgagcggcggcgccggcagatgcagcagcggcggcttcggcagcaagggcgcctgcttcggcggcgccggcggcttcggcaccggcggcttcggcggcggcttcggcggcagcttcagcggcaagggcggccccggcttccccgtgtgccccgccggcggcatccaggaggtgaccatcaaccagagcctgctgacccccctgcacgtggagatcgaccccgagatccagaaggtgagaaccgaggagagagagcagatcaagctgctgaacaacaagttcgccagcttcatcgacaaggtgcagttcctggagcagcagaacaaggtgctggagaccaagtggaacctgctgcagcagcagaccaccaccaccagcagcaagaacctggagcccctgttcgagacctacctgagcgtgctgagaaagcagctggacaccctgggcaacgacaagggcagactgcagagcgagctgaagaccatgcaggacagcgtggaggacttcaagaccaagtacgaggaggagatcaacaagagaaccgccgccgagaacgacttcgtggtgctgaagaaggacgtggacgccgcctacctgaacaaggtggagctggaggccaaggtggacagcctgaacgacgagatcaacttcctgaaggtgctgtacgacgccgagctgagccagatgcagacccacgtgagcgacaccagcgtggtgctgagcatggacaacaacagaaacctggacctggacagcatcatcgccgaggtgagagcccagtacgaggagatcgcccagagaagcaaggccgaggccgaggccctgtaccagaccaaggtgcagcagctgcagatcagcgtggaccagcacggcgacaacctgaagaacaccaagagcgagatcgccgagctgaacagaatgatccagagactgagagccgagatcgagaacatcaagaagcagtgccagaccctgcaggtgagcgtggccgacgccgagcagagaggcgagaacgccctgaaggacgcccacagcaagagagtggagctggaggccgccctgcagcaggccaaggaggagctggccagaatgctgagagagtaccaggagctgatgagcgtgaagctggccctggacatcgagatcgccacctacagaaagctgctggagggcgaggagtacagaatgagcggcgagtgccagagcgccgtgagcatcagcgtggtgagcggcagcaccagcaccggcggcatcagcggcggcctgggcagcggcagcggcttcggcctgagcagcggcttcggcagcggcagcggcagcggcttcggcttcggcggcagcgtgagcggcagcagcagcagcaagatcatcagcaccaccaccctgaacaagagaagatag

SEQ ID NO: 86080 - DNA, 1563 bp, Artificial Sequence
  Description of Artificial Sequence: Synthetic coding sequence
atgatcgccagacagcagtgcgtgagaggcggccccagaggcttcagctgcggcagcgccatcgtgggcggcggcaagagaggcgccttcagcagcgtgagcatgagcggcggcgccggcagatgcagcagcggcggcttcggcagcagaagcctgtacaacctgagaggcaacaagagcatcagcatgagcgtggccggcagcagacagggcgcctgcttcggcggcgccggcggcttcggcaccggcggcttcggcggcggcttcggcggcagcttcagcggcaagggcggccccggcttccccgtgtgccccgccggcggcatccaggaggtgaccatcaaccagagcctgctgacccccctgcacgtggagatcgaccccgagatccagaaggtgagaaccgaggagagagagcagatcaagctgctgaacaacaagttcgccagcttcatcgacaaggtgcagttcctggagcagcagaacaaggtgctggagaccaagtggaacctgctgcagcagcagaccaccaccaccagcagcaagaacctggagcccctgttcgagacctacctgagcgtgctgagaaagcagctggacaccctgggcaacgacaagggcagactgcagagcgagctgaagaccatgcaggacagcgtggaggacttcaagaccaagtacgaggaggagatcaacaagagaaccgccgccgagaacgacttcgtggtgctgaagaaggacgtggacgccgcctacctgaacaaggtggagctggaggccaaggtggacagcctgaacgacgagatcaacttcctgaaggtgctgtacgacgccgagctgagccagatgcagacccacgtgagcgacaccagcgtggtgctgagcatggacaacaacagaaacctggacctggacagcatcatcgccgaggtgagagcccagtacgaggagatcgcccagagaagcaaggccgaggccgaggccctgtaccagaccaaggtgcagcagctgcagatcagcgtggaccagcacggcgacaacctgaagaacaccaagagcgagatcgccgagctgaacagaatgatccagagactgagagccgagatcgagaacatcaagaagcagtgccagaccctgcaggtgagcgtggccgacgccgagcagagaggcgagaacgccctgaaggacgcccacagcaagagagtggagctggaggccgccctgcagcaggccaaggaggagctggccagaatgctgagagagtaccaggagctgatgagcgtgaagctggccctggacatcgagatcgccacctacagaaagctgctggagggcgaggagtacagaatgagcggcgagtgccagagcgccgtgagcatcagcgtggtgagcggcagcaccagcaccggcggcatcagcggcggcctgggcagcggcagcggcttcggcctgagcagcggcttcggcagcggcagcggcagcggcttcggcttcggcggcagcgtgagcggcagcagcagcagcaagatcatcagcaccaccaccctgaacaagagaagatag

SEQ ID NO: 86081 - DNA, 1695 bp, Artificial Sequence
  Description of Artificial Sequence: Synthetic coding sequence
atggccagcaccagcaccaccatcagaagccacagcagcagcagaagaggcttcagcgccaacagcgccagactgcccggcgtgagcagaagcggcttcagcagcgtgagcgtgagcagaagcagaggcagcggcggcctgggcggcgcctgcggcggcgccggcttcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccaccatccagagagtgagagccgaggagagagagcagatcaagaccctgaacaacaagttcgccagcttcatcgacaaggtgagattcctggagcagcagaacaaggtgctggagaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaggcatgcaggacctggtggaggacttcaagaacaagtacgaggacgagatcaacaagagaaccgccgccgagaacgagttcgtgaccctgaagaaggacgtggacgccgcctacatgaacaaggtggagctgcaggccaaggccgacaccctgaccgacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcaggtgaccgccggcagacacggcgacgacctgagaaacaccaagcaggagatcgccgagatcaacagaatgatccagagactgagaagcgagatcgaccacgtgaagaagcagtgcgccaacctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacatcagcgtggtgcagagcaccgtgagcagcggctacggcggcgccagcggcgtgggcagcggcctgggcctgggcggcggcagcagctacagctacggcagcggcctgggcgtgggcggcggcttcagcagcagcagcggcagagccatcggcggcggcctgagcagcgtgggcggcggcagcagcaccatcaagtacaccaccaccagcagcagcagcagaaagagctacaagcactag

SEQ ID NO: 86082 - DNA, 1563 bp, Artificial Sequence
  Description of Artificial Sequence: Synthetic coding sequence
atggccagcaccagcaccaccatcagaagccacagcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccaccatccagagagtgagagccgaggagagagagcagatcaagaccctgaacaacaagttcgccagcttcatcgacaaggtgagattcctggagcagcagaacaaggtgctggagaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaggcatgcaggacctggtggaggacttcaagaacaagtacgaggacgagatcaacaagagaaccgccgccgagaacgagttcgtgaccctgaagaaggacgtggacgccgcctacatgaacaaggtggagctgcaggccaaggccgacaccctgaccgacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcaggtgaccgccggcagacacggcgacgacctgagaaacaccaagcaggagatcgccgagatcaacagaatgatccagagactgagaagcgagatcgaccacgtgaagaagcagtgcgccaacctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacatcagcgtggtgcagagcaccgtgagcagcggctacggcggcgccagcggcgtgggcagcggcctgggcctgggcggcggcagcagctacagctacggcagcggcctgggcgtgggcggcggcttcagcagcagcagcggcagagccatcggcggcggcctgagcagcgtgggcggcggcagcagcaccatcaagtacaccaccaccagcagcagcagcagaaagagctacaagcactag

SEQ ID NO: 86083 - DNA, 1695 bp, Artificial Sequence
  Description of Artificial Sequence: Synthetic coding sequence
atggccagcaccagcaccaccatcagaagccacagcagcagcagaagaggcttcagcgccaacagcgccagactgcccggcgtgagcagaagcggcttcagcagcatcagcgtgagcagaagcagaggcagcggcggcctgggcggcgcctgcggcggcgccggcttcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccgccatccagagagtgagagccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacaacatcgtgggcgagagaggcagactggacagcgagctgagaaacatgcaggacctggtggaggacctgaagaacaagtacgaggacgagatcaacaagagaaccgccgccgagaacgagttcgtgaccctgaagaaggacgtggacgccgcctacatgaacaaggtggagctgcaggccaaggccgacaccctgaccgacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcagatcaccgccggcagacacggcgacgacctgagaaacaccaagcaggagatcgccgagatcaacagaatgatccagagactgagaagcgagatcgaccacgtgaagaagcagtgcgccaacctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacatcagcgtggtgcagagcaccgtgagcagcggctacggcggcgccagcggcgtgggcagcggcctgggcctgggcggcggcagcagctacagctacggcagcggcctgggcgtgggcggcggcttcagcagcagcagcggcagagccaccggcggcggcctgagcagcgtgggcggcggcagcagcaccatcaagtacaccaccaccagcagcagcagcagaaagagctacaagcactag

SEQ ID NO: 86084 - DNA, 1575 bp, Artificial Sequence
  Description of Artificial Sequence: Synthetic coding sequence
atggccagcaccagcaccaccatcagaagccacagcagcagcagaagaggcttcagcgccaacagcgccagactgcccggcgtgagcagaagcggcttcagcagcatcagcgtgagcagaagcagaggcagcggcggcctgggcggcgcctgcggcggcgccggcttcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccgccatccagagagtgagagccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacaacatcgtgggcgagagaggcagactggacagcgagctgagaaacatgcaggacctggtggaggacctgaagaacaaggacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcagatcaccgccggcagacacggcgacgacctgagaaacaccaagcaggagatcgccgagatcaacagaatgatccagagactgagaagcgagatcgaccacgtgaagaagcagtgcgccaacctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacatcagcgtggtgcagagcaccgtgagcagcggctacggcggcgccagcggcgtgggcagcggcctgggcctgggcggcggcagcagctacagctacggcagcggcctgggcgtgggcggcggcttcagcagcagcagcggcagagccaccggcggcggcctgagcagcgtgggcggcggcagcagcaccatcaagtacaccaccaccagcagcagcagcagaaagagctacaagcactag

SEQ ID NO: 86085 - DNA, 1695 bp, Artificial Sequence
  Description of Artificial Sequence: Synthetic coding sequence
atggccagcaccagcaccaccatcagaagccacagcagcagcagaagaggcttcagcgccaacagcgccagactgcccggcgtgagcagaagcggcttcagcagcatcagcgtgagcagaagcagaggcagcggcggcctgggcggcgcctgcggcggcgccggcttcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccgccatccagagagtgagagccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaaacatgcaggacctggtggaggacctgaagaacaagtacgaggacgagatcaacaagagaaccgccgccgagaacgagttcgtgaccctgaagaaggacgtggacgccgcctacatgaacaaggtggagctgcaggccaaggccgacaccctgaccgacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcaggtgaccgccggcagacacggcgacgacctgagaaacaccaagcaggagatcgccgagatcaacagaatgatccagagactgagaagcgagatcgaccacgtgaagaagcagtgcgccagcctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacgtgagcgtggtgcagagcaccatcagcagcggctacggcggcgccagcggcgtgggcagcggcctgggcctgggcggcggcagcagctacagctacggcagcggcctgggcatcggcggcggcttcagcagcagcagcggcagagccatcggcggcggcctgagcagcgtgggcggcggcagcagcaccatcaagtacaccaccaccagcagcagcagcagaaagagctacaagcactag

SEQ ID NO: 86086 - DNA, 1650 bp, Artificial Sequence
  Description of Artificial Sequence: Synthetic coding sequence
atggccagcaccagcaccaccatcagaagccacagcagcagcagaagcggcttcagcagcatcagcgtgagcagaagcagaggcagcggcggcctgggcggcgcctgcggcggcgccggcttcggcagcagaagcctgtacggcctgggcggcagcaagagaatcagcatcggcggcggcagctgcgccatcagcggcggctacggcagcagagccggcggcagctacggcttcggcggcgccggcagcggcttcggcttcggcggcggcgccggcatcggcttcggcctgggcggcggcgccggcctggccggcggcttcggcggccccggcttccccgtgtgcccccccggcggcatccaggaggtgaccgtgaaccagagcctgctgacccccctgaacctgcagatcgaccccgccatccagagagtgagagccgaggagagagagcagatcaagaccctgaacaacaagttcgccagcttcatcgacaaggtgagattcctggagcagcagaacaaggtgctggacaccaagtggaccctgctgcaggagcagggcaccaagaccgtgagacagaacctggagcccctgttcgagcagtacatcaacaacctgagaagacagctggacagcatcgtgggcgagagaggcagactggacagcgagctgagaaacatgcaggacctggtggaggacctgaagaacaagtacgaggacgagatcaacaagagaaccgccgccgagaacgagttcgtgaccctgaagaaggacgtggacgccgcctacatgaacaaggtggagctgcaggccaaggccgacaccctgaccgacgagatcaacttcctgagagccctgtacgacgccgagctgagccagatgcagacccacatcagcgacaccagcgtggtgctgagcatggacaacaacagaaacctggacctggacagcatcatcgccgaggtgaaggcccagtacgaggagatcgcccagagaagcagagccgaggccgagagctggtaccagaccaagtacgaggagctgcaggtgaccgccggcagacacggcgacgacctgagaaacaccaagcaggagatcgccgagatcaacagaatgatccagagactgagaagcgagatcgaccacgtgaagaagcagtgcgccagcctgcaggccgccatcgccgacgccgagcagagaggcgagatggccctgaaggacgccaagaacaagctggagggcctggaggacgccctgcagaaggccaagcaggacctggccagactgctgaaggagtaccaggagctgatgaacgtgaagctggccctggacgtggagatcgccacctacagaaagctgctggagggcgaggagtgcagactgaacggcgagggcgtgggccaggtgaacgtgagcgtggtgcagagcaccatcagcagcggctacggcggcgccagcggcgtgggcagcggcctgggcctgggcggcggcagcagctacagctacggcagcggcctgggcatcggcggcggcttcagcagcagcagcggcagagccatcggcggcggcctgagcagcgtgggcggcggcagcagcaccatcaagtacaccaccaccagcagcagcagcagaaagagctacaagcactag

SEQ ID NO: 86087 - DNA, 1572 bp, Artificial Sequence
  Description of Artificial Sequence: Synthetic coding sequence
atgagcagacagttcacctgcaagagcggcgccgccgccaagggcggcttcagcggctgcagcgccgtgctgagcggcggcagcagcagcagcttcagagccggcagcaagggcctgagcggcggcttcggcagcagaagcctgtacagcctgggcggcgtgagaagcctgaacgtggccagcggcagcggcaagagcggcggctacggcttcggcagaggcagagccagcggcttcgccggcagcatgttcggcagcgtggccctgggccccgtgtgccccaccgtgtgcccccccggcggcatccaccaggtgaccgtgaacgagagcctgctggcccccctgaacgtggagctggaccccgagatccagaaggtgagagcccaggagagagagcagatcaaggccctgaacaacaagttcgccagcttcatcgacaaggtgagattcctggagcagcagaaccaggtgctggagaccaagtgggagctgctgcagcagctggacctgaacaactgcaagaacaacctggagcccatcctggagggctacatcagcaacctgagaaagcagctggagaccctgagcggcgacagagtgagactggacagcgagctgagaaacgtgagagacgtggtggaggactacaagaagagatacgaggaggagatcaacaagagaaccgccgccgagaacgagttcgtgctgctgaagaaggacgtggacgccgcctacgccaacaaggtggagctgcaggccaaggtggagagcatggaccaggagatcaagttcttcagatgcctgttcgaggccgagatcacccagatccagagccacatcagcgacatgagcgtgatcctgagcatggacaacaacagaaacctggacctggacagcatcatcgacgaggtgagaacccagtacgaggagatcgccctgaagagcaaggccgaggccgaggccctgtaccagaccaagttccaggagctgcagctggccgccggcagacacggcgacgacctgaagaacaccaagaacgagatcagcgagctgaccagactgatccagagaatcagaagcgagatcgagaacgtgaagaagcaggccagcaacctggagaccgccatcgccgacgccgagcagagaggcgacaacgccctgaaggacgccagagccaagctggacgagctggagggcgccctgcaccaggccaaggaggagctggccagaatgctgagagagtaccaggagctgatgagcctgaagctggccctggacatggagatcgccacctacagaaagctgctggagagcgaggagtgcagaatgagcggcgagttccccagccccgtgagcatcagcatcatcagcagcaccagcggcggcagcgtgtacggcttcagacccagcatggtgagcggcggctacgtggccaacagcagcaactgcatcagcggcgtgtgcagcgtgagaggcggcgagggcagaagcagaggcagcgccaacgactacaaggacaccctgggcaagggcagcagcctgagcgcccccagcaagaagaccagcagatag

SEQ ID NO: 86088 - DNA, 1536 bp, Artificial Sequence
  Description of Artificial Sequence: Synthetic coding sequence
atgagcagacagctgacccacttccccagaggcgagagactgggcttcagcggctgcagcgccgtgctgagcggcggcatcggcagcagcagcgccagcttcagagccagagtgaagggcagcgccagcttcggcagcaagagcctgagctgcctgggcggcagcagaagcctggccctgagcgccgccgccagaagaggcggcggcagactgggcggcttcgtgggcaccgccttcggcagcgccggcctgggccccaagtgccccagcgtgtgcccccccggcggcatcccccaggtgaccgtgaacaagagcctgctggcccccctgaacgtggagatggaccccgagatccagagagtgagagcccaggagagagagcagatcaaggccctgaacaacaagttcgccagcttcatcgacaaggtgagattcctggagcagcagaaccaggtgctggagaccaagtggaacctgctgcagcagctggacctgaacaactgcagaaagaacctggagcccatctacgagggctacatcagcaacctgcagaagcagctggagatgctgagcggcgacggcgtgagactggacagcgagctgagaaacatgcaggacctggtggaggactacaagaagagatacgaggtggagatcaacagaagaaccgccgccgagaacgagttcgtggtgctgaagaaggacgtggacgccgcctacatgaacaaggtggagctgcaggccaaggtggacagcctgaccgacgagatcaagttcttcaagtgcctgtacgagggcgagatcacccagatccagagccacatcagcgacaccagcatcgtgctgagcatggacaacaacagagacctggacctggacagcatcatcgccgaggtgagagcccagtacgaggagatcgccctgaagagcaaggccgaggccgagaccctgtaccagaccaagatccaggagctgcaggtgaccgccggccagcacggcgacgacctgaagctgaccaaggccgagatcagcgagctgaacagactgatccagagaatcagaagcgagatcggcaacgtgaagaagcagtgcgccgacctggagaccgccatcgccgacgccgagcagagaggcgactgcgccctgaaggacgccagagccaagctggacgagctggagggcgccctgcaccaggccaaggaggagctggccagaatgctgagagagtaccaggagctggtgagcctgaagctggccctggacatggagatcgccacctacagaaagctgctggagagcgaggagtgcagaatgagcggcgagtaccccaacagcgtgagcatcagcgtgatcagcagcaccaacgccggcgccggcggcgccggcttcagcatgggcttcggcgccagcagcagctacagctacaagaccgccgccgccgacgtgaagaccaagggcagctgcggcagcgagctgaaggaccccctggccaagaccagcggcagcagctgcgccaccaagaaggccagcagatag

SEQ ID NO: 86089 - DNA, 1410 bp, Artificial Sequence
  Description of Artificial Sequence: Synthetic coding sequence
atgagcagacagctgacccacttccccagaggcgagagactgggcttcagcggctgcagcgccgtgctgagcggcggcatcggcagcagcagcgccagcttcagagccagagtgaagggcagcgccagcttcggcagcaagagcctgagctgcctgggcggcagcagaagcctggccctgagcgccgccgccagaagaggcggcggcagactgggcggcttcgtgggcaccgccttcggcagcgccggcctgggccccaagtgccccagcgtgtgcccccccggcggcatcccccaggtgaccgtgaacaagagcctgctggcccccctgaacgtggagatggaccccgagatccagagagtgagagcccaggagagagagcagatcaaggccctgaacaacaagttcgccagcttcatcgacaaggtgagattcctggagcagcagaaccaggtgctggagaccaagtggaacctgctgcagcagctggacctgaacaactgcagaaagaacctggagcccatctacgagggctacatcagcaacctgcagaagcagctggagatgctgagcggcgacggcgtgagactggacagcgagctgagaaacatgcaggacctggtggaggactacaagaagagatacgaggtggagatcaacagaagaaccgccgccgagaacgagttcgtggtgctgaagaaggacgtggacgccgcctacatgaacaaggtggagctgcaggccaaggtggacagcctgaccgacgagatcaagttcttcaagtgcctgtacgagggcgagatcacccagatccagagccacatcagcgacaccagcatcgtgctgagcatggacaacaacagagacctggacctggacagcatcatcgccgaggtgagagcccagtacgaggagatcgccctgaagagcaaggccgaggccgagaccctgtaccagaccaagtgcgccgacctggagaccgccatcgccgacgccgagcagagaggcgactgcgccctgaaggacgccagagccaagctggacgagctggagggcgccctgcaccaggccaaggaggagctggccagaatgctgagagagtaccaggagctggtgagcctgaagctggccctggacatggagatcgccacctacagaaagctgctggagagcgaggagtgcagaatgagcggcgagtaccccaacagcgtgagcatcagcgtgatcagcagcaccaacgccggcgccggcggcgccggcttcagcatgggcttcggcgccagcagcagctacagctacaagaccgccgccgccgacgtgaagaccaagggcagctgcggcagcgagctgaaggaccccctggccaagaccagcggcagcagctgcgccaccaagaaggccagcagatag

SEQ ID NO: 86090 - DNA, 972 bp, Artificial Sequence
  Description of Artificial Sequence: Synthetic coding sequence
atgctgagcggcgacggcgtgagactggacagcgagctgagaaacatgcaggacctggtggaggactacaagaagagatacgaggtggagatcaacagaagaaccgccgccgagaacgagttcgtggtgctgaagaaggacgtggacgccgcctacatgaacaaggtggagctgcaggccaaggtggacagcctgaccgacgagatcaagttcttcaagtgcctgtacgagggcgagatcacccagatccagagccacatcagcgacaccagcatcgtgctgagcatggacaacaacagagacctggacctggacagcatcatcgccgaggtgagagcccagtacgaggagatcgccctgaagagcaaggccgaggccgagaccctgtaccagaccaagatccaggagctgcaggtgaccgccggccagcacggcgacgacctgaagctgaccaaggccgagatcagcgagctgaacagactgatccagagaatcagaagcgagatcggcaacgtgaagaagcagtgcgccgacctggagaccgccatcgccgacgccgagcagagaggcgactgcgccctgaaggacgccagagccaagctggacgagctggagggcgccctgcaccaggccaaggaggagctggccagaatgctgagagagtaccaggagctggtgagcctgaagctggccctggacatggagatcgccacctacagaaagctgctggagagcgaggagtgcagaatgagcggcgagtaccccaacagcgtgagcatcagcgtgatcagcagcaccaacgccggcgccggcggcgccggcttcagcatgggcttcggcgccagcagcagctacagctacaagaccgccgccgccgacgtgaagaccaagggcagctgcggcagcgagctgaaggaccccctggccaagaccagcggcagcagctgcgccaccaagaaggccagcagatag

SEQ ID NO: 86091 - DNA, 1536 bp, Artificial Sequence; identical to SEQ ID NO: 86088
  Description of Artificial Sequence: Synthetic coding sequence

SEQ ID NO: 86092 - DNA, 1623 bp, Artificial Sequence
  Description of Artificial Sequence: Synthetic coding sequence
atgagcagacagttcacctacaagagcggcgccgccgccaagggcggcttcagcggctgcagcgccgtgctgagcggcggcagcagcagcagctacagagccggcggcaagggcctgagcggcggcttcagcagcagaagcctgtacagcctgggcggcgccagaagcatcagcttcaacgtggccagcggcagcggctgggccggcggctacggcttcggcagaggcagagccagcggcttcgccggcagcatgttcggcagcgtggccctgggcagcgtgtgccccagcctgtgcccccccggcggcatccaccaggtgaccatcaacaagagcctgctggcccccctgaacgtggagctggaccccgagatccagaaggtgagagcccaggagagagagcagatcaaggtgctgaacaacaagttcgccagcttcatcgacaaggtgagattcctggagcagcagaaccaggtgctggagaccaagtgggagctgctgcagcagctggacctgaacaactgcaagaacaacctggagcccatcctggagggctacatcagcaacctgagaaagcagctggagaccctgagcggcgacagagtgagactggacagcgagctgagaagcgtgagagaggtggtggaggactacaagaagagatacgaggaggagatcaacaagagaaccaccgccgagaacgagttcgtggtgctgaagaaggacgtggacgccgcctacaccagcaaggtggagctgcaggccaaggtggacgccctggacggcgagatcaagttcttcaagtgcctgtacgagggcgagaccgcccagatccagagccacatcagcgacaccagcatcatcctgagcatggacaacaacagaaacctggacctggacagcatcatcgccgaggtgagagcccagtacgaggagatcgccagaaagagcaaggccgaggccgaggccctgtaccagaccaagttccaggagctgcagctggccgccggcagacacggcgacgacctgaagcacaccaagaacgagatcagcgagctgaccagactgatccagagactgagaagcgagatcgagagcgtgaagaagcagtgcgccaacctggagaccgccatcgccgacgccgagcagagaggcgactgcgccctgaaggacgccagagccaagctggacgagctggagggcgccctgcagcaggccaaggaggagctggccagaatgctgagagagtaccaggagctgctgagcgtgaagctgagcctggacatcgagatcgccacctacagaaagctgctggagggcgaggagtgcagaatgagcggcgagtacaccaacagcgtgagcatcagcgtgatcaacagcagcatggccggcatggccggcaccggcgccggcttcggcttcagcaacgccggcacctacggctactggcccagcagcgtgagcggcggctacagcatgctgcccggcggctgcgtgaccggcagcggcaactgcagccccagaggcgaggccagaaccagactgggcagcgccagcgagttcagagacagccagggcaagaccctggccctgagcagccccaccaagaagaccatgagatag

SEQ ID NO: 86093 - DNA, 1590 bp, Artificial Sequence
  Description of Artificial Sequence: Synthetic coding sequence
atgagcagacagctgaacatcaagagcagcggcgacaagggcaacttcagcgtgcacagcgccgtggtgcccagaaaggccgtgggcagcctggccagctactgcgccgccggcagaggcgccggcgccggcttcggcagcagaagcctgtacagcctgggcggcaacagaagaatcagcttcaacgtggccggcggcggcgtgagagccggcggctacggcttcagacccggcagcggctacggcggcggcagagccagcggcttcgccggcagcatgttcggcagcgtggccctgggccccgcctgcctgagcgtgtgcccccccggcggcatccaccaggtgaccgtgaacaagagcctgctggcccccctgaacgtggagctggaccccgagatccagaaggtgagagcccaggagagagagcagatcaaggtgctgaacgacaagttcgccagcttcatcgacaaggtgagattcctggagcagcagaaccaggtgctggagaccaagtgggagctgctgcagcagctggacctgaacaactgcaagaagaacctggagcccatcctggagggctacatcagcaacctgagaaagcagctggagaccctgagcggcgacagagtgagactggacagcgagctgagaagcatgagagacctggtggaggactacaagaagagatacgaggtggagatcaacagaagaaccaccgccgagaacgagttcgtggtgctgaagaaggacgccgacgccgcctacgccgtgaaggtggagctgcaggccaaggtggacagcctggacaaggagatcaagttcctgaagtgcctgtacgacgccgagatcgcccagatccagacccacgccagcgagaccagcgtgatcctgagcatggacaacaacagagacctggacctggacagcatcatcgccgaggtgagaatgcactacgaggagatcgccctgaagagcaaggccgaggccgaggccctgtaccagaccaagatccaggagctgcagctggccgccagcagacacggcgacgacctgaagcacaccagaagcgagatggtggagctgaacagactgatccagagaatcagatgcgagatcggcaacgtgaagaagcagagagccagcctggagaccgccatcgccgacgccgagcagagaggcgacaacgccctgaaggacgcccaggccaagctggacgagctggagggcgccctgcaccaggccaaggaggagctggccagaatgctgagagagtaccaggagctgatgagcctgaagctggccctggacatggagatcgccacctacagaaagctgctggagggcgaggagtgcagaatgagcggcgagaaccccagcagcgtgagcatcagcgtgatcagcagcagcagctacagctaccaccaccccagcagcgccggcgtggacctgggcgccagcgccgtggccggcagcagcggcagcacccagagcggccagaccaagaccaccgaggccagaggcggcgacctgaaggacacccagggcaagagcacccccgccagcatccccgccagaaaggccaccagatag

SEQ ID NO: 86094 - DNA, 1656 bp, Artificial Sequence
  Description of Artificial Sequence: Synthetic coding sequence
atgagcagacagagcagcatcaccttccagagcggcagcagaagaggcttcagcaccaccagcgccatcacccccgccgccggcagaagcagattcagcagcgtgagcgtggccagaagcgccgccggcagcggcggcctgggcagaatcagcagcgccggcgccagcttcggcagcagaagcctgtacaacctgggcggcgccaagagagtgagcatcaacggctgcggcagcagctgcagaagcggcttcggcggcagagccagcaacagattcggcgtgaacagcggcttcggctacggcggcggcgtgggcggcggcttcagcggccccagcttccccgtgtgcccccccggcggcatccaggaggtgaccgtgaaccagagcctgctgacccccctgcacctgcagatcgaccccaccatccagagagtgagagccgaggagagagagcagatcaagaccctgaacaacaagttcgccagcttcatcgacaaggtgagattcctggagcagcagaacaaggtgctggagaccaagtgggccctgctgcaggagcagggcagcagaaccgtgagacagaacctggagcccctgttcgacagctacaccagcgagctgagaagacagctggagagcatcaccaccgagagaggcagactggaggccgagctgagaaacatgcaggacgtggtggaggacttcaaggtgagatacgaggacgagatcaacaagagaaccgccgccgagaacgagttcgtggccctgaagaaggacgtggacgccgcctacatgaacaaggtggagctggaggccaaggtgaagagcctgcccgaggagatcaacttcatccacagcgtgttcgacgccgagctgagccagctgcagacccaggtgggcgacaccagcgtggtgctgagcatggacaacaacagaaacctggacctggacagcatcatcgccgaggtgaaggcccagtacgaggacatcgccaacagaagcagagccgaggccgagagctggtaccagaccaagtacgaggagctgcaggtgaccgccggcagacacggcgacgacctgagaaacaccaagcaggagatcagcgagatgaacagaatgatccagagactgagagccgagatcgacagcgtgaagaagcagtgcagcagcctgcagaccgccatcgccgacgccgagcagagaggcgagctggccctgaaggacgccagagccaagctggtggacctggaggaggccctgcagaaggccaagcaggacatggccagactgctgagagagtaccaggagctgatgaacatcaagctggccctggacgtggagatcgccacctacagaaagctgctggagggcgaggagtgcagactgagcggcgagggcgtgagccccgtgaacatcagcgtggtgaccagcaccctgagcagcggctacggcagcggcagcagcatcggcggcggcaacctgggcctgggcggcggcagcggctacagcttcaccaccagcggcggccacagcctgggcgccggcctgggcggcagcggcttcagcgccaccagcaacagaggcctgggcggcagcggcagcagcgtgaagttcgtgagcaccaccagcagcagccagaagagctacacccactag

SEQ ID NO: 86095 - DNA, 1737 bp, Artificial Sequence
  Description of Artificial Sequence: Synthetic coding sequence
atgagccaccagttcagcagccagagcgccttcagcagcatgagcagaagagtgtacagcaccagcagcagcgccggcagcggcggcggcagccccgccgtgggcagcgtgtgctacgccagaggcagatgcggcggcggcggctacggcatccacggcagaggcttcggcagcagaagcctgtacaacctgggcggcagcagaagcatcagcatcaacctgatgggcagaagcaccagcggcttctgccagggcggcggcgtgggcggcttcggcggcggcagaggcttcggcgtgggcagcaccggcgccggcggcttcggcggcggcggcttcggcggcgccggcttcggcaccagcaacttcggcctgggcggcttcggcccctactgcccccccggcggcatccaggaggtgaccatcaaccagagcctgctggagcccctgcacctggaggtggaccccgagatccagagaatcaagacccaggagagagagcagatcatggtgctgaacaacaagttcgccagcttcatcgacaaggtgagattcctggagcagcagaaccaggtgctgcagaccaagtgggagctgctgcagcaggtgaacaccagcaccggcaccaacaacctggagcccctgctggagaactacatcggcgacctgagaagacaggtggacctgctgagcgccgagcagatgagacagaacgccgaggtgagaagcatgcaggacgtggtggaggactacaagagcaagtacgaggacgagatcaacaagagaaccggcagcgagaacgacttcgtggtgctgaagaaggacgtggacgccgcctacgtgagcaaggtggacctggagagcagagtggacaccctgaccggcgaggtgaacttcctgaagtacctgttcctgaccgagctgagccaggtgcagacccacatcagcgacaccaacgtgatcctgagcatggacaacaacagaagcctggacctggacagcatcatcgacgccgtgagaacccagtacgagctgatcgcccagagaagcaaggacgaggccgaggccctgtaccagaccaagtaccaggagctgcagatcaccgccggcagacacggcgacgacctgaagaacagcaagatggagatcgccgagctgaacagaaccgtgcagagactgcaggccgagatcagcaacgtgaagaagcagatcgagcagatgcagagcctgatcagcgacgccgaggagagaggcgagcaggccctgcaggacgcctggcagaagctgcaggacctggaggaggccctgcagcagagcaaggaggagctggccagactgctgagagactaccaggccatgctgggcgtgaagctgagcctggacgtggagatcgccacctacagacagctgctggagggcgaggagagcagaatgagcggcgagctgcagagccacgtgagcatcagcgtgcagaacagccaggtgagcgtgaacggcggcgccggcggcggcggcagctacggcagcggcggctacggcggcggcagcggcggcggctacggcggcggcagaagctacagaggcggcggcgccagaggcagaagcggcggcggctacggcagcggctgcggcggcggcggcggcagctacggcggcagcggcagaagcggcagaggcagcagcagagtgcagatcatccagaccagcaccaacaccagccacagaagaatcctggagtag

SEQ ID NO: 86096 - DNA, 1038 bp, Artificial Sequence
  Description of Artificial Sequence: Synthetic coding sequence
atgagacagaacgccgaggtgagaagcatgcaggacgtggtggaggactacaagagcaagtacgaggacgagatcaacaagagaaccggcagcgagaacgacttcgtggtgctgaagaaggacgtggacgccgcctacgtgagcaaggtggacctggagagcagagtggacaccctgaccggcgaggtgaacttcctgaagtacctgttcctgaccgagctgagccaggtgcagacccacatcagcgacaccaacgtgatcctgagcatggacaacaacagaagcctggacctggacagcatcatcgacgccgtgagaacccagtacgagctgatcgcccagagaagcaaggacgaggccgaggccctgtaccagaccaagtaccaggagctgcagatcaccgccggcagacacggcgacgacctgaagaacagcaagatggagatcgccgagctgaacagaaccgtgcagagactgcaggccgagatcagcaacgtgaagaagcagatcgagcagatgcagagcctgatcagcgacgccgaggagagaggcgagcaggccctgcaggacgcctggcagaagctgcaggacctggaggaggccctgcagcagagcaaggaggagctggccagactgctgagagactaccaggccatgctgggcgtgaagctgagcctggacgtggagatcgccacctacagacagctgctggagggcgaggagagcagaatgagcggcgagctgcagagccacgtgagcatcagcgtgcagaacagccaggtgagcgtgaacggcggcgccggcggcggcggcagctacggcagcggcggctacggcggcggcagcggcggcggctacggcggcggcagaagctacagaggcggcggcgccagaggcagaagcggcggcggctacggcagcggctgcggcggcggcggcggcagctacggcggcagcggcagaagcggcagaggcagcagcagagtgcagatcatccagaccagcaccaacaccagccacagaagaatcctggagtag

SEQ ID NO: 86097 - DNA, 1563 bp, Artificial Sequence
  Description of Artificial Sequence: Synthetic coding sequence
atgagcctgagcccctgcagagcccagagaggcttcagcgccagaagcgcctgcagcgccagaagcagaggcagaagcagaggcggcttcagcagcagaggcggcttcagcagcagaagcctgaacagcttcggcggctgcctggagggcagcagaggcagcacctggggcagcggcggcagactgggcgtgagattcggcgagtggagcggcggccccggcctgagcctgtgcccccccggcggcatccaggaggtgaccatcaaccagaacctgctgacccccctgaagatcgagatcgacccccagttccaggtggtgagaacccaggagacccaggagatcagaaccctgaacaaccagttcgccagcttcatcgacaaggtgagattcctggagcagcagaacaaggtgctggagaccaagtggcacctgctgcagcagcagggcctgagcggcagccagcagggcctggagcccgtgttcgaggcctgcctggaccagctgagaaagcagctggagcagctgcagggcgagagaggcgccctggacgccgagctgaaggcctgcagagaccaggaggaggagtacaagagcaagtacgaggaggaggcccacagaagagccaccctggagaacgacttcgtggtgctgaagaaggacgtggacggcgtgttcctgagcaagatggagctggagggcaagctggaggccctgagagagtacctgtacttcctgaagcacctgaacgaggaggagctgggccagctgcagacccaggccagcgacaccagcgtggtgctgagcatggacaacaacagatacctggacttcagcagcatcatcaccgaggtgagagccagatacgaggagatcgccagaagcagcaaggccgaggccgaggccctgtaccagaccaagtaccaggagctgcaggtgagcgcccagctgcacggcgacagaatgcaggagaccaaggtgcagatcagccagctgcaccaggagatccagagactgcagagccagaccgagaacctgaagaagcagaacgccagcctgcaggccgccatcaccgacgccgagcagagaggcgagctggccctgaaggacgcccaggccaaggtggacgagctggaggccgccctgagaatggccaagcagaacctggccagactgctgtgcgagtaccaggagctgaccagcaccaagctgagcctggacgtggagatcgccacctacagaagactgctggagggcgaggagtgcagaatgagcggcgagtgcaccagccaggtgaccatcagcagcgtgggcggcagcgccgtgatgagcggcggcgtgggcggcggcctgggcagcacctgcggcctgggcagcggcaagggcagccccggcagctgctgcaccagcatcgtgaccggcggcagcaacatcatcctgggcagcggcaaggaccccgtgctggacagctgcagcgtgagcggcagcagcgccggcagcagctgccacaccatcctgaagaagaccgtggagagcagcctgaagaccagcatcacctactag

SEQ ID NO: 86098 - DNA, 1233 bp, Artificial Sequence
  Description of Artificial Sequence: Synthetic coding sequence
atggagggccacgaggccagccccgcccaggtgggccagggcgacagaggcaaggtgagattcctggagcagcagaacaaggtgctggagaccaagtggcacctgctgcagcagcagggcctgagcggcagccagcagggcctggagcccgtgttcgaggcctgcctggaccagctgagaaagcagctggagcagctgcagggcgagagaggcgccctggacgccgagctgaaggcctgcagagaccaggaggaggagtacaagagcaagtacgaggaggaggcccacagaagagccaccctggagaacgacttcgtggtgctgaagaaggacgtggacggcgtgttcctgagcaagatggagctggagggcaagctggaggccctgagagagtacctgtacttcctgaagcacctgaacgaggaggagctgggccagctgcagacccaggccagcgacaccagcgtggtgctgagcatggacaacaacagatacctggacttcagcagcatcatcaccgaggtgagagccagatacgaggagatcgccagaagcagcaaggccgaggccgaggccctgtaccagaccaagtaccaggagctgcaggtgagcgcccagctgcacggcgacagaatgcaggagaccaaggtgcagatcagccagctgcaccaggagatccagagactgcagagccagaccgagaacctgaagaagcagaacgccagcctgcaggccgccatcaccgacgccgagcagagaggcgagctggccctgaaggacgcccaggccaaggtggacgagctggaggccgccctgagaatggccaagcagaacctggccagactgctgtgcgagtaccaggagctgaccagcaccaagctgagcctggacgtggagatcgccacctacagaagactgctggagggcgaggagtgcagaatgagcggcgagtgcaccagccaggtgaccatcagcagcgtgggcggcagcgccgtgatgagcggcggcgtgggcggcggcctgggcagcacctgcggcctgggcagcggcaagggcagccccggcagctgctgcaccagcatcgtgaccggcggcagcaacatcatcctgggcagcggcaaggaccccgtgctggacagctgcagcgtgagcggcagcagcgccggcagcagctgccacaccatcctgaagaagaccgtggagagcagcctgaagaccagcatcacctactag

SEQ ID NO: 86099 - DNA, 876 bp, Artificial Sequence
  Description of Artificial Sequence: Synthetic coding sequence
atggagctggagggcaagctggaggccctgagagagtacctgtacttcctgaagcacctgaacgaggaggagctgggccagctgcagacccaggccagcgacaccagcgtggtgctgagcatggacaacaacagatacctggacttcagcagcatcatcaccgaggtgagagccagatacgaggagatcgccagaagcagcaaggccgaggccgaggccctgtaccagaccaagtaccaggagctgcaggtgagcgcccagctgcacggcgacagaatgcaggagaccaaggtgcagatcagccagctgcaccaggagatccagagactgcagagccagaccgagaacctgaagaagcagaacgccagcctgcaggccgccatcaccgacgccgagcagagaggcgagctggccctgaaggacgcccaggccaaggtggacgagctggaggccgccctgagaatggccaagcagaacctggccagactgctgtgcgagtaccaggagctgaccagcaccaagctgagcctggacgtggagatcgccacctacagaagactgctggagggcgaggagtgcagaatgagcggcgagtgcaccagccaggtgaccatcagcagcgtgggcggcagcgccgtgatgagcggcggcgtgggcggcggcctgggcagcacctgcggcctgggcagcggcaagggcagccccggcagctgctgcaccagcatcgtgaccggcggcagcaacatcatcctgggcagcggcaaggaccccgtgctggacagctgcagcgtgagcggcagcagcgccggcagcagctgccacaccatcctgaagaagaccgtggagagcagcctgaagaccagcatcacctactag

SEQ ID NO: 86100 - DNA, 1608 bp, Artificial Sequence
  Description of Artificial Sequence: Synthetic coding sequence
atgagaagcagcgtgagcagacagacctacagcaccaagggcggcttcagcagcaacagcgccagcggcggcagcggcagccaggccagaaccagcttcagcagcgtgaccgtgagcagaagcagcggcagcggcggcggcgcccactgcggccccggcaccggcggcttcggcagcagaagcctgtacaacctgggcggccacaagagcatcagcgtgagcgtggccggcggcgccctgctgggcagagccctgggcggcttcggcttcggcagcagagccttcatgggccagggcgccggcagacagaccttcggccccgcctgcccccccggcggcatccaggaggtgaccgtgaaccagagcctgctgacccccctgcacgtggagatcgaccccgagatccagagagtgagaacccaggagagagagcagatcaagaccctgaacaacaagttcgccagcttcatcgacaaggtgagattcctggagcagcagaacaaggtgctggagaccaagtgggccctgctgcaggagcagggccagaacctgggcgtgaccagaaacaacctggagcccctgttcgaggcctacctgggcagcatgagaagcaccctggacagactgcagagcgagagaggcagactggacagcgagctgagaaacgtgcaggacctggtggaggacttcaagaacaagtacgaggacgagatcaacaagcacaccgccgccgagaacgagttcgtggtgctgaagaaggacgtggacgccgcctacatgggcagaatggacctgcacggcaaggtgggcaccctgacccaggagatcgacttcctgcagcagctgtacgagatggagctgagccaggtgcagacccacgtgagcaacaccaacgtggtgctgagcatggacaacaacagaaacctggacctggacagcatcatcgccgaggtgaaggcccagtacgagctgatcgcccagagaagcagagccgaggccgaggcctggtaccagaccaagtacgaggagctgcaggtgaccgccggcaagcacggcgacaacctgagagacaccaagaacgagatcgccgagctgaccagaaccatccagagactgcagggcgaggccgacgccgccaagaagcagtgccagcagctgcagaccgccatcgccgaggccgagcagagaggcgagctggccctgaaggacgcccagaagaagctgggcgacctggacgtggccctgcaccaggccaaggaggacctgaccagactgctgagagactaccaggagctgatgaacgtgaagctggccctggacgtggagatcgccacctacagaaagctgctggagagcgaggagagcagaatgagcggcgagtgccccagcgccgtgagcatcagcgtgaccggcaacagcaccaccgtgtgcggcggcggcgccgccagcttcggcggcggcatcagcctgggcggcagcggcggcgccaccaagggcggcttcagcaccaacgtgggctacagcaccgtgaagggcggccccgtgagcgccggcaccagcatcctgagaaagaccaccaccgtgaagaccagcagccagagatactag

SEQ ID NO: 86101 - DNA, 1269 bp, Artificial Sequence
  Description of Artificial Sequence: Synthetic coding sequence
atggcctgcagaagctgcgtggtgggcttcagcagcctgagcagctgcgaggtgacccccgtgggcagccccagacccggcaccagcggctgggacagctgcagagcccccggccccggcttcagcagcagaagcctgaccggctgctggagcgccggcaccatcagcaaggtgaccgtgaaccccggcctgctggtgcccctggacgtgaagctggaccccgccgtgcagcagctgaagaaccaggagaaggaggagatgaaggccctgaacgacaagttcgccagcctgatcggcaaggtgcaggccctggagcagagaaaccagctgctggagaccagatggagcttcctgcagggccaggacagcgccatcttcgacctgggccacctgtacgaggagtaccagggcagactgcaggaggagctgagaaaggtgagccaggagagaggccagctggaggccaacctgctgcaggtgctggagaaggtggaggagttcagaatcagatacgaggacgagatcagcaagagaaccgacatggagttcaccttcgtgcagctgaagaaggacctggacgccgagtgcctgcacagaaccgagctggagaccaagctgaagagcctggagagcttcgtggagctgatgaagaccatctacgagcaggagctgaaggacctggccgcccaggtgaaggacgtgagcgtgaccgtgggcatggacagcagatgccacatcgacctgagcggcatcgtggaggaggtgaaggcccagtacgacgccgtggccgccagaagcctggaggaggccgaggcctacagcagaagccagctggaggagcaggccgccagaagcgccgagtacggcagcagcctgcagagcagcagaagcgagatcgccgacctgaacgtgagaatccagaagctgagaagccagatcctgagcgtgaagagccactgcctgaagctggaggagaacatcaagaccgccgaggagcagggcgagctggccttccaggacgccaagaccaagctggcccagctggaggccgccctgcagcaggccaagcaggacatggccagacagctgagaaagtaccaggagctgatgaacgtgaagctggccctggacatcgagatcgccacctacagaaagctggtggagggcgaggagggcagaatggacagccccagcgccaccgtggtgagcgccgtgcagagcagatgcaagaccgcccccagcctgccctaccccctgtgcagcctgtag

SEQ ID NO: 86102 - DNA, 1359 bp, Artificial Sequence
  Description of Artificial Sequence: Synthetic coding sequence
atggcctgcagaagctgcgtggtgggcttcagcagcctgagcagctgcgaggtgacccccgtgggcagccccagacccggcaccagcggctgggacagctgcagagcccccggccccggcttcagcagcagaagcctgaccggctgctggagcgccggcaccatcagcaaggtgaccgtgaaccccggcctgctggtgcccctggacgtgaagctggaccccgccgtgcagcagctgaagaaccaggagaaggaggagatgaaggccctgaacgacaagttcgccagcctgatcggcaaggtgcaggccctggagcagagaaaccagctgctggagaccagatggagcttcctgcagggccaggacagcgccatcttcgacctgggccacctgtacgaggagtaccagggcagactgcaggaggagctgagaaaggtgagccaggagagaggccagctggaggccaacctgctgcaggtgctggagaaggtggaggagttcagaatcagatacgaggacgagatcagcaagagaaccgacatggagttcaccttcgtgcagctgaagaaggacctggacgccgagtgcctgcacagaaccgagctggagaccaagctgaagagcctggagagcttcgtggagctgatgaagaccatctacgagcaggagctgaaggacctggccgcccaggtgaaggacgtgagcgtgaccgtgggcatggacagcagatgccacatcgacctgagcggcatcgtggaggaggtgaaggcccagtacgacgccgtggccgccagaagcctggaggaggccgaggcctacagcagaagccagctggaggagcaggccgccagaagcgccgagtacggcagcagcctgcagagcagcagaagcgagatcgccgacctgaacgtgagaatccagaagctgagaagccagatcctgagcgtgaagagccactgcctgaagctggaggagaacatcaagaccgccgaggagcagggcgagctggccttccaggacgccaagaccaagctggcccagctggaggccgccctgcagcaggccaagcaggacatggccagacagctgagaaagtaccaggagctgatgaacgtgaagctggccctggacatcgagatcgccacctacagaaagctggtggagggcgaggagggcagaatggacagccccagcgccaccgtggtgagcgccgtgcagagcagatgcaagaccgccgccagcagaagcggcctgagcaaggcccccagcagaaagaagaagggcagcaagggccccgtgatcaagatcaccgagatgagcgagaagtacttcagccaggagagcgaggtgagcgagtag

SEQ ID NO: 86103 - DNA, 1518 bp, Artificial Sequence
  Description of Artificial Sequence: Synthetic coding sequence
atgacctgcggcagcggcttcggcggcagagccttcagctgcatcagcgcctgcggccccagacccggcagatgctgcatcaccgccgccccctacagaggcatcagctgctacagaggcctgaccggcggcttcggcagccacagcgtgtgcggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagctgcagttctaccagaacagagagtgctgccagagcaacctggagcccctgttcgagggctacatcgagaccctgagaagagaggccgagtgcgtggaggccgacagcggcagactggccagcgagctgaaccacgtgcaggaggtgctggagggctacaagaagaagtacgaggaggaggtgagcctgagagccaccgccgagaacgagttcgtggccctgaagaaggacgtggactgcgcctacctgagaaagagcgacctggaggccaacgtggaggccctgatccaggagatcgacttcctgagaagactgtacgaggaggagatcctgatcctgcagagccacatcagcgacaccagcgtggtggtgaagctggacaacagcagagacctgaacatggactgcatcatcgccgagatcaaggcccagtacgacgacatcgtgaccagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgaggtggagaacgccaagtgccagaacagcaagctggaggccgccgtggcccagagcgagcagcagggcgaggccgccctgagcgacgccagatgcaagctggccgagctggagggcgccctgcagaaggccaagcaggacatggcctgcctgatcagagagtaccaggaggtgatgaacagcaagctgggcctggacatcgagatcgccacctacagaagactgctggagggcgaggagcagagactgtgcgagggcatcggcgccgtgaacgtgtgcgtgagcagcagcagaggcggcgtggtgtgcggcgacctgtgcgtgagcggcagcagacccgtgaccggcagcgtgtgcagcgccccctgcaacggcaacgtggccgtgagcaccggcctgtgcgccccctgcggccagctgaacaccacctgcggcggcggcagctgcggcgtgggcagctgcggcatcagcagcctgggcgtgggcagctgcggcagcagctgcagaaagtgctag

SEQ ID NO: 86104 - DNA, 1455 bp, Artificial Sequence
  Description of Artificial Sequence: Synthetic coding sequence
atgacctgcggcagcggcttcggcggcagagccttcagctgcatcagcgcctgcggccccagacccggcagatgctgcatcaccgccgccccctacagaggcatcagctgctacagaggcctgaccggcggcttcggcagccacagcgtgtgcggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagctgcagttctaccagaacagagagtgctgccagagcaacctggagcccctgttcgagggctacatcgagaccctgagaagagaggccgagtgcgtggaggccgacagcggcagactggccagcgagctgaaccacgtgcaggaggtgctggagggctacaagaagaagtacgaggaggaggtgagcctgagagccaccgccgagaacgagttcgtggccctgaagaaggacgtggactgcgcctacctgagaaagagcgacctggaggccaacgtggaggccctgatccaggagatcgacttcctgagaagactgtacgaggaggagatcctgatcctgcagagccacatcagcgacaccagcgtggtggtgaagctggacaacagcagagacctgaacatggactgcatcatcgccgagatcaaggcccagtacgacgacatcgtgaccagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgaggtggagaacgccaagtgccagaacagcaagctggaggccgccgtggcccagagcgagcagcagggcgaggccgccctgagcgacgccagatgcaagctggccgagctggagggcgccctgcagaaggccaagcaggacatggcctgcctgatcagagagtaccaggaggtgatgaacagcaagctgggcctggacatcgagatcgccacctacagaagactgctggagggcgaggagcagagactgtgcgagggcatcggcgccgtgaacgtgtgcgtgagcagcagcagaggcggcgtggtgtgcggcgacctgtgcgtgagcggcagcagacccgtgaccggcagcgtgtgcagcgccccctgcaacggcaacgtggccgtgagcaccggcctgtgcgccccctgcggccaggtgggcagctgcggcagcagctgcagaaagtgctag

SEQ ID NO: 86105 - DNA, 1482 bp, Artificial Sequence
  Description of Artificial Sequence: Synthetic coding sequence
atgacctgcggcttcaacagcatcggctgcggcttcagacccggcaacttcagctgcgtgagcgcctgcggccccagacccagcagatgctgcatcaccgccgccccctacagaggcatcagctgctacagaggcctgaccggcggcttcggcagccacagcgtgtgcggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagctgcagttctaccagaacagagagtgctgccagagcaacctggagcccctgttcgccggctacatcgagaccctgagaagagaggccgagtgcgtggaggccgacagcggcagactggccagcgagctgaaccacgtgcaggaggtgctggagggctacaagaagaagtacgaggaggaggtggccctgagagccaccgccgagaacgagttcgtggccctgaagaaggacgtggactgcgcctacctgagaaagagcgacctggaggccaacgtggaggccctgatccaggagatcgacttcctgagaagactgtacgaggaggagatcagaatcctgcagagccacatcagcgacaccagcgtggtggtgaagctggacaacagcagagacctgaacatggactgcatcgtggccgagatcaaggcccagtacgacgacatcgccaccagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgaggtggagaacgccaagtgccagaacagcaagctggaggccgccgtggcccagagcgagcagcagggcgaggccgccctgagcgacgccagatgcaagctggccgagctggagggcgccctgcagaaggccaagcaggacatggcctgcctgatcagagagtaccaggaggtgatgaacagcaagctgggcctggacatcgagatcgccacctacagaagactgctggagggcgaggagcagagactgtgcgagggcgtggaggccgtgaacgtgtgcgtgagcagcagcagaggcggcgtggtgtgcggcgacctgtgcgtgagcggcagcagacccgtgaccggcagcgtgtgcagcgccccctgcaacggcaacctggtggtgagcaccggcctgtgcaagccctgcggccagctgaacaccacctgcggcggcggcagctgcggccagggcagacactag

SEQ ID NO: 86106 - DNA, 1524 bp, Artificial Sequence
  Description of Artificial Sequence: Synthetic coding sequence
atgagctgcagaagctacagaatcagcagcggctgcggcgtgaccagaaacttcagcagctgcagcgccgtggcccccaagaccggcaacagatgctgcatcagcgccgccccctacagaggcgtgagctgctacagaggcctgaccggcttcggcagcagaagcctgtgcaacctgggcagctgcggccccagaatcgccgtgggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagtggcagttctaccagaaccagagatgctgcgagagcaacctggagcccctgttcagcggctacatcgagaccctgagaagagaggccgagtgcgtggaggccgacagcggcagactggccagcgagctgaaccacgtgcaggaggtgctggagggctacaagaagaagtacgaggaggaggtggccctgagagccaccgccgagaacgagttcgtggtgctgaagaaggacgtggactgcgcctacctgagaaagagcgacctggaggccaacgtggaggccctggtggaggagagcagcttcctgagaagactgtacgaggaggagatcagagtgctgcaggcccacatcagcgacaccagcgtgatcgtgaagatggacaacagcagagacctgaacatggactgcatcatcgccgagatcaaggcccagtacgacgacgtggccagcagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgagatcgagaacgccaagtgccagagagccaagctggaggccgccgtggccgaggccgagcagcagggcgaggccgccctgagcgacgccagatgcaagctggccgagctggagggcgccctgcagaaggccaagcaggacatggcctgcctgctgaaggagtaccaggaggtgatgaacagcaagctgggcctggacatcgagatcgccacctacagaagactgctggagggcgaggagcacagactgtgcgagggcgtgggcagcgtgaacgtgtgcgtgagcagcagcagaggcggcgtgagctgcggcggcctgagctacagcaccacccccggcagacagatcaccagcggccccagcgccatcggcggcagcatcaccgtggtggcccccgacagctgcgccccctgccagcccagaagcagcagcttcagctgcggcagcagcagaagcgtgagattcgcctag

SEQ ID NO: 86107 - DNA, 888 bp, Artificial Sequence
  Description of Artificial Sequence: Synthetic coding sequence
atggtgttcaaggtgcagttcctgagcagcagacccagcctgagccacacccaggacgtggactgcgcctacctgagaaagagcgacctggaggccaacgtggaggccctggtggaggagagcagcttcctgagaagactgtacgaggaggagatcagagtgctgcaggcccacatcagcgacaccagcgtgatcgtgaagatggacaacagcagagacctgaacatggactgcatcatcgccgagatcaaggcccagtacgacgacgtggccagcagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgagatcgagaacgccaagtgccagagagccaagctggaggccgccgtggccgaggccgagcagcagggcgaggccgccctgagcgacgccagatgcaagctggccgagctggagggcgccctgcagaaggccaagcaggacatggcctgcctgctgaaggagtaccaggaggtgatgaacagcaagctgggcctggacatcgagatcgccacctacagaagactgctggagggcgaggagcacagactgtgcgagggcgtgggcagcgtgaacgtgtgcgtgagcagcagcagaggcggcgtgagctgcggcggcctgagctacagcaccacccccggcagacagatcaccagcggccccagcgccatcggcggcagcatcaccgtggtggcccccgacagctgcgccccctgccagcccagaagcagcagcttcagctgcggcagcagcagaagcgtgagattcgcctag

SEQ ID NO: 86108 - DNA, 1461 bp, Artificial Sequence
  Description of Artificial Sequence: Synthetic coding sequence
atgacctgcggcagctactgcggcggcagagccttcagctgcatcagcgcctgcggccccagacccggcagatgctgcatcaccgccgccccctacagaggcatcagctgctacagaggcctgaccggcggcttcggcagccacagcgtgtgcggcggcttcagagccggcagctgcggcagaagcttcggctacagaagcggcggcgtgtgcggccccagccccccctgcatcaccaccgtgagcgtgaacgagagcctgctgacccccctgaacctggagatcgaccccaacgcccagtgcgtgaagcaggaggagaaggagcagatcaagagcctgaacagcagattcgccgccttcatcgacaaggtgagattcctggagcagcagaacaagctgctggagaccaagctgcagttctaccagaacagagagtgctgccagagcaacctggagcccctgttcgagggctacatcgagaccctgagaagagaggccgagtgcgtggaggccgacagcggcagactggccagcgagctgaaccacgtgcaggaggtgctggagggctacaagaagaagtacgaggaggaggtgagcctgagagccaccgccgagaacgagttcgtggccctgaagaaggacgtggactgcgcctacctgagaaagagcgacctggaggccaacgtggaggccctgatccaggagatcgacttcctgagaagactgtacgaggaggagatcagagtgctgcagagccacatcagcgacaccagcgtggtggtgaagctggacaacagcagagacctgaacatggactgcatcatcgccgagatcaaggcccagtacgacgacatcgtgaccagaagcagagccgaggccgagagctggtacagaagcaagtgcgaggagatgaaggccaccgtgatcagacacggcgagaccctgagaagaaccaaggaggagatcaacgagctgaacagaatgatccagagactgaccgccgaggtggagaacgccaagtgccagaacagcaagctggaggccgccgtggcccagagcgagcagcagggcgaggccgccctgagcgacgccagatgcaagctggccgagctggagggcgccctgcagaaggccaagcaggacatggcctgcctgatcagagagtaccaggaggtgatgaacagcaagctgggcctggacatcgagatcgccacctacagaagactgctggagggcgaggagcagagactgtgcgagggcgtgggcagcgtgaacgtgtgcgtgagcagcagcagaggcggcgtggtgtgcggcgacctgtgcgccagcaccaccgcccccgtggtgagcaccagagtgagcagcgtgcccagcaacagcaacgtggtggtgggcaccaccaacgcctgcgcccccagcgccagagtgggcgtgtgcggcggcagctgcaagagatgctag

SEQ ID NO: 86109 - DNA, 1872 bp, Artificial Sequence
  Description of Artificial Sequence: Synthetic coding sequence
atgagctgcagacagttcagcagcagctacctgagcagaagcggcggcggcggcggcggcggcctgggcagcggcggcagcatcagaagcagctacagcagattcagcagcagcggcggcggcggcggcggcggcagattcagcagcagcagcggctacggcggcggcagcagcagagtgtgcggcagaggcggcggcggcagcttcggctacagctacggcggcggcagcggcggcggcttcagcgccagcagcctgggcggcggcttcggcggcggcagcagaggcttcggcggcgccagcggcggcggctacagcagcagcggcggcttcggcggcggcttcggcggcggcagcggcggcggcttcggcggcggctacggcagcggcttcggcggcttcggcggcttcggcggcggcgccggcggcggcgacggcggcatcctgaccgccaacgagaagagcaccatgcaggagctgaacagcagactggccagctacctggacaaggtgcaggccctggaggaggccaacaacgacctggagaacaagatccaggactggtacgacaagaagggccccgccgccatccagaagaactacagcccctactacaacaccatcgacgacctgaaggaccagatcgtggacctgaccgtgggcaacaacaagaccctgctggacatcgacaacaccagaatgaccctggacgacttcagaatcaagttcgagatggagcagaacctgagacagggcgtggacgccgacatcaacggcctgagacaggtgctggacaacctgaccatggagaagagcgacctggagatgcagtacgagaccctgcaggaggagctgatggccctgaagaagaaccacaaggaggagatgagccagctgaccggccagaacagcggcgacgtgaacgtggagatcaacgtggcccccggcaaggacctgaccaagaccctgaacgacatgagacaggagtacgagcagctgatcgccaagaacagaaaggacatcgagaaccagtacgagacccagatcacccagatcgagcacgaggtgagcagcagcggccaggaggtgcagagcagcgccaaggaggtgacccagctgagacacggcgtgcaggagctggagatcgagctgcagagccagctgagcaagaaggccgccctggagaagagcctggaggacaccaagaacagatactgcggccagctgcagatgatccaggagcagatcagcaacctggaggcccagatcaccgacgtgagacaggagatcgagtgccagaaccaggagtacagcctgctgctgagcatcaagatgagactggagaaggagatcgagacctaccacaacctgctggagggcggccaggaggacttcgagagcagcggcgccggcaagatcggcctgggcggcagaggcggcagcggcggcagctacggcagaggcagcagaggcggcagcggcggcagctacggcggcggcggcagcggcggcggctacggcggcggcagcggcagcagaggcggcagcggcggcagctacggcggcggcagcggcagcggcggcggcagcggcggcggctacggcggcggcagcggcggcggccacagcggcggcagcggcggcggccacagcggcggcagcggcggcaactacggcggcggcagcggcagcggcggcggcagcggcggcggctacggcggcggcagcggcagcagaggcggcagcggcggcagccacggcggcggcagcggcttcggcggcgagagcggcggcagctacggcggcggcgaggaggccagcggcagcggcggcggctacggcggcggcagcggcaagagcagccacagctag

SEQ ID NO: 86110 - DNA, 534 bp, Artificial Sequence
  Description of Artificial Sequence: Synthetic coding sequence
atggcctgctgccagaccagcttctgcggcttccccagctgcagcaccagcggcacctgcggcagcagctgctgccagcccagctgctgcgagaccagcagctgccagcccagatgctgcgagaccagctgctgccagcccagctgctgccagaccagcttctgcggcttccccagcttcagcaccggcggcacctgcgacagcagctgctgccagcccagctgctgcgagaccagctgctgccagcccagctgctaccagaccagcagctgcggcaccggctgcggcatcggcggcggcatcggctacggccaggagggcagcagcggcgccgtgagcaccagaatcagatggtgcagacccgactgcagagtggagggcacctgcctgcccccctgctgcgtggtgagctgcaccccccccagctgctgccagctgcaccacgccgaggccagctgctgcagacccagctactgcggccagagctgctgcagacccgtgtgctgctgctactgcagcgagcccacctgctag

SEQ ID NO: 86111 - DNA, 504 bp, Artificial Sequence
  Description of Artificial Sequence: Synthetic coding sequence
atggcctgctgccagaccagcttctgcggcttccccagctgcagcaccagcggcacctgcggcagcagctgctgccagcccagatgctgcgagaccagctgctgccagcccagctgctgccagaccagcttctgcggcttccccagcttcagcaccggcggcacctgcgacagcagctgctgccagcccagctgctgcgagaccagctgctgccagcccagctgctaccagaccagcagctgcggcaccggctgcggcatcggcggcggcatcggctacggccaggagggcagcagcggcgccgtgagcaccagaatcagatggtgcagacccgactgcagagtggagggcacctgcctgcccccctgctgcgtggtgagctgcaccccccccagctgctgccagctgcaccacgccgaggccagctgctgcagacccagctactgcggccagagctgctgcagacccgtgtgctgctgctactgcagcgagcccacctgctag

SEQ ID NO: 86112 - DNA, 492 bp, Artificial Sequence
  Description of Artificial Sequence: Synthetic coding sequence
atgagcttcaactgcagcaccagaaactgcagcagcagacccatcggcggcagatgcatcgtgcccgtggcccaggtgaccaccaccagcaccaccgacgccgactgcctgggcggcatctgcctgcccagcagcttccagaccggcagctggctgctggaccactgccaggagacctgctgcgagcccaccgcctgccagcccacctgctacagaagaaccagctgcgtgagcaacccctgccaggtgacctgcagcagacagaccacctgcatcagcaacccctgcagcaccacctacagcagacccctgaccttcgtgagcagcggctgccagcccctgggcggcatcagcagcgtgtgccagcccgtgggcggcatcagcaccgtgtgccagcccgtgggcggcgtgagcaccgtgtgccagcccgcctgcggcgtgagcagaacctaccagcagagctgcgtgagcagctgcagaagaacctgctag

SEQ ID NO: 86113 - DNA, 504 bp, Artificial Sequence
  Description of Artificial Sequence: Synthetic coding sequence
atgacctgctgccagaccagcttctgcggctaccccagctgcagcaccagcggcacctgcggcagcagctgctgccagcccagctgctgcgagaccagctgctgccagcccagctgctgccagaccagcttctgcggcttccccagcttcagcaccagcggcacctgcagcagcagctgctgccagcccagctgctgcgagaccagctgctgccagcccagctgctgccagaccagcagctgcggcaccggctgcggcatcggcggcggcatcggctacggccaggagggcagcagcggcgccgtgagcaccagaatcagatggtgcagacccgactgcagagtggagggcacctgcctgcccccctgctgcgtggtgagctgcaccccccccacctgctgccagctgcaccacgccgaggccagctgctgcagacccagctactgcggccagagctgctgcagacccgtgtgctgctgctacagctgcgagcccacctgctag

SEQ ID NO: 86114 - DNA, 366 bp, Artificial Sequence
  Description of Artificial Sequence: Synthetic coding sequence
atggccagctgcagcaccagcggcacctgcggcagcagctgctgccagcccagctgctgcgagaccagctgctgccagcccagctgctgccagaccagcagctgcggcaccggctgcggcatcggcggcggcatcggctacggccaggagggcagcggcggcagcgtgagcaccagaatcagatggtgccaccccgactgccacgtggagggcacctgcctgcccccctgctacctggtgagctgcaccccccccagctgctgccagctgcaccacgccgaggccagctgctgcagacccagctactgcggccagagctgctgcagacccgcctgctgctgccactgctgcgagcccacctgctag

SEQ ID NO: 86115 - DNA, 837 bp, Artificial Sequence
  Description of Artificial Sequence: Synthetic coding sequence
atgggctgctgcggctgcagcggcggctgcggcagcagctgcggcggctgcggcagcggctgcggcggctgcggcagcggctgcggcggctgcggcagcggctgcggcggcagcggcagcagctgctgcgtgcccgtgtgctgctgcaagcccgtgtgctgcagagtgcccacctgcagctgcagcagctgcggcaagggcggctgcggcagcagcggcggcagcaagggcggctgcggcagctgcggcggctgcaagggcggctgcggcagctgcggcggcagcaagggcggctgcggcagctgcggcggcagcaagggcggctgcggcagctgcggcggcagcaagggcggctgcggcagcggctgcggcggctgcggcagcagctgctgcgtgcccgtgtgctgctgcaagcccatgtgctgctgcgtgcccgcctgcagctgcagcagctgcggcaagggcggctgcggcagctgcggctgcagcaagggcgcctgcggcagctgcggcggcagcaagggcggctgcggcagctgcggcggctgcaagggcggctgcggcagctgcggcggcagcaagggcggctgcggcagcggctgcggcggctgcggcagcggctgcggcgtgcccgtgtgctgctgcagctgcagcagctgcggcagctgcgccggcagcaagggcggctgcggcagcagctgcagccagtgcagctgctgcaagccctgctgctgcagcagcggctgcggcagcagctgctgccagagcagctgctgcaagccctgctgcagccagagcagctgctgcgtgcccgtgtgctgccagtgcaagatctag

SEQ ID NO: 86116 - DNA, 510 bp, Artificial Sequence
  Description of Artificial Sequence: Synthetic coding sequence
atgggctgctgcggctgcagcggcggctgcggcagcagctgcggcggctgcgacagcagctgcggcagctgcggcagcggctgcagaggctgcggccccagctgctgcgcccccgtgtactgctgcaagcccgtgtgctgctgcgtgcccgcctgcagctgcagcagctgcggcaagagaggctgcggcagctgcggcggcagcaagggcggctgcggcagctgcggctgcagccagtgcagctgctgcaagccctgctgctgcagcagcggctgcggcagcagctgctgccagtgcagctgctgcaagccctactgcagccagtgcagctgctgcaagccctgctgcagcagcagcggcagaggcagcagctgctgccagagcagctgctgcaagccctgctgcagcagcagcggctgcggcagcagctgctgccagagcagctgctgcaagccctgctgcagccagagcagatgctgcgtgcccgtgtgctaccagtgcaagatctag

SEQ ID NO: 86117 - DNA, 1740 bp, Artificial Sequence
  Description of Artificial Sequence: Synthetic coding sequence
atgtgcgaccagcagcagatccagtgcagactgcccctgcagcagtgctgcgtgaagggccccagcttctgcagcagccagagccccttcgcccagagccaggtggtggtgcaggccccctgcgagatgcagatcgtggactgccccgccagctgccccgtgcaggtgtgccaggtgagcgaccaggccccctgccagagccagaccacccaggtgaagtgccagagcaagaccaagcaggtgaagggccaggcccagtgccagagcaagaccacccaggtgaagggccaggccgccagccagagccagaccagcagcgtgcagagccaggccccctgccagagcgaggtgagctacgtgcagtgcgaggccagccagcccgtgcagacctgcttcgtggagtgcgcccccgtgtgctacaccgagacctgctacgtggagtgccccgtgcagaactacgtgccctgccccgccccccagcccgtgcagatgtacagaggcagacccgccgtgtgccagccccagggcagattcagcacccagtgccagtaccagggcagctacagcagctgcggcccccagttccagagcagagccacctgcaacaactacaccccccagttccagctgagacccagctacagcagctgcttcccccagtacagaagcagaaccagcttcagcccctgcgtgccccagtgccagacccagggcagctacggcagcttcaccgagcagcacagaagcagaagcaccagcagatgcctgcccccccccagaagactgcagctgttccccagaagctgcagcccccccagaagattcgagccctgcagcagcagctacctgcccctgagacccagcgagggcttccccaactactgcaccccccccagaagaagcgagcccatctacaacagcagatgccccagaagacccatcagcagctgcagccagagaagaggccccaagtgcagaatcgagatcagcagcccctgctgccccagacaggtgcccccccagagatgccccgtggagatcccccccatcagaagaagaagccagagctgcggcccccagcccagctggggcgccagctgccccgagctgagaccccacgtggagcccagacccctgcccagcttctgcccccccagaagactggaccagtgccccgagagccccctgcagagatgccccccccccgcccccagacccagactgagacccgagccctgcatcagcctggagcccagacccagacccctgcccagacagctgagcgagccctgcctgtaccccgagcccctgcccgccctgagacccacccccagacccgtgcccctgcccagacccggccagtgcgagatccccgagcccagaccctgcctgcagccctgcgagcaccccgagccctgccccagacccgagcccatccccctgcccgccccctgccccagccccgagccctgcagagagacctggagaagccccagcccctgctggggccccaaccccgtgccctaccccggcgacctgggctgccacgagagcagcccccacagactggacaccgaggccccctactgcggccccagcagctacaaccagggccaggagagcggcgccggctgcggccccggcgacgtgttccccgagagaagaggccaggacggccacggcgaccagggcaacgccttcgccggcgtgaagggcgaggccaagagcgcctacttctag

SEQ ID NO: 86118 - DNA, 1059 bp, Artificial Sequence
  Description of Artificial Sequence: Synthetic coding sequence
atggccggcaccatctgcttcatcatgtgggtgctgttcatcaccgacaccgtgtggagcagaagcgtgagacaggtgtacgaggtgcacgacagcgacgactggaccatccacgacttcgagtgccccatggagtgcttctgcccccccagcttccccaccgccctgtactgcgagaacagaggcctgaaggagatccccgccatccccagcagaatctggtacctgtacctgcagaacaacctgatcgagaccatccccgagaagcccttcgagaacgccacccagctgagatggatcaacctgaacaagaacaagatcaccaactacggcatcgagaagggcgccctgagccagctgaagaagctgctgttcctgttcctggaggacaacgagctggaggaggtgcccagccccctgcccagaagcctggagcagctgcagctggccagaaacaaggtgagcagaatcccccagggcaccttcagcaacctggagaacctgaccctgctggacctgcagaacaacaagctggtggacaacgccttccagagagacaccttcaagggcctgaagaacctgatgcagctgaacatggccaagaacgccctgagaaacatgccccccagactgcccgccaacaccatgcagctgttcctggacaacaacagcatcgagggcatccccgagaactacttcaacgtgatccccaaggtggccttcctgagactgaaccacaacaagctgagcgacgagggcctgcccagcagaggcttcgacgtgagcagcatcctggacctgcagctgagccacaaccagctgaccaaggtgcccagaatcagcgcccacctgcagcacctgcacctggaccacaacaagatcaagagcgtgaacgtgagcgtgatctgccccagccccagcatgctgcccgccgagagagacagcttcagctacggcccccacctgagatacctgagactggacggcaacgagatcaagccccccatccccatggccctgatgacctgcttcagactgctgcaggccgtgatcatctag

SEQ ID NO: 86119 - DNA, 897 bp, Artificial Sequence
  Description of Artificial Sequence: Synthetic coding sequence
atggaggagaagcagatcctgtgcgtgggcctggtggtgctggacgtgatcagcctggtggacaagtaccccaaggaggacagcgagatcagatgcctgagccagagatggcagagaggcggcaacgccagcaacagctgcaccgtgctgagcctgctgggcgccccctgcgccttcatgggcagcatggcccccggccacgtggccgacttcctggtggccgacttcagaagaagaggcgtggacgtgagccaggtggcctggcagagcaagggcgacacccccagcagctgctgcatcatcaacaacagcaacggcaacagaaccatcgtgctgcacgacaccagcctgcccgacgtgagcgccaccgacttcgagaaggtggacctgacccagttcaagtggatccacatcgagggcagaaacgccagcgagcaggtgaagatgctgcagagaatcgacgcccacaacaccagacagccccccgagcagaagatcagagtgagcgtggaggtggagaagcccagagaggagctgttccagctgttcggctacggcgacgtggtgttcgtgagcaaggacgtggccaagcacctgggcttccagagcgccgaggaggccctgagaggcctgtacggcagagtgagaaagggcgccgtgctggtgtgcgcctgggccgaggagggcgccgacgccctgggccccgacggcaagctgctgcacagcgacgccttccccccccccagagtggtggacaccctgggcgccggcgacaccttcaacgccagcgtgatcttcagcctgagccagggcagaagcgtgcaggaggccctgagattcggctgccaggtggccggcaagaagtgcggcctgcagggcttcgacggcatcgtgtag

SEQ ID NO: 86120 - DNA, 897 bp, Artificial Sequence
  Description of Artificial Sequence: Synthetic coding sequence
atggaggagaagcagatcctgtgcgtgggcctggtggtgctggacgtgatcagcctggtggacaagtaccccaaggaggacagcgagatcagatgcctgagccagagatggcagagaggcggcaacgccagcaacagctgcaccgtgctgagcctgctgggcgccccctgcgccttcatgggcagcatggcccccggccacgtggccgacttcgtgctggacgacctgagaagatacagcgtggacctgagatacaccgtgttccagaccaccggcagcgtgcccatcgccaccgtgatcatcaacgaggccagcggcagcagaaccatcctgtactacgacagaagcctgcccgacgtgagcgccaccgacttcgagaaggtggacctgacccagttcaagtggatccacatcgagggcagaaacgccagcgagcaggtgaagatgctgcagagaatcgacgcccacaacaccagacagccccccgagcagaagatcagagtgagcgtggaggtggagaagcccagagaggagctgttccagctgttcggctacggcgacgtggtgttcgtgagcaaggacgtggccaagcacctgggcttccagagcgccgaggaggccctgagaggcctgtacggcagagtgagaaagggcgccgtgctggtgtgcgcctgggccgaggagggcgccgacgccctgggccccgacggcaagctgctgcacagcgacgccttccccccccccagagtggtggacaccctgggcgccggcgacaccttcaacgccagcgtgatcttcagcctgagccagggcagaagcgtgcaggaggccctgagattcggctgccaggtggccggcaagaagtgcggcctgcagggcttcgacggcatcgtgtag

SEQ ID NO: 86121 - DNA, 1041 bp, Artificial Sequence
  Description of Artificial Sequence: Synthetic coding sequence
atggaggagaagtacctgcccgagctgatggccgagaaggacagcctggaccccagcttcacccacgccctgagactggtgaaccaggagatcgagaagttccagaagggcgagggcaaggacgaggagaagtacatcgacgtggtgatcaacaagaacatgaagctgggccagaaggtgctgatccccgtgaagcagttccccaagttcaacttcgtgggcaagctgctgggccccagaggcaacagcctgaagagactgcaggaggagaccctgaccaagatgagcatcctgggcaagggcagcatgagagacaaggccaaggaggaggagctgagaaagagcggcgaggccaagtacttccacctgaacgacgacctgcacgtgctgatcgaggtgttcgccccccccgccgaggcctacgccagaatgggccacgccctggaggagatcaagaagttcctgatccccgactacaacgacgagatcagacaggcccagctgcaggagctgacctacctgaacggcggcagcgagaacgccgacgtgcccgtggtgagaggcaagcccaccctgagaaccagaggcgtgcccgcccccgccatcaccagaggcagaggcggcgtgaccgccagacccgtgggcgtggtggtgcccagaggcacccccacccccagaggcgtgctgagcaccagaggccccgtgagcagaggcagaggcctgctgacccccagagccagaggcgtgccccccaccggctacagaccccccccccccccccccacccaggagacctacggcgagtacgactacgacgacggctacggcaccgcctacgacgagcagagctacgacagctacgacaacagctacagcacccccgcccagagcggcgccgactactacgactacggccacggcctgagcgaggagacctacgacagctacggccaggaggagtggaccaacagcagacacaaggcccccagcgccagaaccgccaagggcgtgtacagagaccagccctacggcagatactag

SEQ ID NO: 86122 - DNA, 495 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatcttcggccacggcgacacctacctgagatgcatcgaggtgcacagccacaccctgatccagctggagagctggttcaccgccaccggccagaccagagtgaccgtggtgggcccccacagagccagacagtggctgctgcacatgttctgctgcgtgggcagccaggacagctaccaccacgccagaggcctggagatgctggagagagtgagaagccagcccctgaccaacgacgacctggtgaccagcatcagcgtgcccccctacaccggcgacctgagcctggcccccagaatcagcggcaccgtgtgcctgagcgtgccccagcccagcccctaccaggtgatcggctgcagcggcttccacctgagcagcctgtacccctag

SEQ ID NO: 86123 - DNA, 714 bp, Artificial Sequence
  Description of Artificial Sequence: Synthetic coding sequence
atgctgagcgccttccagagactgttcagagtgctgttcgtgatcgagaccgtgagcgagtacggcgtgctgatcttcatctacggctggcccttcctgcagaccctggccatgctgctgatcggcaccgtgagcttccacctgtggatcagaagaaacagagagagaaacagcagaagcggcaagaccagatgcagaagcaagagaagcgagcagagcatggacatgggcaccagcgccctgagcaagaagccctggtggaccctgccccagaacttccacgcccccatggtgttccacatggaggaggaccaggaggagctgatcttcggccacggcgacacctacctgagatgcatcgaggtgcacagccacaccctgatccagctggagagctggttcaccgccaccggccagaccagagtgaccgtggtgggcccccacagagccagacagtggctgctgcacatgttctgctgcgtgggcagccaggacagctaccaccacgccagaggcctggagatgctggagagagtgagaagccagcccctgaccaacgacgacctggtgaccagcatcagcgtgcccccctacaccggcgacctgagcctggcccccagaatcagcggcaccgtgtgcctgagcgtgccccagcccagcccctaccaggtgatcggctgcagcggcttccacctgagcagcctgtacccctag

SEQ ID NO: 86124 - DNA, 297 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatcttcggccacggcgacacctacctgagatgcatcgaggtgcacagccacaccctgatccagctggagagctggttcaccgccaccggccagaccagagtgaccgtggtgggcccccacagagccagacagtggctgctgcacatgttctgctgcgtgggcagccaggacagctaccaccacgccagatag

SEQ ID NO: 86125 - DNA, 2133 bp, Artificial Sequence
  Description of Artificial Sequence: Synthetic coding sequence
atgagcgactacagcaccggcggccccccccccggcccccccccccccgccggcggcggcggcggcgccggcggcgccggcggcggccccccccccggcccccccggcgccggcgacagaggcggcggcggccccggcggcggcggccccggcggcggcagcgccggcggccccagccagccccccggcggcggcggccccggcatcagaaaggacgccttcgccgacgccgtgcagagagccagacagatcgccgccaagatcggcggcgacgccgccaccaccgtgaacaacagcacccccgacttcggcttcggcggccagaagagacagctggaggacggcgaccagcccgagagcaagaagctggccagccagggcgacagcatcagcagccagctgggccccatccaccccccccccagaaccagcatgaccgaggagtacagagtgcccgacggcatggtgggcctgatcatcggcagaggcggcgagcagatcaacaagatccagcaggacagcggctgcaaggtgcagatcagccccgacagcggcggcctgcccgagagaagcgtgagcctgaccggcgcccccgagagcgtgcagaaggccaagatgatgctggacgacatcgtgagcagaggcagaggcggcccccccggccagttccacgacaacgccaacggcggccagaacggcaccgtgcaggagatcatgatccccgccggcaaggccggcctggtgatcggcaagggcggcgagaccatcaagcagctgcaggagagagccggcgtgaagatgatcctgatccaggacggcagccagaacaccaacgtggacaagcccctgagaatcatcggcgacccctacaaggtgcagcaggcctgcgagatggtgatggacatcctgagagagagagaccagggcggcttcggcgacagaaacgagtacggcagcagaatcggcggcggcatcgacgtgcccgtgcccagacacagcgtgggcgtggtgatcggcagaagcggcgagatgatcaagaagatccagaacgacgccggcgtgagaatccagttcaagcaggacgacggcaccggccccgagaagatcgcccacatcatgggcccccccgacagatgcgagcacgccgccagaatcatcaacgacctgctgcagagcctgagaagcggcccccccggcccccccggcggccccggcatgccccccggcggcagaggcagaggcagaggccagggcaactggggcccccccggcggcgagatgaccttcagcatccccacccacaagtgcggcctggtgatcggcagaggcggcgagaacgtgaaggccatcaaccagcagaccggcgccttcgtggagatcagcagacagctgccccccaacggcgaccccaacttcaagctgttcatcatcagaggcagcccccagcagatcgaccacgccaagcagctgatcgaggagaagatcgagggccccctgtgccccgtgggccccggccccggcggccccggccccgccggccccatgggccccttcaaccccggccccttcaaccagggcccccccggcgcccccccccacgccggcggcccccccccccaccagtaccccccccagggctggggcaacacctacccccagtggcagccccccgccccccacgaccccagcaaggccgccgccgccgccgccgaccccaacgccgcctgggccgcctactacagccactactaccagcagccccccggccccgtgcccggccccgcccccgcccccgccgccccccccgcccagggcgagcccccccagcccccccccaccggccagagcgactacaccaaggcctgggaggagtactacaagaagatcggccagcagccccagcagcccggcgcccccccccagcaggactacaccaaggcctgggaggagtactacaagaagcaggcccaggtggccaccggcggcggccccggcgccccccccggcttcctggccccccccaccgtgttccagcccctgctgagcagcgccctggcccagctgcccagacccagacccagccccctgcccggcctggtgtgctgcctgttcatctgcagcagaggcgactag

SEQ ID NO: 86126 - DNA, 2136 bp, Artificial Sequence
  Description of Artificial Sequence: Synthetic coding sequence
atgagcgactacagcaccggcggccccccccccggcccccccccccccgccggcggcggcggcggcgccggcggcgccggcggcggccccccccccggcccccccggcgccggcgacagaggcggcggcggccccggcggcggcggccccggcggcggcagcgccggcggccccagccagccccccggcggcggcggccccggcatcagaaaggacgccttcgccgacgccgtgcagagagccagacagatcgccgccaagatcggcggcgacgccgccaccaccgtgaacaacagcacccccgacttcggcttcggcggccagaagagacagctggaggacggcgaccagcccgagagcaagaagctggccagccagggcgacagcatcagcagccagctgggccccatccaccccccccccagaaccagcatgaccgaggagtacagagtgcccgacggcatggtgggcctgatcatcggcagaggcggcgagcagatcaacaagatccagcaggacagcggctgcaaggtgcagatcagccccgacagcggcggcctgcccgagagaagcgtgagcctgaccggcgcccccgagagcgtgcagaaggccaagatgatgctggacgacatcgtgagcagaggcagaggcggcccccccggccagttccacgacaacgccaacggcggccagaacggcaccgtgcaggagatcatgatccccgccggcaaggccggcctggtgatcggcaagggcggcgagaccatcaagcagctgcaggagagagccggcgtgaagatgatcctgatccaggacggcagccagaacaccaacgtggacaagcccctgagaatcatcggcgacccctacaaggtgcagcaggcctgcgagatggtgatggacatcctgagagagagagaccagggcggcttcggcgacagaaacgagtacggcagcagaatcggcggcggcatcgacgtgcccgtgcccagacacagcgtgggcgtggtgatcggcagaagcggcgagatgatcaagaagatccagaacgacgccggcgtgagaatccagttcaagcaggacgacggcaccggccccgagaagatcgcccacatcatgggcccccccgacagatgcgagcacgccgccagaatcatcaacgacctgctgcagagcctgagaagcggcccccccggcccccccggcggccccggcatgccccccggcggcagaggcagaggcagaggccagggcaactggggcccccccggcggcgagatgaccttcagcatccccacccacaagtgcggcctggtgatcggcagaggcggcgagaacgtgaaggccatcaaccagcagaccggcgccttcgtggagatcagcagacagctgccccccaacggcgaccccaacttcaagctgttcatcatcagaggcagcccccagcagatcgaccacgccaagcagctgatcgaggagaagatcgagggccccctgtgccccgtgggccccggccccggcggccccggccccgccggccccatgggccccttcaaccccggccccttcaaccagggcccccccggcgcccccccccacgccggcggcccccccccccaccagtaccccccccagggctggggcaacacctacccccagtggcagccccccgccccccacgaccccagcaaggccgccgccgccgccgccgaccccaacgccgcctgggccgcctactacagccactactaccagcagccccccggccccgtgcccggccccgcccccgcccccgccgccccccccgcccagggcgagcccccccagcccccccccaccggccagagcgactacaccaaggcctgggaggagtactacaagaagatcggccagcagccccagcagcccggcgcccccccccagcaggactacaccaaggcctgggaggagtactacaagaagcaggcccaggtggccaccggcggcggccccggcgccccccccggcagccagcccgactacagcgccgcctgggccgagtactacagacagcaggccgcctactacggccagacccccggccccggcggcccccagcccccccccacccagcagggccagcagcaggcccagtag

SEQ ID NO: 86127 - DNA, 1095 bp, Artificial Sequence
  Description of Artificial Sequence: Synthetic coding sequence
atgagcgactacagccccggcggcggcagcgccggcggccccagccagccccccggcggcggcggccccggcatcagaaaggacgccttcgccgacgccgtgcagagagccagacagatcgccgccaagatcggcggcgacgccgccaccaccgtgaacaacagcacccccgacttcggcttcggcggccagaagagacagctggaggacggcgaccagcccgagagcaagaagctggccagccagggcgacagcatcagcagccagctgggccccatccaccccccccccagaaccagcatgaccgaggagtacagagtgcccgacggcatggtgggcctgatcatcggcagaggcggcgagcagatcaacaagatccagcaggacagcggctgcaaggtgcagatcagccccgacagcggcggcctgcccgagagaagcgtgagcctgaccggcgcccccgagagcgtgcagaaggccaagatgatgctggacgacatcgtgagcagaggcagaggcggcccccccggccagttccacgacaacgccaacggcggccagaacggcaccgtgcaggagatcatgatccccgccggcaaggccggcctggtgatcggcaagggcggcgagaccatcaagcagctgcaggagagagccggcgtgaagatgatcctgatccaggacggcagccagaacaccaacgtggacaagcccctgagaatcatcggcgacccctacaaggtgcagcaggcctgcgagatggtgatggacatcctgagagagagagaccagggcggcttcggcgacagaaacgagtacggcagcagaatcggcggcggcatcgacgtgcccgtgcccagacacagcgtgggcgtggtgatcggcagaagcggcgagatgatcaagaagatccagaacgacgccggcgtgagaatccagttcaagcaggacgacggcaccggccccgagaagatcgcccacatcatgggcccccccgacagatgcgagcacgccgccagaatcatcaacgaccccagcagcagcagcttcctgctgcccacccccggccacagacccagctgcctgagcggctag

SEQ ID NO: 86128 - DNA, 255 bp, Artificial Sequence
  Description of Artificial Sequence: Synthetic coding sequence
atggacgacgacgccgcccccagagtggagggcgtgcccgtggccgtgcacaagcacgccctgcacgacggcctgagacaggtggccggccccggcgccgccgccgcccacctgcccagatggccccccccccagctggccgccagcagaagagaggccccccccctgagccagagaccccacagaacccagggcgccggcagcccccccgagaccaacgagaagctgaccaacccccaggtgaaggagaagtag

SEQ ID NO: 86129 - DNA, 822 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactacagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccggcatcgccagacacctgcacgccgtgatcagatacagcgtggccatcatcctgttcaccatcctgcccttcttcctgctgcacagatggtgcagcaagaagaagatgctgctgtag

SEQ ID NO: 86130 - DNA, 1269 bp, Artificial Sequence
  Description of Artificial Sequence: Synthetic coding sequence
atgggcggccaggacaagcccttcctgagcgcctggcccagcgccgtggtgcccagaggcggccacgtgaccctgagatgccactacagacacagattcaacaacttcatgctgtacaaggaggacagaatccacatccccatcttccacggcagaatcttccaggagagcttcaacatgagccccgtgaccaccgcccacgccggcaactacacctgcagaggcagccacccccacagccccaccggctggagcgcccccagcaaccccgtggtgatcatggtgaccggcaaccacagaaagcccagcctgctggcccaccccggccccctggtgaagagcggcgagagagtgatcctgcagtgctggagcgacatcatgttcgagcacttcttcctgcacaaggagggcatcagcaaggaccccagcagactggtgggccagatccacgacggcgtgagcaaggccaacttcagcatcggccccatgatgctggccctggccggcacctacagatgctacggcagcgtgacccacaccccctaccagctgagcgcccccagcgaccccctggacatcgtggtgaccggcccctacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcaaccccagacacctgcacatcctgatcggcaccagcgtggtgatcatcctgttcatcctgctgctgttcttcctgctgcacctgtggtgcagcaacaagaagaacgccgccgtgatggaccaggagcccgccggcaacagaaccgccaacagcgaggacagcgacgagcaggaccccgaggaggtgacctacgcccagctggaccactgcgtgttcacccagagaaagatcaccagacccagccagagacccaagaccccccccaccgacaccatcctgtacaccgagctgcccaacgccaagcccagaagcaaggtggtgagctgcccctag

SEQ ID NO: 86131 - DNA, 1050 bp, Artificial Sequence
  Description of Artificial Sequence: Synthetic coding sequence
atgagcctgatggtggtgagcatggcctgcgtgggcctgttcctggtgcagagagccggcccccacatgggcaaccacagaaagcccagcctgctggcccaccccggccccctggtgaagagcggcgagagagtgatcctgcagtgctggagcgacatcatgttcgagcacttcttcctgcacaaggagggcatcagcaaggaccccagcagactggtgggccagatccacgacggcgtgagcaaggccaacttcagcatcggccccatgatgctggccctggccggcacctacagatgctacggcagcgtgacccacaccccctaccagctgagcgcccccagcgaccccctggacatcgtggtgaccggcccctacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcaaccccagacacctgcacatcctgatcggcaccagcgtggtgatcatcctgttcatcctgctgctgttcttcctgctgcacctgtggtgcagcaacaagaagaacgccgccgtgatggaccaggagcccgccggcaacagaaccgccaacagcgaggacagcgacgagcaggaccccgaggaggtgacctacgcccagctggaccactgcgtgttcacccagagaaagatcaccagacccagccagagacccaagaccccccccaccgacaccatcctgtacaccgagctgcccaacgccaagcccagaagcaaggtggtgagctgcccctag

SEQ ID NO: 86132 - DNA, 1335 bp, Artificial Sequence
  Description of Artificial Sequence: Synthetic coding sequence
atgagcctgatggtggtgagcatggcctgcgtgggcctgttcctggtgcagagagccggcccccacatgggcggccaggacaagcccttcctgagcgcctggcccagcgccgtggtgcccagaggcggccacgtgaccctgagatgccactacagacacagattcaacaacttcatgctgtacaaggaggacagaatccacatccccatcttccacggcagaatcttccaggagagcttcaacatgagccccgtgaccaccgcccacgccggcaactacacctgcagaggcagccacccccacagccccaccggctggagcgcccccagcaaccccgtggtgatcatggtgaccggcaaccacagaaagcccagcctgctggcccaccccggccccctggtgaagagcggcgagagagtgatcctgcagtgctggagcgacatcatgttcgagcacttcttcctgcacaaggagggcatcagcaaggaccccagcagactggtgggccagatccacgacggcgtgagcaaggccaacttcagcatcggccccatgatgctggccctggccggcacctacagatgctacggcagcgtgacccacaccccctaccagctgagcgcccccagcgaccccctggacatcgtggtgaccggcccctacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcaaccccagacacctgcacatcctgatcggcaccagcgtggtgatcatcctgttcatcctgctgctgttcttcctgctgcacctgtggtgcagcaacaagaagaacgccgccgtgatggaccaggagcccgccggcaacagaaccgccaacagcgaggacagcgacgagcaggaccccgaggaggtgacctacgcccagctggaccactgcgtgttcacccagagaaagatcaccagacccagccagagacccaagaccccccccaccgacaccatcctgtacaccgagctgcccaacgccaagcccagaagcaaggtggtgagctgcccctag

SEQ ID NO: 86133 - DNA, 1368 bp, Artificial Sequence
  Description of Artificial Sequence: Synthetic coding sequence
atgagcctgatggtggtgagcatggcctgcgtgggcctgttcctggtgcagagagccggcccccacatgggcggccaggacaagcccttcctgagcgcctggcccagcgccgtggtgcccagaggcggccacgtgaccctgagatgccactacagacacagattcaacaacttcatgctgtacaaggaggacagaatccacatccccatcttccacggcagaatcttccaggagagcttcaacatgagccccgtgaccaccgcccacgccggcaactacacctgcagaggcagccacccccacagccccaccggctggagcgcccccagcaaccccgtggtgatcatggtgaccggcaaccacagaaagcccagcctgctggcccaccccggccccctggtgaagagcggcgagagagtgatcctgcagtgctggagcgacatcatgttcgagcacttcttcctgcacaaggagggcatcagcaaggaccccagcagactggtgggccagatccacgacggcgtgagcaaggccaacttcagcatcggccccatgatgctggccctggccggcacctacagatgctacggcagcgtgacccacaccccctaccagctgagcgcccccagcgaccccctggacatcgtggtgaccggcccctacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcatctgcagacacctgcacgtgctgatcggcaccagcgtggtgatcttcctgttcatcctgctgctgttcttcctgctgtacagatggtgcagcaacaagaagaacgccgccgtgatggaccaggagcccgccggcgacagaaccgtgaacagacaggacagcgacgagcaggacccccaggaggtgacctacgcccagctggaccactgcgtgttcatccagagaaagatcagcagacccagccagagacccaagacccccctgaccgacaccagcgtgtacaccgagctgcccaacgccgagcccagaagcaaggtggtgagctgccccagagccccccagagcggcctggagggcgtgttctag

SEQ ID NO: 86134 - DNA, 1335 bp, Artificial Sequence; identical to SEQ ID NO: 86132
  Description of Artificial Sequence: Synthetic coding sequence

SEQ ID NO: 86135 - DNA, 1284 bp, Artificial Sequence
  Description of Artificial Sequence: Synthetic coding sequence
atgagcctgatggtggtgagcatggcctgcgtgggcctgttcctggtgcagagagccggcccccacatgggcggccaggacaagcccttcctgagcgcctggcccagcgccgtggtgcccagaggcggccacgtgaccctgagatgccactacagacacagattcaacaacttcatgctgtacaaggaggacagaatccacatccccatcttccacggcagaatcttccaggagagcttcaacatgagccccgtgaccaccgcccacgccggcaactacacctgcagaggcagccacccccacagccccaccggctggagcgcccccagcaaccccgtggtgatcatggtgaccggcaaccacagaaagcccagcctgctggcccaccccggccccctggtgaagagcggcgagagagtgatcctgcagtgctggagcgacatcatgttcgagcacttcttcctgcacaaggagggcatcagcaaggaccccagcagactggtgggccagatccacgacggcgtgagcaaggccaacttcagcatcggccccatgatgctggccctggccggcacctacagatgctacggcagcgtgacccacaccccctaccagctgagcgcccccagcgaccccctggacatcgtggtgaccggcccctacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagacacctgcacatcctgatcggcaccagcgtggtgatcatcctgttcatcctgctgctgttcttcctgctgcacctgtggtgcagcaacaagaagaacgccgccgtgatggaccaggagcccgccggcaacagaaccgccaacagcgaggacagcgacgagcaggaccccgaggaggtgacctacgcccagctggaccactgcgtgttcacccagagaaagatcaccagacccagccagagacccaagaccccccccaccgacaccatcctgtacaccgagctgcccaacgccaagcccagaagcaaggtggtgagctgcccctag

SEQ ID NO: 86136 - DNA, 1368 bp, Artificial Sequence
  Description of Artificial Sequence: Synthetic coding sequence
atgagcctgaccgtggtgagcatggcctgcgtgggcttcttcctgctgcagggcgcctggcccctgatgggcggccaggacaagcccttcctgagcgccagacccagcaccgtggtgcccagaggcggccacgtggccctgcagtgccactacagaagaggcttcaacaacttcatgctgtacaaggaggacagaagccacgtgcccatcttccacggcagaatcttccaggagagcttcatcatgggccccgtgacccccgcccacgccggcacctacagatgcagaggcagcagaccccacagcctgaccggctggagcgcccccagcaaccccctggtgatcatggtgaccggcaaccacagaaagcccagcctgctggcccaccccggccccctgctgaagagcggcgagaccgtgatcctgcagtgctggagcgacgtgatgttcgagcacttcttcctgcacagagagggcatcagcgaggaccccagcagactggtgggccagatccacgacggcgtgagcaaggccaacttcagcatcggccccctgatgcccgtgctggccggcacctacagatgctacggcagcgtgccccacagcccctaccagctgagcgcccccagcgaccccctggacatcgtgatcaccggcctgtacgagaagcccagcctgagcgcccagcccggccccaccgtgcaggccggcgagaacgtgaccctgagctgcagcagctggagcagctacgacatctaccacctgagcagagagggcgaggcccacgagagaagactgagagccgtgcccaaggtgaacagaaccttccaggccgacttccccctgggccccgccacccacggcggcacctacagatgcttcggcagcttcagagccctgccctgcgtgtggagcaacagcagcgaccccctgctggtgagcgtgaccggcaaccccagcagcagctggcccagccccaccgagcccagcagcaagagcggcatctgcagacacctgcacgtgctgatcggcaccagcgtggtgatcttcctgttcatcctgctgctgttcttcctgctgtacagatggtgcagcaacaagaagaacgccgccgtgatggaccaggagcccgccggcgacagaaccgtgaacagacaggacagcgacgagcaggacccccaggaggtgacctacgcccagctggaccactgcgtgttcatccagagaaagatcagcagacccagccagagacccaagacccccctgaccgacaccagcgtgtacaccgagctgcccaacgccgagcccagaagcaaggtggtgagctgccccagagccccccagagcggcctggagggcgtgttctag

SEQ ID NO: 86137 - DNA, 1047 bp, Artificial Sequence
  Description of Artificial Sequence: Synthetic coding sequence
atgagcctgatggtggtgagcatggcctgcgtgggcttcttcctgctgcagggcgcctggccccacgagggcgtgcacagaaagcccagcctgctggcccaccccggcagactggtgaagagcgaggagaccgtgatcctgcagtgctggagcgacgtgagattcgagcacttcctgctgcacagagagggcaagttcaaggacaccctgcacctgatcggcgagcaccacgacggcgtgagcaaggccaacttcagcatcggccccatgatgcaggacctggccggcacctacagatgctacggcagcgtgacccacagcccctaccagctgagcgcccccagcgaccccctggacatcgtgatcaccggcctgtacgagaagcccagcctgagcgcccagcccggccccaccgtgctggccggcgagagcgtgaccctgagctgcagcagcagaagcagctacgacatgtaccacctgagcagagagggcgaggcccacgagtgcagattcagcgccggccccaaggtgaacggcaccttccaggccgacttccccctgggccccgccacccacggcggcacctacagatgcttcggcagcttcagagacagcccctacgagtggagcaacagcagcgaccccctgctggtgagcgtgaccggcaaccccagcaacagctggcccagccccaccgagcccagcagcaagaccggcaaccccagacacctgcacatcctgatcggcaccagcgtggtgatcatcctgttcatcctgctgttcttcctgctgcacagatggtgcagcaacaagaagaacgccgccgtgatggaccaggagagcgccggcaacagaaccgccaacagcgaggacagcgacgagcaggacccccaggaggtgacctacacccagctgaaccactgcgtgttcacccagagaaagatcaccagacccagccagagacccaagaccccccccaccgacatcatcgtgtacaccgagctgcccaacgccgagagcagaagcaaggtggtgagctgcccctag

SEQ ID NO: 86138 - DNA, 1128 bp, Artificial Sequence
  Description of Artificial Sequence: Synthetic coding sequence
atgagcctgatggtggtgagcatggcctgcgtgggcttcttcctgctgcagggcgcctggccccacgagggcggccaggacaagcccctgctgagcgcctggcccagcgccgtggtgcccagaggcggccacgtgaccctgctgtgcagaagcagactgggcttcaccatcttcagcctgtacaaggaggacggcgtgcccgtgcccgagctgtacaacaagatcttctggaagagcatcctgatgggccccgtgacccccgcccacgccggcacctacagatgcagaggcagccaccccagaagccccatcgagtggagcgcccccagcaaccccctggtgatcgtggtgaccggcctgttcggcaagcccagcctgagcgcccagcccggccccaccgtgagaaccggcgagaacgtgaccctgagctgcagcagcagaagcagcttcgacatgtaccacctgagcagagagggcagagcccacgagcccagactgcccgccgtgcccagcgtgaacggcaccttccaggccgacttccccctgggccccgccacccacggcggcacctacacctgcttcggcagcctgcacgacagcccctacgagtggagcgaccccagcgaccccctgctggtgagcgtgaccggcaacagcagcagcagcagcagcagccccaccgagcccagcagcaagaccggcatcagaagacacctgcacatcctgatcggcaccagcgtggccatcatcctgttcatcatcctgttcttcttcctgctgcactgctgctgcagcaacaagaagaacgccgccgtgatggaccaggagcccgccggcgacagaaccgtgaacagagaggacagcgacgaccaggacccccaggaggtgacctacgcccagctggaccactgcgtgttcacccagaccaagatcaccagccccagccagagacccaagaccccccccaccgacaccaccatgtacatggagctgcccaacgccaagcccagaagcctgagccccgcccacaagcaccacagccaggccctgagaggcagcagcagagagaccaccgccctgagccagaacagagtggccagcagccacgtgcccgccgccggcatctag

SEQ ID NO: 86139 - DNA, 1128 bp, Artificial Sequence
  Description of Artificial Sequence: Synthetic coding sequence
atgagcctgatggtgatcagcatggcctgcgtgggcttcttcctgctgcagggcgcctggacccacgagggcggccaggacaagcccctgctgagcgcctggcccagcgccgtggtgcccagaggcggccacgtgaccctgctgtgcagaagcagactgggcttcaccatcttcagcctgtacaaggaggacggcgtgcccgtgcccgagctgtacaacaagatcttctggaagagcatcctgatgggccccgtgacccccgcccacgccggcacctacagatgcagaggcagccaccccagaagccccatcgagtggagcgcccccagcaaccccctggtgatcgtggtgaccggcctgttcggcaagcccagcctgagcgcccagcccggccccaccgtgagaaccggcgagaacgtgaccctgagctgcagcagcagaagcagcttcgacatgtaccacctgagcagagagggcagagcccacgagcccagactgcccgccgtgcccagcgtgaacggcaccttccaggccgacttccccctgggccccgccacccacggcggcacctacacctgcttcggcagcctgcacgacagcccctacgagtggagcgaccccagcgaccccctgctggtgagcgtgaccggcaacagcagcagcagcagcagcagccccaccgagcccagcagcaagaccggcatcagaagacacctgcacatcctgatcggcaccagcgtggccatcatcctgttcatcatcctgttcttcttcctgctgcactgctgctgcagcaacaagaagaacgccgccgtgatggaccaggagcccgccggcgacagaaccgtgaacagagaggacagcgacgaccaggacccccaggaggtgacctacgcccagctggaccactgcgtgttcacccagaccaagatcaccagccccagccagagacccaagaccccccccaccgacaccaccatgtacatggagctgcccaacgccaagcccagaagcctgagccccgcccacaagcaccacagccaggccctgagaggcagcagcagagagaccaccgccctgagccagaacagagtggccagcagccacgtgcccgccgccggcatctag

SEQ ID NO: 86140 - DNA, 1164 bp, Artificial Sequence
  Description of Artificial Sequence: Synthetic coding sequence
atgagcctgatggtggtgagcatggcctgcgtgggcctgttcctggtgcagagagccggcccccacatgggcggccaggacaagcccttcctgagcgcctggcccagcgccgtggtgcccagaggcggccacgtgaccctgagatgccactacagacacagattcaacaacttcatgctgtacaaggaggacagaatccacgtgcccatcttccacggcagaatcttccaggagggcttcaacatgagccccgtgaccaccgcccacgccggcaactacacctgcagaggcagccacccccacagccccaccggctggagcgcccccagcaaccccatggtgatcatggtgaccggcaaccacagaaagcccagcctgctggcccaccccggccccctggtgaagagcggcgagagagtgatcctgcagtgctggagcgacatcatgttcgagcacttcttcctgcacaaggagtggatcagcaaggaccccagcagactggtgggccagatccacgacggcgtgagcaaggccaacttcagcatcggcagcatgatgagagccctggccggcacctacagatgctacggcagcgtgacccacaccccctaccagctgagcgcccccagcgaccccctggacatcgtggtgaccggcctgtacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcaacctgagacacctgcacatcctgatcggcaccagcgtggtgaagatccccttcaccatcctgctgttcttcctgctgcacagatggtgcagcaacaagaagaacgccgccgtgatggaccaggagcccgccggcaacagaagcgagcagagaggcttctag

SEQ ID NO: 86141 - DNA, 1149 bp, Artificial Sequence
  Description of Artificial Sequence: Synthetic coding sequence
atgctgctgatggtggtgagcatggcctgcgtgggcctgttcctggtgcagagagccggcccccacatgggcggccaggacaagcccttcctgagcgcctggcccagcgccgtggtgcccagaggcggccacgtgaccctgagatgccactacagacacagattcaacaacttcatgctgtacaaggaggacagaatccacgtgcccatcttccacggcagaatcttccaggagggcttcaacatgagccccgtgaccaccgcccacgccggcaactacacctgcagaggcagccacccccacagccccaccggctggagcgcccccagcaaccccatggtgatcatggtgaccggcaaccacagaaagcccagcctgctggcccaccccggccccctggtgaagagcggcgagagagtgatcctgcagtgctggagcgacatcatgttcgagcacttcttcctgcacaaggagtggatcagcaaggaccccagcagactggtgggccagatccacgacggcgtgagcaaggccaacttcagcatcggcagcatgatgagagccctggccggcacctacagatgctacggcagcgtgacccacaccccctaccagctgagcgcccccagcgaccccctggacatcgtggtgaccggcctgtacgagaagcccagcctgagcgcccagcccggccccaaggtgcaggccggcgagagcgtgaccctgagctgcagcagcagaagcagctacgacatgtaccacctgagcagagagggcggcgcccacgagagaagactgcccgccgtgagaaaggtgaacagaaccttccaggccgacttccccctgggccccgccacccacggcggcacctacagatgcttcggcagcttcagacacagcccctacgagtggagcgaccccagcgaccccctgctggtgagcgtgaccggcaaccccagcagcagctggcccagccccaccgagcccagcagcaagagcggcaacctgagacacctgcacatcctgatcggcaccagcgtggtgaagatccccttcaccatcctgctgttcttcctgctgcacagatggtgcagcaacaagaagaagtgctgctgcaacggccccagagcctgcagagagcagaagtag

SEQ ID NO: 86142 - DNA, 1194 bp, Artificial Sequence
  Description of Artificial Sequence: Synthetic coding sequence
atgagcctgatggtggtgagcatggcctgcgtgggcttcttcctggaccagagcgtgtgggcccacgtgggcggccaggacaagcccttctgcagcgcctggcccagcgccgtggtgccccagggcggccacgtgaccctgagatgccactgcagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccggcatcgccagacacctgcacgccgtgatcagatacagcgtggccatcatcctgttcaccatcctgcccttcttcctgctgcacagatggtgcagcaagaagaaggtgagcctgaccaagcagagacccgagaacagcggcccctgcgccgaggccggctgggagcacgccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86143 - DNA, 1029 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactgcagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86144 - DNA, 1083 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactgcagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcatcgccagacacctgcacgccgtgatcagatacagcgtggccatcatcctgttcaccatcctgcccttcttcctgctgcacagatggtgcagcaagaagaagaacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86145 - DNA, 1134 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactgcagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccggcatcgccagacacctgcacgccgtgatcagatacagcgtggccatcatcctgttcaccatcctgcccttcttcctgctgcacagatggtgcagcaagaagaagaacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86146 - DNA, 1233 bp, Artificial Sequence
  Description of Artificial Sequence: Synthetic coding sequence
atgagcctgatggtggtgagcatggcctgcgtgggcttcttcctgctggagggcccctggccccacgtgggcggccaggacaagcccttcctgagcgcctggcccggcaccgtggtgagcgagggccagcacgtgaccctgcagtgcagaagcagactgggcttcaacgagttcagcctgagcaaggaggacggcatgcccgtgcccgagctgtacaacagaatcttcagaaacagcttcctgatgggccccgtgacccccgcccacgccggcacctacagatgctgcagcagccacccccacagccccaccggctggagcgcccccagcaaccccgtggtgatcatggtgaccggcgtgcacagaaagcccagcctgctggcccaccccggccccctggtgaagagcggcgagaccgtgatcctgcagtgctggagcgacgtgagattcgagagattcctgctgcacagagagggcatcaccgaggaccccctgagactgatcggccagctgcacgacgccggcagccaggtgaactacagcatgggccccatgacccccgccctggccggcacctacagatgcttcggcagcgtgacccacctgccctacgagctgagcgcccccagcgaccccctggacatcgtggtggtgggcctgtacggcaagcccagcctgagcgcccagcccggccccaccgtgcaggccggcgagaacgtgaccctgagctgcagcagcagaagcctgttcgacatctaccacctgagcagagaggccgaggccggcgagctgagactgaccgccgtgctgagagtgaacggcaccttccaggccaacttccccctgggccccgtgacccacggcggcaactacagatgcttcggcagcttcagagccctgccccacgcctggagcgaccccagcgaccccctgcccgtgagcgtgaccggcaacagcagatacctgcacgccctgatcggcaccagcgtggtgatcatccccttcgccatcctgctgttcttcctgctgcacagatggtgcgccaacaagaagaacgccgtggtgatggaccaggagcccgccggcaacagaaccgtgaacagagaggacagcgacgagcaggacccccaggaggtgacctacgcccagctgaaccactgcgtgttcacccagagaaagatcaccagacccagccagagacccaagaccccccccaccgacaccagcgtgtag

SEQ ID NO: 86147 - DNA, 1047 bp, Artificial Sequence
  Description of Artificial Sequence: Synthetic coding sequence
atgagcctgctggtggtgagcatggcctgcgtgggcttcttcctgctgcagggcgcctggccccacgagggcgtgcacagaaagcccagcctgctggcccaccccggcagactggtgaagagcgaggagaccgtgatcctgcagtgctggagcgacgtgatgttcgagcacttcctgctgcacagagagggcatgttcaacgacaccctgagactgatcggcgagcaccacgacggcgtgagcaaggccaacttcagcatcagcagaatgacccaggacctggccggcacctacagatgctacggcagcgtgacccacagcccctaccaggtgagcgcccccagcgaccccctggacatcgtgatcatcggcctgtacgagaagcccagcctgagcgcccagctgggccccaccgtgctggccggcgagaacgtgaccctgagctgcagcagcagaagcagctacgacatgtaccacctgagcagagagggcgaggcccacgagagaagactgcccgccggccccaaggtgaacggcaccttccaggccgacttccccctgggccccgccacccacggcggcacctacagatgcttcggcagcttccacgacagcccctacgagtggagcaagagcagcgaccccctgctggtgagcgtgaccggcaaccccagcaacagctggcccagccccaccgagcccagcagcaagaccggcaaccccagacacctgcacatcctgatcggcaccagcgtggtgatcatcctgttcatcctgctgttcttcctgctgcacagatggtgcagcaacaagaagaacgccgccgtgatggaccaggagagcgccggcaacagaaccgccaacagcgaggacagcgacgagcaggacccccaggaggtgacctacacccagctgaaccactgcgtgttcacccagagaaagatcaccagacccagccagagacccaagaccccccccaccgacatcatcgtgtacaccgagctgcccaacgccgagagcagaagcaaggtggtgagctgcccctag

SEQ ID NO: 86148 - DNA, 1026 bp, Artificial Sequence
  Description of Artificial Sequence: Synthetic coding sequence
atgagcctgatggtggtgagcatggtgtgcgtgggcttcttcctgctgcagggcgcctggccccacgagggcgtgcacagaaagcccagcctgctggcccaccccggccccctggtgaagagcgaggagaccgtgatcctgcagtgctggagcgacgtgagattccagcacttcctgctgcacagagagggcaagttcaaggacaccctgcacctgatcggcgagcaccacgacggcgtgagcaaggccaacttcagcatcggccccatgatgcaggacctggccggcacctacagatgctacggcagcgtgacccacagcccctaccagctgagcgcccccagcgaccccctggacatcgtgatcaccggcctgtacgagaagcccagcctgagcgcccagcccggccccaccgtgctggccggcgagagcgtgaccctgagctgcagcagcagaagcagctacgacatgtaccacctgagcagagagggcgaggcccacgagagaagattcagcgccggccccaaggtgaacggcaccttccaggccgacttccccctgggccccgccacccacggcggcacctacagatgcttcggcagcttcagagacagcccctacgagtggagcaacagcagcgaccccctgctggtgagcgtgaccggcaaccccagcaacagctggcccagccccaccgagcccagcagcgagaccggcaaccccagacacctgcacgtgctgatcggcaccagcgtggtgatcatcctgttcatcctgctgctgttcttcctgctgcacagatggtgctgcaacaagaagaacgccgtggtgatggaccaggagcccgccggcaacagaaccgtgaacagagaggacagcgacgagcaggacccccaggaggtgacctacgcccagctgaaccactgcgtgttcacccagagaaagatcaccagacccagccagagacccaagaccccccccaccgacatcatcgtgtacaccgagctgcccaacgccgagccctag

SEQ ID NO: 86149 - DNA, 1047 bp, Artificial Sequence
  Description of Artificial Sequence: Synthetic coding sequence
atgagcctgatggtggtgagcatggtgtgcgtgggcttcttcctgctgcagggcgcctggccccacgagggcgtgcacagaaagcccagcctgctggcccaccccggccccctggtgaagagcgaggagaccgtgatcctgcagtgctggagcgacgtgagattccagcacttcctgctgcacagagagggcaagttcaaggacaccctgcacctgatcggcgagcaccacgacggcgtgagcaaggccaacttcagcatcggccccatgatgcaggacctggccggcacctacagatgctacggcagcgtgacccacagcccctaccagctgagcgcccccagcgaccccctggacatcgtgatcaccggcctgtacgagaagcccagcctgagcgcccagcccggccccaccgtgctggccggcgagagcgtgaccctgagctgcagcagcagaagcagctacgacatgtaccacctgagcagagagggcgaggcccacgagagaagattcagcgccggccccaaggtgaacggcaccttccaggccgacttccccctgggccccgccacccacggcggcacctacagatgcttcggcagcttcagagacagcccctacgagtggagcaacagcagcgaccccctgctggtgagcgtgaccggcaaccccagcaacagctggcccagccccaccgagcccagcagcaagaccggcaaccccagacacctgcacatcctgatcggcaccagcgtggtgatcatcctgttcatcctgctgttcttcctgctgcacagatggtgcagcaacaagaagaacgccgccgtgatggaccaggagagcgccggcaacagaaccgccaacagcgaggacagcgacgagcaggacccccaggaggtgacctacacccagctgaaccactgcgtgttcacccagagaaagatcaccagacccagccagagacccaagaccccccccaccgacatcatcgtgtacaccgagctgcccaacgccgagagcagaagcaaggtggtgagctgcccctag

SEQ ID NO: 86150 - DNA, 1029 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactacagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86151 - DNA, 978 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcggccaggacaagcccttctgcagcgcctggcccagcgccgtggtgccccagggcggccacgtgaccctgagatgccactacagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86152 - DNA, 1194 bp, Artificial Sequence
  Description of Artificial Sequence: Synthetic coding sequence
atgagcctgatggtggtgagcatggcctgcgtgggcttcttcctggaccagagcgtgtgggcccacgtgggcggccaggacaagcccttctgcagcgcctggcccagcgccgtggtgccccagggcggccacgtgaccctgagatgccactacagaagaggcttcaacatcttcaccctgtacaagaaggacggcgtgcccgtgcccgagctgtacaacagaatcttctggaacagcttcctgatcagccccgtgacccccgcccacgccggcacctacagatgcagaggcttccacccccacagccccaccgagtggagcgcccccagcaaccccctggtgatcatggtgaccggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccggcaaccccagcagcagctggcccagccccaccgagcccagcttcaagaccggcatcgccagacacctgcacgccgtgatcagatacagcgtggccatcatcctgttcaccatcctgcccttcttcctgctgcacagatggtgcagcaagaagaaggtgagcctgaccaagcagagacccgagaacagcggcccctgcgccgaggccggctgggagcacgccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86153 - DNA, 693 bp, Artificial Sequence
  Description of Artificial Sequence: Synthetic coding sequence
atgagcatgagccccaccgtgatcatcctggcctgcctgggcttcttcctggaccagagcgtgtgggcccacgtgggcctgtacgagaagcccagcctgaccgccagacccggccccaccgtgagagccggcgagaacgtgaccctgagctgcagcagccagagcagcttcgacatctaccacctgagcagagagggcgaggcccacgagctgagactgcccgccgtgcccagcatcaacggcaccttccaggccgacttccccctgggccccgccacccacggcgagacctacagatgcttcggcagcttccacggcagcccctacgagtggagcgaccccagcgaccccctgcccgtgagcgtgaccgacgccgccgtgatgaaccaggagcccgccggccacagaaccgtgaacagagaggacagcgacgagcaggacccccaggaggtgacctacgcccagctggaccactgcatcttcacccagagaaagatcaccggccccagccagagaagcaagagacccagcaccgacaccagcgtgtgcatcgagctgcccaacgccgagcccagagccctgagccccgcccacgagcaccacagccaggccctgatgggcagcagcagagagaccaccgccctgagccagacccagctggccagcagcaacgtgcccgccgccggcatctag

SEQ ID NO: 86154 - DNA, 762 bp, Artificial Sequence
  Description of Artificial Sequence: Synthetic coding sequence
atgagctgcaccatcgagaaggccctggccgacgccaaggccctggtggagagactgagagaccacgacgacgccgccgagagcctgatcgagcagaccaccgccctgaacaagagagtggaggccatgaagcagtaccaggaggagatccaggagctgaacgaggtggccagacacagacccagaagcaccctggtgatgggcatccagcaggagaacagacagatcagagagctgcagcaggagaacaaggagctgagaaccagcctggaggagcaccagagcgccctggagctgatcatgagcaagtacagagagcagatgttcagactgctgatggccagcaagaaggacgaccccggcatcatcatgaagctgaaggagcagcacagcaagatcgacatggtgcacagaaacaagagcgagggcttcttcctggacgccagcagacacatcctggaggccccccagcacggcctggagagaagacacctggaggccaaccagaacgagctgcaggcccacgtggaccagatcaccgagatggccgccgtgatgagaaaggccatcgagatcgacgagcagcagggctgcaaggagcaggagagaatcttccagctggagcaggagaacaagggcctgagagagatcctgcagatcaccagagagagcttcctgaacctgagaaaggacgacgccagcgagagcaccagcctgagcgccctggtgaccaacagcgacctgagcctgagaaagagctag

SEQ ID NO: 86155 - DNA, 648 bp, Artificial Sequence
  Description of Artificial Sequence: Synthetic coding sequence
atggacaaccagggcgtgatctacagcgacctgaacctgccccccaaccccaagagacagcagagaaagcccaagggcaacaagaacagcatcctggccaccgagcaggagatcacctacgccgagctgaacctgcagaaggccagccaggacttccagggcaacgacaagacctaccactgcaaggacctgcccagcgcccccgagaagctgatcgtgggcatcctgggcatcatctgcctgatcctgatggccagcgtggtgaccatcgtggtgatccccagcagacactgcggccactgccccgaggagtggatcacctacagcaacagctgctactacatcggcaaggagagaagaacctgggaggagagcctgctggcctgcaccagcaagaacagcagcctgctgagcatcgacaacgaggaggagatgaagttcctgagcatcatcagccccagcagctggatcggcgtgttcagaaacagcagccaccacccctgggtgaccatgaacggcctggccttcaagcacgagatcaaggacagcgacaacgccgagctgaactgcgccgtgctgcaggtgaacagactgaagagcgcccagtgcggcagcagcatcatctaccactgcaagcacaagctgtag

SEQ ID NO: 86156 - DNA, 702 bp, Artificial Sequence
  Description of Artificial Sequence: Synthetic coding sequence
atggacaaccagggcgtgatctacagcgacctgaacctgccccccaaccccaagagacagcagagaaagcccaagggcaacaagaacagcatcctggccaccgagcaggagatcacctacgccgagctgaacctgcagaaggccagccaggacttccagggcaacgacaagacctaccactgcaaggacctgcccagcgcccccgagaagctgatcgtgggcatcctgggcatcatctgcctgatcctgatggccagcgtggtgaccatcgtggtgatccccagcaccctgatccagagacacaacaacagcagcctgaacaccagaacccagaaggccagacactgcggccactgccccgaggagtggatcacctacagcaacagctgctactacatcggcaaggagagaagaacctgggaggagagcctgctggcctgcaccagcaagaacagcagcctgctgagcatcgacaacgaggaggagatgaagttcctgagcatcatcagccccagcagctggatcggcgtgttcagaaacagcagccaccacccctgggtgaccatgaacggcctggccttcaagcacgagatcaaggacagcgacaacgccgagctgaactgcgccgtgctgcaggtgaacagactgaagagcgcccagtgcggcagcagcatcatctaccactgcaagcacaagctgtag

SEQ ID NO: 86157 - DNA, 648 bp, Artificial Sequence; identical to SEQ ID NO: 86155
  Description of Artificial Sequence: Synthetic coding sequence

SEQ ID NO: 86158 - DNA, 702 bp, Artificial Sequence; identical to SEQ ID NO: 86156
  Description of Artificial Sequence: Synthetic coding sequence

SEQ ID NO: 86159 - DNA, 696 bp, Artificial Sequence
  Description of Artificial Sequence: Synthetic coding sequence
atgaacaagcagagaggcaccttcagcgaggtgagcctggcccaggaccccaagagacagcagagaaagcccaagggcaacaagagcagcatcagcggcaccgagcaggagatcttccaggtggagctgaacctgcagaaccccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacagcagccccaacaccagaacccagaagaccagacactgcggccactgccccgaggagtggatcacctacagcaacagctgctactacatcggcaaggagagaagaacctgggaggagagcctgctggcctgcaccagcaagaacagcagcctgctgagcatcgacaacgaggaggagatgaagttcctggccagcatcctgcccagcagctggatcggcgtgttcagaaacagcagccaccacccctgggtgaccatcaacggcctggccttcaagcacaagatcaaggacagcgacaacgccgagctgaactgcgccgtgctgcaggtgaacagactgaagagcgcccagtgcggcagcagcatgatctaccactgcaagcacaagctgtag

SEQ ID NO: 86160 - DNA, 696 bp, Artificial Sequence
  Description of Artificial Sequence: Synthetic coding sequence
atgaacaagcagagaggcaccttcagcgaggtgagcctggcccaggaccccaagagacagcagagaaagcccaagggcaacaagagcagcatcagcggcaccgagcaggagatcttccaggtggagctgaacctgcagaaccccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacttcagccccaacaccagaacccagaaggccagacactgcggccactgccccgaggagtggatcacctacagcaacagctgctactacatcggcaaggagagaagaacctgggaggagagcctgctggcctgcaccagcaagaacagcagcctgctgagcatcgacaacgaggaggagatgaagttcctggccagcatcctgcccagcagctggatcggcgtgttcagaaacagcagccaccacccctgggtgaccatcaacggcctggccttcaagcacaagatcaaggacagcgacaacgccgagctgaactgcgccgtgctgcaggtgaacagactgaagagcgcccagtgcggcagcagcatgatctaccactgcaagcacaagctgtag

SEQ ID NO: 86161 - DNA, 375 bp, Artificial Sequence
  Description of Artificial Sequence: Synthetic coding sequence
atgatccccaccagacactgcggccactgccccgaggagtggatcacctacagcaacagctgctactacatcggcaaggagagaagaacctgggaggagagcctgctggcctgcaccagcaagaacagcagcctgctgagcatcgacaacgaggaggagatgaagttcctggccagcatcctgcccagcagctggatcggcgtgttcagaaacagcagccaccacccctgggtgaccatcaacggcctggccttcaagcacaagatcaaggacagcgacaacgccgagctgaactgcgccgtgctgcaggtgaacagactgaagagcgcccagtgcggcagcagcatgatctaccactgcaagcacaagctgtag

SEQ ID NO: 86162 - DNA, 774 bp, Artificial Sequence
  Description of Artificial Sequence: Synthetic coding sequence
atgagcaagcagagaggcaccttcagcgaggtgagcctggcccaggaccccaagtggcagcagagaaagcccaagggcaacaagagcagcatcagcggcaccgagcaggagatcttccaggtggagctgaacctgcagaacgccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacagcagccccaacgccagaacccagaaggccagacactgcggccactgccccgaggagtggatcacctacagcaacagctgctactacatcggcaaggagagaagaacctgggaggagagcctgcaggcctgcgccagcaagaacagcagcagcctgctgtgcatcgacaacgaggaggagatgaagttcctggccagcatcctgcccagcagctggatcggcgtgttcagaaacagcagccaccacccctgggtgaccatcaacggcctggccttcaagcacgagatcaaggacagcgaccacgccgagagaaactgcgccatgctgcacgtgagaggcctgatcagcgaccagtgcggcagcagcagaatcatcgtgagcatcagcttcagaatcaaggccctggagctggccgtgcaccagatcaagttctacatctgcagcaacagaaacgacatcatgatcgcctag

SEQ ID NO: 86163 - DNA, 723 bp, Artificial Sequence
  Description of Artificial Sequence: Synthetic coding sequence
atgagcaagcagagaggcaccttcagcgaggtgagcctggcccaggaccccaagtggcagcagagaaagcccaagggcaacaagagcagcatcagcggcaccgagcaggagatcttccaggtggagctgaacctgcagaacgccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacagcagccccaacaccagaacccagaagaccagacactgcggccactgccccgaggagtggatcacctacagcaacagctgctactacatcggcaaggagagaagaacctgggaggagagcctgcaggcctgcgccagcaagaacagcagcagcctgctgtgcatcgacaacgaggaggagatgaagttcctggccagcatcctgcccagcagctggatcggcgtgttcagaaacagcagccaccacccctgggtgaccatcaacggcctggccttcaagcacgagatcaaggacagcgaccacgccgagagaaactgcgccatgctgcacgtgagaggcctgatcagcgaccagtgcggcagcagcagaatcatcagaagaggcttcatcatgctgaccagactggtgctgaacagctag

SEQ ID NO: 86164 - DNA, 723 bp, Artificial Sequence
  Description of Artificial Sequence: Synthetic coding sequence
atgagcaagcagagaggcaccttcagcgaggtgagcctggcccaggaccccaagtggcagcagagaaagcccaagggcaacaagagcagcatcagcggcaccgagcaggagatcttccaggtggagctgaacctgcagaacgccagcctgaaccaccagggcatcgacaagatctacgactgccagggcctgctgcccccccccgagaagctgaccgccgaggtgctgggcatcatctgcatcgtgctgatggccaccgtgctgaagaccatcgtgctgatccccttcctggagcagaacaacagcagccccaacgccagaacccagaaggccagacactgcggccactgccccgaggagtggatcacctacagcaacagctgctactacatcggcaaggagagaagaacctgggaggagagcctgcaggcctgcgccagcaagaacagcagcagcctgctgtgcatcgacaacgaggaggagatgaagttcctggccagcatcctgcccagcagctggatcggcgtgttcagaaacagcagccaccacccctgggtgaccatcaacggcctggccttcaagcacgagatcaaggacagcgaccacgccgagagaaactgcgccatgctgcacgtgagaggcctgatcagcgaccagtgcggcagcagcagaatcatcagaagaggcttcatcatgctgaccagactggtgctgaacagctag

SEQ ID NO: 86165 - DNA, 477 bp, Artificial Sequence
  Description of Artificial Sequence: Synthetic coding sequence
atgaacaagcagagaggcacctacagcgaggtgagcctggcccaggaccccaagagacagcagagaaagctgaagggcaacaagatcagcatcagcggcaccaagcaggagatcttccaggtggagctgaacctgcagaacgccagcagcgaccaccagggcaacgacaagacctaccactgcaagggcctgctgcccccccccgagaagctgaccgccgaggtgctgggcatcatctgcatcgtgctgatggccaccgtgctgaagaccatcgtgctgatcccctgcatcggcgtgctggagcagaacaacttcagcctgaacagaagaatgcagaaggccagacactgcggccactgccccgaggagtggatcacctacagcaacagctgctactacatcggcaaggagagaagaacctgggaggagagagtgtgctggcccgtgctgagaagaaccctgatctgcttcctgtag

SEQ ID NO: 86166 - DNA, 540 bp, Artificial Sequence
  Description of Artificial Sequence: Synthetic coding sequence
atggccgtgttcaagaccaccctgtggagactgatcagcggcaccctgggcatcatctgcctgagcctgatgagcaccctgggcatcctgctgaagaacagcttcaccaagctgagcatcgagcccgccttcacccccggccccaacatcgagctgcagaaggacagcgactgctgcagctgccaggagaagtgggtgggctacagatgcaactgctacttcatcagcagcgagcagaagacctggaacgagagcagacacctgtgcgccagccagaagagcagcctgctgcagctgcagaacaccgacgagctggacttcatgagcagcagccagcagttctactggatcggcctgagctacagcgaggagcacaccgcctggctgtgggagaacggcagcgccctgagccagtacctgttccccagcttcgagaccttcaacaccaagaactgcatcgcctacaaccccaacggcaacgccctggacgagagctgcgaggacaagaacagatacatctgcaagcagcagctgatctag

SEQ ID NO: 86167 - DNA, 447 bp, Artificial Sequence
  Description of Artificial Sequence: Synthetic coding sequence
atggccgccttcaccaagctgagcatcgagcccgccttcacccccggccccaacatcgagctgcagaaggacagcgactgctgcagctgccaggagaagtgggtgggctacagatgcaactgctacttcatcagcagcgagcagaagacctggaacgagagcagacacctgtgcgccagccagaagagcagcctgctgcagctgcagaacaccgacgagctggacttcatgagcagcagccagcagttctactggatcggcctgagctacagcgaggagcacaccgcctggctgtgggagaacggcagcgccctgagccagtacctgttccccagcttcgagaccttcaacaccaagaactgcatcgcctacaaccccaacggcaacgccctggacgagagctgcgaggacaagaacagatacatctgcaagcagcagctgatctag

SEQ ID NO: 86168 - DNA, 540 bp, Artificial Sequence; identical to SEQ ID NO: 86166
  Description of Artificial Sequence: Synthetic coding sequence

SEQ ID NO: 86169 - DNA, 543 bp, Artificial Sequence
  Description of Artificial Sequence: Synthetic coding sequence
atggccgtgttcaagaccaccctgtggagactgatcagcggcaccctgggcatcatctgcctgagcctgatgagcaccctgggcatcctgctgaagaacagcttcaccaagctgagcatcgagcccgccttcacccccggccccaacatcgagctgcagaaggacagcgactgctgcagctgccaggagaagtgggtgggctacagatgcaactgctacttcatcagcagcgagcagaagacctggaacgagagcagacacctgtgcgccagccagaagagcagcctgctgcagctgcagaacaccgacgagctgcaggacttcatgagcagcagccagcagttctactggatcggcctgagctacagcgaggagcacaccgcctggctgtgggagaacggcagcgccctgagccagtacctgttccccagcttcgagaccttcaacaccaagaactgcatcgcctacaaccccaacggcaacgccctggacgagagctgcgaggacaagaacagatacatctgcaagcagcagctgatctag

SEQ ID NO: 86170 - DNA, 156 bp, Artificial Sequence
  Description of Artificial Sequence: Synthetic coding sequence
agcgccctgagccagtacctgttccccagcttcgagaccttcaacaccaagaactgcatcgcctacaaccccaacggcaacgccctggacgagagctgcgaggacaagaacagatacatctacaaggtgctgctgtgctgccccggctggagctag

SEQ ID NO: 86171 - DNA, 420 bp, Artificial Sequence
  Description of Artificial Sequence: Synthetic coding sequence
atggccgccttcaccaagctgagcatcgagcccgccttcacccccggccccaacatcgagctgcagaaggacagcgactgctgcagctgccaggagaagtgggtgggctacagatgcaactgctacttcatcagcagcgagcagaagacctggaacgagagcagacacctgtgcgccagccagaagagcagcctgctgcagctgcagaacaccgacgagctggacttcatgagcagcagccagcagttctactggatcggcctgagctacagcgaggagcacaccgcctggctgtgggagaacggcagcgccctgagccagtacctgttccccagcttcgagaccttcaacaccaagaactgcatcgcctacaaccccaacggcaacgccctggacgagagctgcgaggacaagaactag

SEQ ID NO: 86172 - DNA, 699 bp, Artificial Sequence
  Description of Artificial Sequence: Synthetic coding sequence
atgcaggacgaggagagatacatgaccctgaacgtgcagagcaagaagagaagcagcgcccagaccagccagctgaccttcaaggactacagcgtgaccctgcactggtacaagatcctgctgggcatcagcggcaccgtgaacggcatcctgaccctgaccctgatcagcctgatcctgctggtgagccagggcgtgctgctgaagtgccagaagggcagctgcagcaacgccacccagtacgaggacaccggcgacctgaaggtgaacaacggcaccagaagaaacatcagcaacaaggacctgtgcgccagcagaagcgccgaccagaccgtgctgtgccagagcgagtggctgaagtaccagggcaagtgctgctactggttcagcaacgagatgaagagctggagcgacagctacgtgtactgcctggagagaaagagccacctgctgatcatccacgaccagctggagatggccttcatccagaagaacctgagacagctgaactacgtgtggatcggcctgaacttcaccagcctgaagatgacctggacctgggtggacggcagccccatcgacagcaagatcttcttcatcaagggccccgccaaggagaacagctgcgccgccatcaaggagagcaagatcttcagcgagacctgcagcagcgtgttcaagtggatctgccagtactag

SEQ ID NO: 86173 - DNA, 549 bp, Artificial Sequence
  Description of Artificial Sequence: Synthetic coding sequence
atgcaggacgaggagagatacatgaccctgaacgtgcagagcaagaagagaagcagcgcccagaccagccagctgaccttcaaggactacagcgtgaccctgcactggtacaagatcctgctgggcatcagcggcaccgtgaacggcatcctgaccctgaccctgatcagcctgatcctgctggtgctgtgccagagcgagtggctgaagtaccagggcaagtgctgctactggttcagcaacgagatgaagagctggagcgacagctacgtgtactgcctggagagaaagagccacctgctgatcatccacgaccagctggagatggccttcatccagaagaacctgagacagctgaactacgtgtggatcggcctgaacttcaccagcctgaagatgacctggacctgggtggacggcagccccatcgacagcaagatcttcttcatcaagggccccgccaaggagaacagctgcgccgccatcaaggagagcaagatcttcagcgagacctgcagcagcgtgttcaagtggatctgccagtactag

SEQ ID NO: 86174 - DNA, 195 bp, Artificial Sequence
  Description of Artificial Sequence: Synthetic coding sequence
atgcaggacgaggagagatacatgaccctgaacgtgcagagcaagaagagaagcagcgcccagaccagccagctgaccttcaaggactacagcgtgaccctgcactggtacaagatcctgctgggcatcagcggcaccgtgaacggcatcctgaccctgaccctgatcagcctgatcctgctggacagcagctag

SEQ ID NO: 86175 - DNA, 588 bp, Artificial Sequence
  Description of Artificial Sequence: Synthetic coding sequence
atgaccgacagcgtgatctacagcatgctggagctgcccaccgccacccaggcccagaacgactacggcccccagcagaagagcagcagcagcagacccagctgcagctgcctggtggccatcgccctgggcctgctgaccgccgtgctgctgagcgtgctgctgtaccagtggatcctgtgccagggcagcaactacagcacctgcgccagctgccccagctgccccgacagatggatgaagtacggcaaccactgctactacttcagcgtggaggagaaggactggaacagcagcctggagttctgcctggccagagacagccacctgctggtgatcaccgacaaccaggagatgagcctgctgcaggtgttcctgagcgaggccttctgctggatcggcctgagaaacaacagcggctggagatgggaggacggcagccccctgaacttcagcagaatcagcagcaacagcttcgtgcagacctgcggcgccatcaacaagaacggcctgcaggccagcagctgcgaggtgcccctgcactgggtgtgcaagaagtgccccttcgccgaccaggccctgttctag

SEQ ID NO: 86176 - DNA, 570 bp, Artificial Sequence
  Description of Artificial Sequence: Synthetic coding sequence
atgaccgacagcgtgatctacagcatgctggagctgcccaccgccacccaggcccagaacgactacggcccccagcagaagagcagcagcagcagacccagctgcagctgcctggtggccatcgccctgggcctgctgaccgccgtgctgctgagcgtgctgctgtaccagtggatcctgtgccagggcagcaactacagcacctgcgccagctgccccagctgccccgacagatggatgaagtacggcaaccactgctactacttcagcgtggaggagaaggactggaacagcagcctggagttctgcctggccagagacagccacctgctggtgatcaccgacaaccaggagatgagcctgctgcaggtgttcctgagcgaggccttctgctggatcggcctgagaaacaacagcggctggagatgggaggacggcagccccctgaacttcagcagaatcagcagcaacagcttcgtgcagacctgcggcgccatcaacaagaacggcctgcaggccagcagctgcgaggtgcccctgcactgggtgtgcaagaaggtgagactgtag

SEQ ID NO: 86177 - DNA, 651 bp, Artificial Sequence
  Description of Artificial Sequence: Synthetic coding sequence
atgggctggatcagaggcagaagaagcagacacagctgggagatgagcgagttccacaactacaacctggacctgaagaagagcgacttcagcaccagatggcagaagcagagatgccccgtggtgaagagcaagtgcagagagaacgccagccccttcttcttctgctgcttcatcgccgtggccatgggcatcagattcatcatcatggtgaccatctggagcgccgtgttcctgaacagcctgttcaaccaggaggtgcagatccccctgaccgagagctactgcggcccctgccccaagaactggatctgctacaagaacaactgctaccagttcttcgacgagagcaagaactggtacgagagccaggccagctgcatgagccagaacgccagcctgctgaaggtgtacagcaaggaggaccaggacctgctgaagctggtgaagagctaccactggatgggcctggtgcacatccccaccaacggcagctggcagtgggaggacggcagcatcctgagccccaacctgctgaccatcatcgagatgcagaagggcgactgcgccctgtacgccagcagcttcaagggctacatcgagaactgcagcacccccaacacctacatctgcatgcagagaaccgtgtag

SEQ ID NO: 86178 - DNA, 243 bp, Artificial Sequence
  Description of Artificial Sequence: Synthetic coding sequence
atgggctggatcagaggcagaagaagcagacacagctgggagatgagcgagttccacaactacaacctggacctgaagaagagcgacttcagcaccagatggcagaagcagagatgccccgtggtgaagagcaagtgcagagagaacgccagccccttcttcttctgctgcttcatcgccgtggccatgggcatcagattcatcatcatggtgaccatctggagcgccgtgttcctgaactag

SEQ ID NO: 86179 - DNA, 651 bp, Artificial Sequence; identical to SEQ ID NO: 86177
  Description of Artificial Sequence: Synthetic coding sequence

SEQ ID NO: 86180 - DNA, 537 bp, Artificial Sequence
  Description of Artificial Sequence: Synthetic coding sequence
atggacagacccggccccggcagcgccagacccggcagaaccgtgcacgtgtggggctacagagtggagtggaaggtgagaaacggcagaaagctgcagcccagcgagtgggccggcagaggcgacctgggcggcttcaagagaagatggaaggacaccagagccaccgtgggcaccaccttcagaagaagaagcagagtgagcctggtgggcgagctgagcaagttccccctgcccagcgacagcagcggcggcaagagcagcagcagcttcgccagaggcgccctggcctggtgcagacagagaaaccccaaccccagctgcgccgccgccgagaccggcgccagaaccagcctgcccaaggagagatgcagaggctggagactgggcaactggctgcacaagcacccccaccccaacacctgccccagactgcccgcctgctggctgccccccatcctgaccgagagaggcgagagagtgcccaagctggtgcccctgctggcctgctaccccaagagcaagcccaaggactag

SEQ ID NO: 86181 - DNA, 1902 bp, Artificial Sequence
  Description of Artificial Sequence: Synthetic coding sequence
atgctgagaatgagagtgcccgccctgctggtgctgctgttctgcttcagaggcagagccggccccagcccccacttcctgcagcagcccgaggacctggtggtgctgctgggcgaggaggccagactgccctgcgccctgggcgcctactggggcctggtgcagtggaccaagagcggcctggccctgggcggccagagagacctgcccggctggagcagatactggatcagcggcaacgccgccaacggccagcacgacctgcacatcagacccgtggagctggaggacgaggccagctacgagtgccaggccacccaggccggcctgagaagcagacccgcccagctgcacgtgctggtgccccccgaggccccccaggtgctgggcggccccagcgtgagcctggtggccggcgtgcccgccaacctgacctgcagaagcagaggcgacgccagacccacccccgagctgctgtggttcagagacggcgtgctgctggacggcgccaccttccaccagaccctgctgaaggagggcacccccggcagcgtggagagcaccctgaccctgacccccttcagccacgacgacggcgccaccttcgtgtgcagagccagaagccaggccctgcccaccggcagagacaccgccatcaccctgagcctgcagtacccccccgaggtgaccctgagcgccagcccccacaccgtgcaggagggcgagaaggtgatcttcctgtgccaggccaccgcccagccccccgtgaccggctacagatgggccaagggcggcagccccgtgctgggcgccagaggccccagactggaggtggtggccgacgccagcttcctgaccgagcccgtgagctgcgaggtgagcaacgccgtgggcagcgccaacagaagcaccgccctggacgtgctgttcggccccatcctgcaggccaagcccgagcccgtgagcgtggacgtgggcgaggacgccagcttcagctgcgcctggagaggcaaccccctgcccagagtgacctggaccagaagaggcggcgcccaggtgctgggcagcggcgccaccctgagactgcccagcgtgggccccgaggacgccggcgactacgtgtgcagagccgaggccggcctgagcggcctgagaggcggcgccgccgaggccagactgaccgtgaacgccccccccgtggtgaccgccctgcacagcgcccccgccttcctgagaggccccgccagactgcagtgcctggtgttcgccagccccgcccccgacgccgtggtgtggagctgggacgagggcttcctggaggccggcagccagggcagattcctggtggagaccttccccgcccccgagagcagaggcggcctgggccccggcctgatcagcgtgctgcacatcagcggcacccaggagagcgacttcagcagaagcttcaactgcagcgccagaaacagactgggcgagggcggcgcccaggccagcctgggcagaagagacctgctgcccaccgtgagaatcgtggccggcgtggccgccgccaccaccaccctgctgatggtgatcaccggcgtggccctgtgctgctggagacacagcaaggccagcgccagcttcagcgagcagaagaacctgatgagaatccccggcagcagcgacggcagcagcagcagaggccccgaggaggaggagaccggcagcagagaggacagaggccccatcgtgcacaccgaccacagcgacctggtgctggaggagaagggcaccctggagaccaaggaccccaccaacggctactacaaggtgagaggcgtgagcccccccgccagccccgacagcagagtgaccagcttccagtggaagagccccggcatcagcaacctgccctag

SEQ ID NO: 86182 - DNA, 660 bp, Artificial Sequence
  Description of Artificial Sequence: Synthetic coding sequence
atgctgagaatgagagtgcccgccctgctggtgctgctgttctgcttcagaggcagagccggccccagcccccacttcctgcagcagcccgaggacctggtggtgctgctgggcgagggcggcgcccaggccagcctgggcagaagagccagcgccagcttcagcgagcagaagaacctgatgagaatccccggcagcagcgacggcagcagcagcagaggccccgaggaggaggagaccggcagcagagaggacagaggccccatcgtgcacaccgaccacagcgacctggtgctggaggagaagggcaccctggagaccaaggaccccaccaacggctactacaaggtgagaggcgtgagcgtgagcctgagcctgggcgaggcccccggcggcggcctgttcctgcccccccccagccccctgggcccccccggcacccccaccttctacgacttcaacccccacctgggcatggtgcccccctgcagactgtacagagccagagccggctacctgaccaccccccaccccagagccttcaccagctacatcaagcccaccagcttcggcccccccgacctggcccccggcaccccccccttcccctacgccgccttccccacccccagccaccccagactgcagacccacgtgtag

SEQ ID NO: 86183 - DNA, 2067 bp, Artificial Sequence
  Description of Artificial Sequence: Synthetic coding sequence
atgctgagaatgagagtgcccgccctgctggtgctgctgttctgcttcagaggcagagccggccccagcccccacttcctgcagcagcccgaggacctggtggtgctgctgggcgaggaggccagactgccctgcgccctgggcgcctactggggcctggtgcagtggaccaagagcggcctggccctgggcggccagagagacctgcccggctggagcagatactggatcagcggcaacgccgccaacggccagcacgacctgcacatcagacccgtggagctggaggacgaggccagctacgagtgccaggccacccaggccggcctgagaagcagacccgcccagctgcacgtgctggtgccccccgaggccccccaggtgctgggcggccccagcgtgagcctggtggccggcgtgcccgccaacctgacctgcagaagcagaggcgacgccagacccacccccgagctgctgtggttcagagacggcgtgctgctggacggcgccaccttccaccagaccctgctgaaggagggcacccccggcagcgtggagagcaccctgaccctgcccaccggcagagacaccgccatcaccctgagcctgcagtacccccccgaggtgaccctgagcgccagcccccacaccgtgcaggagggcgagaaggtgatcttcctgtgccaggccaccgcccagccccccgtgaccggctacagatgggccaagggcggcagccccgtgctgggcgccagaggccccagactggaggtggtggccgacgccagcttcctgaccgagcccgtgagctgcgaggtgagcaacgccgtgggcagcgccaacagaagcaccgccctggacgtgctgttcggccccatcctgcaggccaagcccgagcccgtgagcgtggacgtgggcgaggacgccagcttcagctgcgcctggagaggcaaccccctgcccagagtgacctggaccagaagaggcggcgcccaggtgctgggcagcggcgccaccctgagactgcccagcgtgggccccgaggacgccggcgactacgtgtgcagagccgaggccggcctgagcggcctgagaggcggcgccgccgaggccagactgaccgtgaacgccccccccgtggtgaccgccctgcacagcgcccccgccttcctgagaggccccgccagactgcagtgcctggtgttcgccagccccgcccccgacgccgtggtgtggagctgggacgagggcttcctggaggccggcagccagggcagattcctggtggagaccttccccgcccccgagagcagaggcggcctgggccccggcctgatcagcgtgctgcacatcagcggcacccaggagagcgacttcagcagaagcttcaactgcagcgccagaaacagactgggcgagggcggcgcccaggccagcctgggcagaagagacctgctgcccaccgtgagaatcgtggccggcgtggccgccgccaccaccaccctgctgatggtgatcaccggcgtggccctgtgctgctggagacacagcaaggccagcgccagcttcagcgagcagaagaacctgatgagaatccccggcagcagcgacggcagcagcagcagaggccccgaggaggaggagaccggcagcagagaggacagaggccccatcgtgcacaccgaccacagcgacctggtgctggaggagaagggcaccctggagaccaaggaccccaccaacggctactacaaggtgagaggcgtgagcgtgagcctgagcctgggcgaggcccccggcggcggcctgttcctgcccccccccagccccctgggcccccccggcacccccaccttctacgacttcaacccccacctgggcatggtgcccccctgcagactgtacagagccagagccggctacctgaccaccccccaccccagagccttcaccagctacatcaagcccaccagcttcggcccccccgacctggcccccggcaccccccccttcccctacgccgccttccccacccccagccaccccagactgcagacccacgtgtag

SEQ ID NO: 86184 - DNA, 1752 bp, Artificial Sequence
  Description of Artificial Sequence: Synthetic coding sequence
atgctgagaatgagagtgcccgccctgctggtgctgctgttctgcttcagaggcagagccggctggagcagatactggatcagcggcaacgccgccaacggccagcacgacctgcacatcagacccgtggagctggaggacgaggccagctacgagtgccaggccacccaggccggcctgagaagcagacccgcccagctgcacgtgctggtgccccccgaggccccccaggtgctgggcggccccagcgtgagcctggtggccggcgtgcccgccaacctgacctgcagaagcagaggcgacgccagacccacccccgagctgctgtggttcagagacggcgtgctgctggacggcgccaccttccaccagaccctgctgaaggagggcacccccggcagcgtggagagcaccctgaccctgacccccttcagccacgacgacggcgccaccttcgtgtgcagagccagaagccaggccctgcccaccggcagagacaccgccatcaccctgagcctgcagtacccccccgaggtgaccctgagcgccagcccccacaccgtgcaggagggcgagaaggtgatcttcctgtgccaggccaccgcccagccccccgtgaccggctacagatgggccaagggcggcagccccgtgctgggcgccagaggccccagactggaggtggtggccgacgccagcttcctgaccgagcccgtgagctgcgaggtgagcaacgccgtgggcagcgccaacagaagcaccgccctggacgtgctgttcggccccatcctgcaggccaagcccgagcccgtgagcgtggacgtgggcgaggacgccagcttcagctgcgcctggagaggcaaccccctgcccagagtgacctggaccagaagaggcggcgcccaggtgctgggcagcggcgccaccctgagactgcccagcgtgggccccgaggacgccggcgactacgtgtgcagagccgaggccggcctgagcggcctgagaggcggcgccgccgaggccagactgaccgtgaacgccccccccgtggtgaccgccctgcacagcgcccccgccttcctgagaggccccgccagactgcagtgcctggtgttcgccagccccgcccccgacgccgtggtgtggagctgggacgagggcttcctggaggccggcagccagggcagattcctggtggagaccttccccgcccccgagagcagaggcggcctgggccccggcctgatcagcgtgctgcacatcagcggcacccaggagagcgacttcagcagaagcttcaactgcagcgccagaaacagactgggcgagggcggcgcccaggccagcctgggcagaagagacctgctgcccaccgtgagaatcgtggccggcgtggccgccgccaccaccaccctgctgatggtgatcaccggcgtggccctgtgctgctggagacacagcaaggccagcgccagcttcagcgagcagaagaacctgatgagaatccccggcagcagcgacggcagcagcagcagaggccccgaggaggaggagaccggcagcagagaggacagaggccccatcgtgcacaccgaccacagcgacctggtgctggaggagaagggcaccctggagaccaaggaccccaccaacggctactacaaggtgagaggcgtgagcccccccgccagccccgacagcagagtgaccagcttccagtggaagagccccggcatcagcaacctgccctag

SEQ ID NO: 86185 - DNA, 2127 bp, Artificial Sequence
  Description of Artificial Sequence: Synthetic coding sequence
atgctgagaatgagagtgcccgccctgctggtgctgctgttctgcttcagaggcagagccggccccagcccccacttcctgcagcagcccgaggacctggtggtgctgctgggcgaggaggccagactgccctgcgccctgggcgcctactggggcctggtgcagtggaccaagagcggcctggccctgggcggccagagagacctgcccggctggagcagatactggatcagcggcaacgccgccaacggccagcacgacctgcacatcagacccgtggagctggaggacgaggccagctacgagtgccaggccacccaggccggcctgagaagcagacccgcccagctgcacgtgctggtgccccccgaggccccccaggtgctgggcggccccagcgtgagcctggtggccggcgtgcccgccaacctgacctgcagaagcagaggcgacgccagacccacccccgagctgctgtggttcagagacggcgtgctgctggacggcgccaccttccaccagaccctgctgaaggagggcacccccggcagcgtggagagcaccctgaccctgacccccttcagccacgacgacggcgccaccttcgtgtgcagagccagaagccaggccctgcccaccggcagagacaccgccatcaccctgagcctgcagtacccccccgaggtgaccctgagcgccagcccccacaccgtgcaggagggcgagaaggtgatcttcctgtgccaggccaccgcccagccccccgtgaccggctacagatgggccaagggcggcagccccgtgctgggcgccagaggccccagactggaggtggtggccgacgccagcttcctgaccgagcccgtgagctgcgaggtgagcaacgccgtgggcagcgccaacagaagcaccgccctggacgtgctgttcggccccatcctgcaggccaagcccgagcccgtgagcgtggacgtgggcgaggacgccagcttcagctgcgcctggagaggcaaccccctgcccagagtgacctggaccagaagaggcggcgcccaggtgctgggcagcggcgccaccctgagactgcccagcgtgggccccgaggacgccggcgactacgtgtgcagagccgaggccggcctgagcggcctgagaggcggcgccgccgaggccagactgaccgtgaacgccccccccgtggtgaccgccctgcacagcgcccccgccttcctgagaggccccgccagactgcagtgcctggtgttcgccagccccgcccccgacgccgtggtgtggagctgggacgagggcttcctggaggccggcagccagggcagattcctggtggagaccttccccgcccccgagagcagaggcggcctgggccccggcctgatcagcgtgctgcacatcagcggcacccaggagagcgacttcagcagaagcttcaactgcagcgccagaaacagactgggcgagggcggcgcccaggccagcctgggcagaagagacctgctgcccaccgtgagaatcgtggccggcgtggccgccgccaccaccaccctgctgatggtgatcaccggcgtggccctgtgctgctggagacacagcaaggccagcgccagcttcagcgagcagaagaacctgatgagaatccccggcagcagcgacggcagcagcagcagaggccccgaggaggaggagaccggcagcagagaggacagaggccccatcgtgcacaccgaccacagcgacctggtgctggaggagaagggcaccctggagaccaaggaccccaccaacggctactacaaggtgagaggcgtgagcgtgagcctgagcctgggcgaggcccccggcggcggcctgttcctgcccccccccagccccctgggcccccccggcacccccaccttctacgacttcaacccccacctgggcatggtgcccccctgcagactgtacagagccagagccggctacctgaccaccccccaccccagagccttcaccagctacatcaagcccaccagcttcggcccccccgacctggcccccggcaccccccccttcccctacgccgccttccccacccccagccaccccagactgcagacccacgtgtag

SEQ ID NO: 86186 - DNA, 738 bp, Artificial Sequence
  Description of Artificial Sequence: Synthetic coding sequence
atggccgtgatcatcggcgtggccgtgggcgccggcgtggccttcctggtgctgatggccaccatcgtggccttctgctgcgccagaagccagagaaacctgaagggcgtggtgagcgccaagaacgacatcagagtggagatcgtgcacaaggagcccgccagcggcagagagggcgaggagcacagcaccatcaagcagctgatgatggacagaggcgagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcccgacctgagacccgccggcaagcagagagtgcccaccggcatgagcttcaccaacatctacagcaccctgagcggccagggcagactgtacgactacggccagagattcgtgctgggcatgggcagcagcagcatcgagctgtgcgagagagagttccagagaggcagcctgagcgacagcagcagcttcctggacacccagtgcgacagcagcgtgagcagcagcggcaagcaggacggctacgtgcagttcgacaaggccagcaaggccagcgccagcagcagccaccacagccagagcagcagccagaacagcgaccccagcagacccctgcagagaagaatgcagacccacgtgtag

SEQ ID NO: 86187 - DNA, 2337 bp, Artificial Sequence
  Description of Artificial Sequence: Synthetic coding sequence
atgaagcccttccagctggacctgctgttcgtgtgcttcttcctgttcagccaggagctgggcctgcagaagagaggctgctgcctggtgctgggctacatggccaaggacaagttcagaagaatgaacgagggccaggtgtacagcttcagccagcagccccaggaccaggtggtggtgagcggccagcccgtgaccctgctgtgcgccatccccgagtacgacggcttcgtgctgtggatcaaggacggcctggccctgggcgtgggcagagacctgagcagctacccccagtacctggtggtgggcaaccacctgagcggcgagcaccacctgaagatcctgagagccgagctgcaggacgacgccgtgtacgagtgccaggccatccaggccgccatcagaagcagacccgccagactgaccgtgctggtgccccccgacgaccccgtgatcctgggcggccccgtgatcagcctgagagccggcgaccccctgaacctgacctgccacgccgacaacgccaagcccgccgccagcatcatctggctgagaaagggcgaggtgatcaacggcgccacctacagcaagaccctgctgagagacggcaagagagagagcatcgtgagcaccctgttcatcagccccggcgacgtggagaacggccagagcatcgtgtgcagagccaccaacaaggccatccccggcggcaaggagaccagcgtgaccatcgacatccagcacccccccctggtgaacctgagcgtggagccccagcccgtgctggaggacaacgtggtgaccttccactgcagcgccaaggccaaccccgccgtgacccagtacagatgggccaagagaggccagatcatcaaggaggccagcggcgaggtgtacagaaccaccgtggactacacctacttcagcgagcccgtgagctgcgaggtgaccaacgccctgggcagcaccaacctgagcagaaccgtggacgtgtacttcggccccagaatgaccaccgagccccagagcctgctggtggacctgggcagcgacgccatcttcagctgcgcctggaccggcaaccccagcctgaccatcgtgtggatgaagagaggcagcggcgtggtgctgagcaacgagaagaccctgaccctgaagagcgtgagacaggaggacgccggcaagtacgtgtgcagagccgtggtgcccagagtgggcgccggcgagagagaggtgaccctgaccgtgaacggcccccccatcatcagcagcacccagacccagcacgccctgcacggcgagaagggccagatcaagtgcttcatcagaagcacccccccccccgacagaatcgcctggagctggaaggagaacgtgctggagagcggcaccagcggcagatacaccgtggagaccatcagcaccgaggagggcgtgatcagcaccctgaccatcagcaacatcgtgagagccgacttccagaccatctacaactgcaccgcctggaacagcttcggcagcgacaccgagatcatcagactgaaggagcagggcagcgagatgaagagcggcgccggcctggaggccgagagcgtgcccatggccgtgatcatcggcgtggccgtgggcgccggcgtggccttcctggtgctgatggccaccatcgtggccttctgctgcgccagaagccagagaaacctgaagggcgtggtgagcgccaagaacgacatcagagtggagatcgtgcacaaggagcccgccagcggcagagagggcgaggagcacagcaccatcaagcagctgatgatggacagaggcgagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcccgacctgagacccgccggcaagcagagagtgcccaccggcatgagcttcaccaacatctacagcaccctgagcggccagggcagactgtacgactacggccagagattcgtgctgggcatgggcagcagcagcatcgagctgtgcgagagagagttccagagaggcagcctgagcgacagcagcagcttcctggacacccagtgcgacagcagcgtgagcagcagcggcaagcaggacggctacgtgcagttcgacaaggccagcaaggccagcgccagcagcagccaccacagccagagcagcagccagaacagcgaccccagcagacccctgcagagaagaatgcagacccacgtgtag

SEQ ID NO: 86188 - DNA, 1803 bp, Artificial Sequence
  Description of Artificial Sequence: Synthetic coding sequence
atgaagcccttccagctggacctgctgttcgtgtgcttcttcctgttcagccaggagctgggcctgcagaagagaggctgctgcctggtgctgggctacatggccaaggacaagttcagaagaatgaacgagggccaggtgtacagcttcagccagcagccccaggaccaggtggtggtgagcggccagcccgtgaccctgctgtgcgccatccccgagtacgacggcttcgtgctgtggatcaaggacggcctggccctgggcgtgggcagagacctgagcagctacccccagtacctggtggtgggcaaccacctgagcggcgagcaccacctgaagatcctgagagccgagctgcaggacgacgccgtgtacgagtgccaggccatccaggccgccatcagaagcagacccgccagactgaccgtgctggtgccccccgacgaccccgtgatcctgggcggccccgtgatcagcctgagagccggcgaccccctgaacctgacctgccacgccgacaacgccaagcccgccgccagcatcatctggctgagaaagggcgaggtgatcaacggcgccacctacagcaagaccctgctgagagacggcaagagagagagcatcgtgagcaccctgttcatcagccccggcgacgtggagaacggccagagcatcgtgtgcagagccaccaacaaggccatccccggcggcaaggagaccagcgtgaccatcgacatccagcacccccccctggtgaacctgagcgtggagccccagcccgtgctggaggacaacgtggtgaccttccactgcagcgccaaggccaaccccgccgtgacccagtacagatgggccaagagaggccagatcatcaaggaggccagcggcgaggtgtacagaaccaccgtggactacacctacttcagcgagcccgtgagctgcgaggtgaccaacgccctgggcagcaccaacctgagcagaaccgtggacgtgtacttcggccccagaatgaccaccgagccccagagcctgctggtggacctgggcagcgacgccatcttcagctgcgcctggaccggcaaccccagcctgaccatcgtgtggatgaagagaggcagcggcgtggtgctgagcaacgagaagaccctgaccctgaagagcgtgagacaggaggacgccggcaagtacgtgtgcagagccgtggtgcccagagtgggcgccggcgagagagaggtgaccctgaccgtgaacggcccccccatcatcagcagcacccagacccagcacgccctgcacggcgagaagggccagatcaagtgcttcatcagaagcacccccccccccgacagaatcgcctggagctggaaggagaacgtgctggagagcggcaccagcggcagatacaccgtggagaccatcagcaccgaggagggcgtgatcagcaccctgaccatcagcaacatcgtgagagccgacttccagaccatctacaactgcaccgcctggaacagcttcggcagcgacaccgagatcatcagactgaaggagcagggcagcgagatgaagagcggcgccggcctggaggccgagagcgtgcccatggccgtgatcatcggcgtggccgtgggcgccggcgtggccttcctggtgctgatggccaccatcgtggccttctgctgcgccagaagccagagaagcaccggcggcagaagcggcatcagcggcagaggcaccgagaagaaggccagactgagactgcccagaagagccagcaagcaggagtgcaacgagcagggcagctag

SEQ ID NO: 86189 - DNA, 2301 bp, Artificial Sequence
  Description of Artificial Sequence: Synthetic coding sequence
atgaagcccttccagctggacctgctgttcgtgtgcttcttcctgttcagccaggagctgggcctgcagaagagaggctgctgcctggtgctgggctacatggccaaggacaagttcagaagaatgaacgagggccaggtgtacagcttcagccagcagccccaggaccaggtggtggtgagcggccagcccgtgaccctgctgtgcgccatccccgagtacgacggcttcgtgctgtggatcaaggacggcctggccctgggcgtgggcagagacctgagcagctacccccagtacctggtggtgggcaaccacctgagcggcgagcaccacctgaagatcctgagagccgagctgcaggacgacgccgtgtacgagtgccaggccatccaggccgccatcagaagcagacccgccagactgaccgtgctggtgccccccgacgaccccgtgatcctgggcggccccgtgatcagcctgagagccggcgaccccctgaacctgacctgccacgccgacaacgccaagcccgccgccagcatcatctggctgagaaagggcgaggtgatcaacggcgccacctacagcaagaccctgctgagagacggcaagagagagagcatcgtgagcaccctgttcatcagccccggcgacgtggagaacggccagagcatcgtgtgcagagccaccaacaaggccatccccggcggcaaggagaccagcgtgaccatcgacatccagcacccccccctggtgaacctgagcgtggagccccagcccgtgctggaggacaacgtggtgaccttccactgcagcgccaaggccaaccccgccgtgacccagtacagatgggccaagagaggccagatcatcaaggaggccagcggcgaggtgtacagaaccaccgtggactacacctacttcagcgagcccgtgagctgcgaggtgaccaacgccctgggcagcaccaacctgagcagaaccgtggacgtgtacttcggccccagaatgaccaccgagccccagagcctgctggtggacctgggcagcgacgccatcttcagctgcgcctggaccggcaaccccagcctgaccatcgtgtggatgaagagaggcagcggcgtggtgctgagcaacgagaagaccctgaccctgaagagcgtgagacaggaggacgccggcaagtacgtgtgcagagccgtggtgcccagagtgggcgccggcgagagagaggtgaccctgaccgtgaacggcccccccatcatcagcagcacccagacccagcacgccctgcacggcgagaagggccagatcaagtgcttcatcagaagcacccccccccccgacagaatcgcctggagctggaaggagaacgtgctggagagcggcaccagcggcagatacaccgtggagaccatcagcaccgaggagggcgtgatcagcaccctgaccatcagcaacatcgtgagagccgacttccagaccatctacaactgcaccgcctggaacagcttcggcagcgacaccgagatcatcagactgaaggagcaggagagcgtgcccatggccgtgatcatcggcgtggccgtgggcgccggcgtggccttcctggtgctgatggccaccatcgtggccttctgctgcgccagaagccagagaaacctgaagggcgtggtgagcgccaagaacgacatcagagtggagatcgtgcacaaggagcccgccagcggcagagagggcgaggagcacagcaccatcaagcagctgatgatggacagaggcgagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcccgacctgagacccgccggcaagcagagagtgcccaccggcatgagcttcaccaacatctacagcaccctgagcggccagggcagactgtacgactacggccagagattcgtgctgggcatgggcagcagcagcatcgagctgtgcgagagagagttccagagaggcagcctgagcgacagcagcagcttcctggacacccagtgcgacagcagcgtgagcagcagcggcaagcaggacggctacgtgcagttcgacaaggccagcaaggccagcgccagcagcagccaccacagccagagcagcagccagaacagcgaccccagcagacccctgcagagaagaatgcagacccacgtgtag

SEQ ID NO: 86190 - DNA, 1182 bp, Artificial Sequence
  Description of Artificial Sequence: Synthetic coding sequence
atgggcaagagcgacttcctgacccccaaggccatcgccaacagaatcaagagcaagggcctgcagaagctgagatggtactgccagatgtgccagaagcagtgcagagacgagaacggcttcaagtgccactgcatgagcgagagccaccagagacagctgctgctggccagcgagaacccccagcagttcatggactacttcagcgaggagttcagaaacgacttcctggagctgctgagaagaagattcggcaccaagagagtgcacaacaacatcgtgtacaacgagtacatcagccacagagagcacatccacatgaacgccacccagtgggagaccctgaccgacttcaccaagtggctgggcagagagggcctgtgcaaggtggacgagacccccaagggctggtacatccagtacatcgacagagaccccgagaccatcagaagacagctggagctggagaagaagaagaagcaggacctggacgacgaggagaagaccgccaagttcatcgaggagcaggtgagaagaggcctggagggcaaggagcaggaggtgcccaccttcaccgagctgagcagagagaacgacgaggagaaggtgaccttcaacctgagcaagggcgcctgcagcagcagcggcgccaccagcagcaagagcagcaccctgggccccagcgccctgaagaccatcggcagcagcgccagcgtgaagagaaaggagagcagccagagcagcacccagagcaaggagaagaagaagaagaagagcgccctggacgagatcatggagatcgaggaggagaagaagagaaccgccagaaccgactactggctgcagcccgagatcatcgtgaagatcatcaccaagaagctgggcgagaagtaccacaagaagaaggccatcgtgaaggaggtgatcgacaagtacaccgccgtggtgaagatgatcgacagcggcgacaagctgaagctggaccagacccacctggagaccgtgatccccgcccccggcaagagaatcctggtgctgaacggcggctacagaggcaacgagggcaccctggagagcatcaacgagaagaccttcagcgccaccatcgtgatcgagaccggccccctgaagggcagaagagtggagggcatccagtacgaggacatcagcaagctggcctag

SEQ ID NO: 86191 - DNA, 1125 bp, Artificial Sequence
  Description of Artificial Sequence: Synthetic coding sequence
atgggcaagagcgacttcctgacccccaaggccatcgccaacagaatcaagagcaagggcctgcagaagctgagatggtactgccagatgtgccagaagcagtgcagagacgagaacggcttcaagtgccactgcatgagcgagagccaccagagacagctgctgctggccagcgagaacccccagcagttcatggactacttcagcgaggagttcagaaacgacttcctggagctgctgagaagaagattcggcaccaagagagtgcacaacaacatcgtgtacaacgagtacatcagccacagagagcacatccacatgaacgccacccagtgggagaccctgaccgacttcaccaagtggctgggcagagagggcctgtgcaaggtggacgagacccccaagggctggtacatccagtacatcgacagagaccccgagaccatcagaagacagctggagctggagaagaagaagaagcaggacctggacgacgaggagaagaccgccaagttcatcgaggagcaggtgagaagaggcctggagggcaaggagcaggaggtgcccaccttcaccgagctgagcagagagaacgacgaggagaaggtgaccttcaacctgagcaagggcgcctgcagcagcagcggcgccaccagcagcaagagcagcaccctgggccccagcgccctgaagaccatcggcagcagcgccagcgtgaagagaaaggagagcagccagagcagcacccagagcaaggagaagaagaagaagaagagcgccctggacgagatcatggagatcgaggaggagaagaagagaaccgccagaaccgactactggctgcagcccgagatcatcgtgaagatcatcaccaagaagctgggcgagaagtaccacaagaagaaggccatcgtgaaggaggtgatcgacaagtacaccgccgtggtgaagatgatcgacagcggcgacaagctgaagctggaccagacccacctggagaccgtgatccccgcccccggcaagagaatcctggtgctgaacggcggctacagaggcaacgagggcaccctggagagcatcaacgagaagaccttcagcgccaccatcgtgatcgagaccgtgtag

SEQ ID NO: 86192 - DNA, 867 bp, Artificial Sequence
  Description of Artificial Sequence: Synthetic coding sequence
atgaacgccacccagtgggagaccctgaccgacttcaccaagtggctgggcagagagggcctgtgcaaggtggacgagacccccaagggctggtacatccagtacatcgacagagaccccgagaccatcagaagacagctggagctggagaagaagaagaagcaggacctggacgacgaggagaagaccgccaagttcatcgaggagcaggtgagaagaggcctggagggcaaggagcaggaggtgcccaccttcaccgagctgagcagagagaacgacgaggagaaggtgaccttcaacctgagcaagggcgcctgcagcagcagcggcgccaccagcagcaagagcagcaccctgggccccagcgccctgaagaccatcggcagcagcgccagcgtgaagagaaaggagagcagccagagcagcacccagagcaaggagaagaagaagaagaagagcgccctggacgagatcatggagatcgaggaggagaagaagagaaccgccagaaccgactactggctgcagcccgagatcatcgtgaagatcatcaccaagaagctgggcgagaagtaccacaagaagaaggccatcgtgaaggaggtgatcgacaagtacaccgccgtggtgaagatgatcgacagcggcgacaagctgaagctggaccagacccacctggagaccgtgatccccgcccccggcaagagaatcctggtgctgaacggcggctacagaggcaacgagggcaccctggagagcatcaacgagaagaccttcagcgccaccatcgtgatcgagaccgtgagcctgttcacccagagacagaagttccagaacgccctgaagatgtgccacagcttcttctag

SEQ ID NO: 86193 - DNA, 2361 bp, Artificial Sequence
  Description of Artificial Sequence: Synthetic coding sequence
atgaacgaggccaaggtgaaggagaccctgagaagatgcggcgccagcggcgacgagtgcggcagactgcagtacgccctgacctgcctgagaaaggtgaccggcctgggcggcgagcacaaggaggacagcagctggagcagcctggacgccagaagagagagcggcagcggccccagcaccgacaccctgagcgccgccagcctgccctggccccccggcagcagccagctgggcagagccggcaacagcgcccagggccccagaagcatcagcgtgagcgccctgcccgccagcgacagccccacccccagcttcagcgagggcctgagcgacacctgcatccccctgcacgccagcggcagactgacccccagagccctgcacagcttcatcaccccccccaccaccccccagctgagaagacacaccaagctgaagccccccagaaccccccccccccccagcagaaaggtgttccagctgctgcccagcttccccaccctgaccagaagcaagagccacgagagccagctgggcaacagaatcgacgacgtgagcagcatgagattcgacctgagccacggcagcccccagatggtgagaagagacatcggcctgagcgtgacccacagattcagcaccaagagctggctgagccaggtgtgccacgtgtgccagaagagcatgatcttcggcgtgaagtgcaagcactgcagactgaagtgccacaacaagtgcaccaaggaggcccccgcctgcagaatcagcttcctgcccctgaccagactgagaagaaccgagagcgtgcccagcgacatcaacaaccccgtggacagagccgccgagccccacttcggcaccctgcccaaggccctgaccaagaaggagcacccccccgccatgaaccacctggacagcagcagcaaccccagcagcaccaccagcagcacccccagcagccccgcccccttccccaccagcagcaaccccagcagcgccaccaccccccccaaccccagccccggccagagagacagcagattcaacttccccgccgcctacttcatccaccacagacagcagttcatcttccccgtgcccagcgccggccactgctggaagtgcctgctgatcgccgagagcctgaaggagaacgccttcaacatcagcgccttcgcccacgccgcccccctgcccgaggccgccgacggcaccagactggacgaccagcccaaggccgacgtgctggaggcccacgaggccgaggccgaggagcccgaggccggcaagagcgaggccgaggacgacgaggacgaggtggacgacctgcccagcagcagaagaccctggagaggccccatcagcagaaaggccagccagaccagcgtgtacctgcaggagtgggacatccccttcgagcaggtggagctgggcgagcccatcggccagggcagatggggcagagtgcacagaggcagatggcacggcgaggtggccatcagactgctggagatggacggccacaaccaggaccacctgaagctgttcaagaaggaggtgatgaactacagacagaccagacacgagaacgtggtgctgttcatgggcgcctgcatgaaccccccccacctggccatcatcaccagcttctgcaagggcagaaccctgcacagcttcgtgagagaccccaagaccagcctggacatcaacaagaccagacagatcgcccaggagatcatcaagggcatgggctacctgcacgccaagggcatcgtgcacaaggacctgaagagcaagaacgtgttctacgacaacggcaaggtggtgatcaccgacttcggcctgttcggcatcagcggcgtggtgagagagggcagaagagagaaccagctgaagctgagccacgactggctgtgctacctggcccccgagatcgtgagagagatgacccccggcaaggacgaggaccagctgcccttcagcaaggccgccgacgtgtacgccttcggcaccgtgtggtacgagctgcaggccagagactggcccctgaagaaccaggccgccgaggccagcatctggcagatcggcagcggcgagggcatgaagagagtgctgaccagcgtgagcctgggcaaggaggtgagcgagatcctgagcgcctgctgggccttcgacctgcaggagagacccagcttcagcctgctgatggacatgctggagaagctgcccaagctgaacagaagactgagccaccccggccacttctggaagagcgccgacatcaacagcagcaaggtggtgcccagattcgagagattcggcctgggcgtgctggagagcagcaaccccaagatgtag

SEQ ID NO: 86194 - DNA, 2772 bp, Artificial Sequence
  Description of Artificial Sequence: Synthetic coding sequence
atggacagagccgccctgagagccgccgccatgggcgagaagaaggagggcggcggcggcggcgacgccgccgccgccgagggcggcgccggcgccgccgccagcagagccctgcagcagtgcggccagctgcagaagctgatcgacatcagcatcggcagcctgagaggcctgagaaccaagtgcgccgtgagcaacgacctgacccagcaggagatcagaaccctggaggccaagctggtgagatacatctgcaagcagagacagtgcaagctgagcgtggcccccggcgagagaacccccgagctgaacagctaccccagattcagcgactggctgtacaccttcaacgtgagacccgaggtggtgcaggagatccccagagacctgaccctggacgccctgctggagatgaacgaggccaaggtgaaggagaccctgagaagatgcggcgccagcggcgacgagtgcggcagactgcagtacgccctgacctgcctgagaaaggtgaccggcctgggcggcgagcacaaggaggacagcagctggagcagcctggacgccagaagagagagcggcagcggccccagcaccgacaccctgagcgccgccagcctgccctggccccccggcagcagccagctgggcagagccggcaacagcgcccagggccccagaagcatcagcgtgagcgccctgcccgccagcgacagccccacccccagcttcagcgagggcctgagcgacacctgcatccccctgcacgccagcggcagactgacccccagagccctgcacagcttcatcaccccccccaccaccccccagctgagaagacacaccaagctgaagccccccagaaccccccccccccccagcagaaaggtgttccagctgctgcccagcttccccaccctgaccagaagcaagagccacgagagccagctgggcaacagaatcgacgacgtgagcagcatgagattcgacctgagccacggcagcccccagatggtgagaagagacatcggcctgagcgtgacccacagattcagcaccaagagctggctgagccaggtgtgccacgtgtgccagaagagcatgatcttcggcgtgaagtgcaagcactgcagactgaagtgccacaacaagtgcaccaaggaggcccccgcctgcagaatcagcttcctgcccctgaccagactgagaagaaccgagagcgtgcccagcgacatcaacaaccccgtggacagagccgccgagccccacttcggcaccctgcccaaggccctgaccaagaaggagcacccccccgccatgaaccacctggacagcagcagcaaccccagcagcaccaccagcagcacccccagcagccccgcccccttccccaccagcagcaaccccagcagcgccaccaccccccccaaccccagccccggccagagagacagcagattcaacttccccgccgcctacttcatccaccacagacagcagttcatcttccccgtgcccagcgccggccactgctggaagtgcctgctgatcgccgagagcctgaaggagaacgccttcaacatcagcgccttcgcccacgccgcccccctgcccgaggccgccgacggcaccagactggacgaccagcccaaggccgacgtgctggaggcccacgaggccgaggccgaggagcccgaggccggcaagagcgaggccgaggacgacgaggacgaggtggacgacctgcccagcagcagaagaccctggagaggccccatcagcagaaaggccagccagaccagcgtgtacctgcaggagtgggacatccccttcgagcaggtggagctgggcgagcccatcggccagggcagatggggcagagtgcacagaggcagatggcacggcgaggtggccatcagactgctggagatggacggccacaaccaggaccacctgaagctgttcaagaaggaggtgatgaactacagacagaccagacacgagaacgtggtgctgttcatgggcgcctgcatgaaccccccccacctggccatcatcaccagcttctgcaagggcagaaccctgcacagcttcgtgagagaccccaagaccagcctggacatcaacaagaccagacagatcgcccaggagatcatcaagggcatgggctacctgcacgccaagggcatcgtgcacaaggacctgaagagcaagaacgtgttctacgacaacggcaaggtggtgatcaccgacttcggcctgttcggcatcagcggcgtggtgagagagggcagaagagagaaccagctgaagctgagccacgactggctgtgctacctggcccccgagatcgtgagagagatgacccccggcaaggacgaggaccagctgcccttcagcaaggccgccgacgtgtacgccttcggcaccgtgtggtacgagctgcaggccagagactggcccctgaagaaccaggccgccgaggccagcatctggcagatcggcagcggcgagggcatgaagagagtgctgaccagcgtgagcctgggcaaggaggtgagcgagatcctgagcgcctgctgggccttcgacctgcaggagagacccagcttcagcctgctgatggacatgctggagaagctgcccaagctgaacagaagactgagccaccccggccacttctggaagagcgccgacatcaacagcagcaaggtggtgcccagattcgagagattcggcctgggcgtgctggagagcagcaaccccaagatgtag

SEQ ID NO: 86195 - DNA, 2289 bp, Artificial Sequence
  Description of Artificial Sequence: Synthetic coding sequence
atgaacgaggccaaggtgaaggagaccctgagaagatgcggcgccagcggcgacgagtgcggcagactgcagtacgccctgacctgcctgagaaaggtgaccggcctgggcggcgagcacaaggaggacagcagctggagcagcctggacgccagaagagagagcggcagcggccccagcaccgacaccctgagcgccgccagcctgccctggccccccggcagcagccagctgggcagagccggcaacagcgcccagggccccagaagcatcagcgtgagcgccctgcccgccagcgacagccccacccccagcttcagcgagggcctgagcgacacctgcatccccctgcacgccagcggcagactgacccccagagccctgcacagcttcatcaccccccccaccaccccccagctgagaagacacaccaagctgaagccccccagaaccccccccccccccagcagaaaggtgttccagctgctgcccagcttccccaccctgaccagaagcaagagccacgagagccagctgggcaacagaatcgacgacgtgagcagcatgagattcgacctgagccacggcagcccccagatggtgagaagagacatcggcctgagcgtgacccacagattcagcaccaagagctggctgagccaggtgtgccacgtgtgccagaagagcatgatcttcggcgtgaagtgcaagcactgcagactgaagtgccacaacaagtgcaccaaggaggcccccgcctgcagaatcagcttcctgcccctgaccagactgagaagaaccgagagcgtgcccagcgacatcaacaaccccgtggacagagccgccgagccccacttcggcaccctgcccaaggccctgaccaagaaggagcacccccccgccatgaaccacctggacagcagcagcaaccccagcagcaccaccagcagcacccccagcagccccgcccccttccccaccagcagcaaccccagcagcgccaccaccccccccaaccccagccccggccagagagacagcagattcaacttccccgccgcctacttcatccaccacagacagcagttcatcttccccgtgcccagcgccggccactgctggaagtgcctgctgatcgccgagagcctgaaggagaacgccttcaacatcagcgccttcgcccacgccgcccccctgcccgaggccgccgacggcaccagactggacgaccagcccaaggccgacgtgctggaggcccacgaggccgaggccgaggagcccgaggccggcaagagcgaggccgaggacgacgaggacgaggtggacgacctgcccagcagcagaagaccctggagaggccccatcagcagaaaggccagccagaccagcgtgtacctgcaggagtgggacatccccttcgagcaggtggagctgggcgagcccatcggccagggcagatggggcagagtgcacagaggcagatggcacggcgaggtggccatcagactgctggagatggacggccacaaccaggaccacctgaagctgttcaagaaggaggtgatgaactacagacagaccagacacgagaacgtggtgctgttcatgggcgcctgcatgaaccccccccacctggccatcatcaccagcttctgcaagggcagaaccctgcacagcttcgtgagagaccccaagaccagcctggacatcaacaagaccagacagatcgcccaggagatcatcaagggcatgggctacctgcacgccaagggcatcgtgcacaaggacctgaagagcaagaacgtgttctacgacaacggcaaggtggtgatcaccgacttcggcctgttcggcatcagcggcgtggtgagagagggcagaagagagaaccagctgaagctgagccacgactggctgtgctacctggcccccgagatcgtgagagagatgacccccggcaaggacgaggaccagctgcccttcagcaaggccgccgacgtgtacgccttcggcaccgtgtggtacgagctgcaggccagagactggcccctgaagaaccaggccgccgaggccagcatctggcagatcggcagcggcgagggcatgaagagagtgctgaccagcgtgagcctgggcaaggaggtgagcgagatcctgagcgcctgctgggccttcgacctgcaggagagacccagcttcagcctgctgatggacatgctggagaagctgcccaagctgaacagaagactgagccaccccggccacttctggaagagcgccgagctgtag

SEQ ID NO: 86196 - DNA, 375 bp, Artificial Sequence
  Description of Artificial Sequence: Synthetic coding sequence
atgcaggccgacctggagatccccagagacctgaccctggacgccctgctggagatgaacgaggccaaggtgaaggagaccctgagaagatgcggcgccagcggcgacgagtgcggcagactgcagtacgccctgacctgcctgagaaaggtgaccggcctgggcacctggggcctgccccccagccccctgcccggcctggtgcccctgggcctgtggcccagcctgtggtgggtgatggagagaggcaagagaggccccggcttcctgggccagcccggcaaggccagagtgggctgcagccagccccccgagaagctgagccagggcccccagggcagcggcagctggtgggtgtggcccggcagaatctag

SEQ ID NO: 86197 - DNA, 1842 bp, Artificial Sequence
  Description of Artificial Sequence: Synthetic coding sequence
tgacacagcttcatcaccccccccaccaccccccagctgagaagacacaccaagctgaagccccccagaaccccccccccccccagcagaaaggtgttccagctgctgcccagcttccccaccctgaccagaagcaagagccacgagagccagctgggcaacagaatcgacgacgtgagcagcatgagattcgacctgagccacggcagcccccagatggtgagaagagacatcggcctgagcgtgacccacagattcagcaccaagagctggctgagccaggtgtgccacgtgtgccagaagagcatgatcttcggcgtgaagtgcaagcactgcagactgaagtgccacaacaagtgcaccaaggaggcccccgcctgcagaatcagcttcctgcccctgaccagactgagaagaaccgagagcgtgcccagcgacatcaacaaccccgtggacagagccgccgagccccacttcggcaccctgcccaaggccctgaccaagaaggagcacccccccgccatgaaccacctggacagcagcagcaaccccagcagcaccaccagcagcacccccagcagccccgcccccttccccaccagcagcaaccccagcagcgccaccaccccccccaaccccagccccggccagagagacagcagattcaacttccccgccgcctacttcatccaccacagacagcagttcatcttccccgacatcagcgccttcgcccacgccgcccccctgcccgaggccgccgacggcaccagactggacgaccagcccaaggccgacgtgctggaggcccacgaggccgaggccgaggagcccgaggccggcaagagcgaggccgaggacgacgaggacgaggtggacgacctgcccagcagcagaagaccctggagaggccccatcagcagaaaggccagccagaccagcgtgtacctgcaggagtgggacatccccttcgagcaggtggagctgggcgagcccatcggccagggcagatggggcagagtgcacagaggcagatggcacggcgaggtggccatcagactgctggagatggacggccacaaccaggaccacctgaagctgttcaagaaggaggtgatgaactacagacagaccagacacgagaacgtggtgctgttcatgggcgcctgcatgaaccccccccacctggccatcatcaccagcttctgcaagggcagaaccctgcacagcttcgtgagagaccccaagaccagcctggacatcaacaagaccagacagatcgcccaggagatcatcaagggcatgggctacctgcacgccaagggcatcgtgcacaaggacctgaagagcaagaacgtgttctacgacaacggcaaggtggtgatcaccgacttcggcctgttcggcatcagcggcgtggtgagagagggcagaagagagaaccagctgaagctgagccacgactggctgtgctacctggcccccgagatcgtgagagagatgacccccggcaaggacgaggaccagctgcccttcagcaaggccgccgacgtgtacgccttcggcaccgtgtggtacgagctgcaggccagagactggcccctgaagaaccaggccgccgaggccagcatctggcagatcggcagcggcgagggcatgaagagagtgctgaccagcgtgagcctgggcaaggaggtgagcgagatcctgagcgcctgctgggccttcgacctgcaggagagacccagcttcagcctgctgatggacatgctggagaagctgcccaagctgaacagaagactgagccaccccggccacttctggaagagcgccgagctgtag

SEQ ID NO: 86198 - DNA, 2634 bp, Artificial Sequence
  Description of Artificial Sequence: Synthetic coding sequence
atggacagagccgccctgagagccgccgccatgggcgagaagaaggagggcggcggcggcggcgacgccgccgccgccgagggcggcgccggcgccgccgccagcagagccctgcagcagtgcggccagctgcagaagctgatcgacatcagcatcggcagcctgagaggcctgagaaccaagtgcgccgtgagcaacgacctgacccagcaggagatcagaaccctggaggccaagctggtgagatacatctgcaagcagagacagtgcaagctgagcgtggcccccggcgagagaacccccgagctgaacagctaccccagattcagcgactggctgtacaccttcaacgtgagacccgaggtggtgcaggagatccccagagacctgaccctggacgccctgctggagatgaacgaggccaaggtgaaggagaccctgagaagatgcggcgccagcggcgacgagtgcggcagactgcagtacgccctgacctgcctgagaaaggtgaccggcctgggcggcgagcacaaggaggacagcagctggagcagcctggacgccagaagagagagcggcagcggccccagcaccgacaccctgagcgccgccagcctgccctggccccccggcagcagccagctgggcagagccggcaacagcgcccagggccccagaagcatcagcgtgagcgccctgcccgccagcgacagccccacccccagcttcagcgagggcctgagcgacacctgcatccccctgcacgccagcggcagactgacccccagagccctgcacagcttcatcaccccccccaccaccccccagctgagaagacacaccaagctgaagccccccagaaccccccccccccccagcagaaaggtgttccagctgctgcccagcttccccaccctgaccagaagcaagagccacgagagccagctgggcaacagaatcgacgacgtgagcagcatgagattcgacctgagccacggcagcccccagatggtgagaagagacatcggcctgagcgtgacccacagattcagcaccaagagctggctgagccaggtgtgccacgtgtgccagaagagcatgatcttcggcgtgaagtgcaagcactgcagactgaagtgccacaacaagtgcaccaaggaggcccccgcctgcagaatcagcttcctgcccctgaccagactgagaagaaccgagagcgtgcccagcgacatcaacaaccccgtggacagagccgccgagccccacttcggcaccctgcccaaggccctgaccaagaaggagcacccccccgccatgaaccacctggacagcagcagcaaccccagcagcaccaccagcagcacccccagcagccccgcccccttccccaccagcagcaaccccagcagcgccaccaccccccccaaccccagccccggccagagagacagcagattcaacttccccgccgcctacttcatccaccacagacagcagttcatcttccccgacatcagcgccttcgcccacgccgcccccctgcccgaggccgccgacggcaccagactggacgaccagcccaaggccgacgtgctggaggcccacgaggccgaggccgaggagcccgaggccggcaagagcgaggccgaggacgacgaggacgaggtggacgacctgcccagcagcagaagaccctggagaggccccatcagcagaaaggccagccagaccagcgtgtacctgcaggagtgggacatccccttcgagcaggtggagctgggcgagcccatcggccagggcagatggggcagagtgcacagaggcagatggcacggcgaggtggccatcagactgctggagatggacggccacaaccaggaccacctgaagctgttcaagaaggaggtgatgaactacagacagaccagacacgagaacgtggtgctgttcatgggcgcctgcatgaaccccccccacctggccatcatcaccagcttctgcaagggcagaaccctgcacagcttcgtgagagaccccaagaccagcctggacatcaacaagaccagacagatcgcccaggagatcatcaagggcatgggctacctgcacgccaagggcatcgtgcacaaggacctgaagagcaagaacgtgttctacgacaacggcaaggtggtgatcaccgacttcggcctgttcggcatcagcggcgtggtgagagagggcagaagagagaaccagctgaagctgagccacgactggctgtgctacctggcccccgagatcgtgagagagatgacccccggcaaggacgaggaccagctgcccttcagcaaggccgccgacgtgtacgccttcggcaccgtgtggtacgagctgcaggccagagactggcccctgaagaaccaggccgccgaggccagcatctggcagatcggcagcggcgagggcatgaagagagtgctgaccagcgtgagcctgggcaaggaggtgagcgagatcctgagcgcctgctgggccttcgacctgcaggagagacccagcttcagcctgctgatggacatgctggagaagctgcccaagctgaacagaagactgagccaccccggccacttctggaagagcgccgagctgtag

SEQ ID NO: 86199 - DNA, 1311 bp, Artificial Sequence
  Description of Artificial Sequence: Synthetic coding sequence
atgtacaacaagaaggccaagatggagcccaacgccagcgagagcgccatccccgccagaagacagagacagcccagagccaagaagaagagcaagcccctgaacctgaagatccacagcagcgtgggcagctgcgagaacatccccagccagcagagaagccccctgctgagcgagagaagcctgagaagcttcttcgtgggccacgcccccttcctgcccagcaccccccccgtgcacaccgaggccaacttcagcgccaacaccctgagcgtgcccagatggagcccccagatccccagaagagacctgggcaacagcatcaagcacagattcagcaccaagtactggatgagccagacctgcaccgtgtgcggcaagggcatgctgttcggcctgaagtgcaagaactgcaagctgaagtgccacaacaagtgcaccaaggaggcccccccctgccacctgctgatcatccacagaggcgaccccgccagactggtgagaaccgagagcgtgccctgcgacatcaacaaccccctgagaaagccccccagatacagcgacctgcacatcagccagaccctgcccaagaccaacaagatcaacaaggaccacatccccgtgccctaccagcccgacagcagcagcaaccccagcagcaccaccagcagcacccccagcagccccgccccccccctgccccccagcgccaccccccccagccccctgcaccccagcccccagtgcaccagacagcagaagaacttcaacctgcccgccagccactactacaagtacaagcagcagttcatcttccccgacgtggtgcccgtgcccgagacccccaccagagccccccaggtgatcctgcaccccgtgaccagcaaccccatcctggagggcaaccccctgctgcagatcgaggtggagcccaccagcgagaacgaggaggtgcacgacgaggccgaggagagcgaggacgacttcgaggagatgaacctgagcctgctgagcgccagaagcttccccagaaaggccagccagaccagcatcttcctgcaggagtgggacatccccttcgagcagctggagatcggcgagctgatcggcaagggcagattcggccaggtgtaccacggcagatggcacggcgaggtggccatcagactgatcgacatcgagagagacaacgaggaccagctgaaggccttcaagagagaggtgatggcctacagacagaccagacacgagaacgtggtgctgttcatgggcgcctgcatgagccccccccacctggccatcatcacctag

SEQ ID NO: 86200 - DNA, 2853 bp, Artificial Sequence
  Description of Artificial Sequence: Synthetic coding sequence
atggacgaggagaacatgaccaagagcgaggagcagcagcccctgagcctgcagaaggccctgcagcagtgcgagctggtgcagaacatgatcgacctgagcatcagcaacctggagggcctgagaaccaagtgcgccaccagcaacgacctgacccagaaggagatcagaaccctggagagcaagctggtgaagtacttcagcagacagctgagctgcaagaagaaggtggccctgcaggagagaaacgccgagctggacggcttcccccagctgagacactggttcagaatcgtggacgtgagaaaggaggtgctggaggagatcagccccggccagctgagcctggaggacctgctggagatgaccgacgagcaggtgtgcgagaccgtggagaagtacggcgccaacagagaggagtgcgccagactgaacgccagcctgagctgcctgagaaacgtgcacatgagcggcggcaacctgagcaagcaggactggaccatccagtggcccaccaccgagaccggcaaggagaacaaccccgtgtgcccccccgagcccaccccctggatcagaacccacctgagccagagccccagagtgcccagcaagtgcgtgcagcactactgccacaccagccccacccccggcgcccccgtgtacacccacgtggacagactgaccgtggacgcctaccccggcctgtgcccccccccccccctggagagcggccacagaagcctgccccccagccccagacagagacacgccgtgagaaccccccccagaacccccaacatcgtgaccaccgtgaccccccccggcaccccccccatgagaaagaagaacaagctgaagccccccggcacccccccccccagcagcagaaagctgatccacctgatccccggcttcaccgccctgcacagaagcaagagccacgagttccagctgggccacagagtggacgaggcccacacccccaaggccaagaagaagagcaagcccctgaacctgaagatccacagcagcgtgggcagctgcgagaacatccccagccagcagagaagccccctgctgagcgagagaagcctgagaagcttcttcgtgggccacgcccccttcctgcccagcaccccccccgtgcacaccgaggccaacttcagcgccaacaccctgagcgtgcccagatggagcccccagatccccagaagagacctgggcaacagcatcaagcacagattcagcaccaagtactggatgagccagacctgcaccgtgtgcggcaagggcatgctgttcggcctgaagtgcaagaactgcaagctgaagtgccacaacaagtgcaccaaggaggcccccccctgccacctgctgatcatccacagaggcgaccccgccagactggtgagaaccgagagcgtgccctgcgacatcaacaaccccctgagaaagccccccagatacagcgacctgcacatcagccagaccctgcccaagaccaacaagatcaacaaggaccacatccccgtgccctaccagcccgacagcagcagcaaccccagcagcaccaccagcagcacccccagcagccccgccccccccctgccccccagcgccaccccccccagccccctgcaccccagcccccagtgcaccagacagcagaagaacttcaacctgcccgccagccactactacaagtacaagcagcagttcatcttccccgacgtggtgcccgtgcccgagacccccaccagagccccccaggtgatcctgcaccccgtgaccagcaaccccatcctggagggcaaccccctgctgcagatcgaggtggagcccaccagcgagaacgaggaggtgcacgacgaggccgaggagagcgaggacgacttcgaggagatgaacctgagcctgctgagcgccagaagcttccccagaaaggccagccagaccagcatcttcctgcaggagtgggacatccccttcgagcagctggagatcggcgagctgatcggcaagggcagattcggccaggtgtaccacggcagatggcacggcgaggtggccatcagactgatcgacatcgagagagacaacgaggaccagctgaaggccttcaagagagaggtgatggcctacagacagaccagacacgagaacgtggtgctgttcatgggcgcctgcatgagccccccccacctggccatcatcaccagcctgtgcaagggcagaaccctgtacagcgtggtgagagacgccaagatcgtgctggacgtgaacaagaccagacagatcgcccaggagatcgtgaagggcatgggctacctgcacgccaagggcatcctgcacaaggacctgaagagcaagaacgtgttctacgacaacggcaaggtggtgatcaccgacttcggcctgttcagcatcagcggcgtgctgcaggccggcagaagagaggacaagctgagaatccagaacggctggctgtgccacctggcccccgagatcatcagacagctgagccccgacaccgaggaggacaagctgcccttcagcaagcacagcgacgtgttcgccctgggcaccatctggtacgagctgcacgccagagagtggcccttcaagacccagcccgccgaggccatcatctggcagatgggcaccggcatgaagcccaacctgagccagatcggcatgggcaaggagatcagcgacatcctgctgttctgctgggccttcgagcaggaggagagacccaccttcaccaagctgatggacatgctggagaagctgcccaagagaaacagaagactgagccaccccggccacttctggaagagcgccgagctgtag

SEQ ID NO: 86201 - DNA, 2766 bp, Artificial Sequence
  Description of Artificial Sequence: Synthetic coding sequence
atgatcgacctgagcatcagcaacctggagggcctgagaaccaagtgcgccaccagcaacgacctgacccagaaggagatcagaaccctggagagcaagctggtgaagtacttcagcagacagctgagctgcaagaagaaggtggccctgcaggagagaaacgccgagctggacggcttcccccagctgagacactggttcagaatcgtggacgtgagaaaggaggtgctggaggagatcagccccggccagctgagcctggaggacctgctggagatgaccgacgagcaggtgtgcgagaccgtggagaagtacggcgccaacagagaggagtgcgccagactgaacgccagcctgagctgcctgagaaacgtgcacatgagcggcggcaacctgagcaagcaggactggaccatccagtggcccaccaccgagaccggcaaggagaacaaccccgtgtgcccccccgagcccaccccctggatcagaacccacctgagccagagccccagagtgcccagcaagtgcgtgcagcactactgccacaccagccccacccccggcgcccccgtgtacacccacgtggacagactgaccgtggacgcctaccccggcctgtgcccccccccccccctggagagcggccacagaagcctgccccccagccccagacagagacacgccgtgagaaccccccccagaacccccaacatcgtgaccaccgtgaccccccccggcaccccccccatgagaaagaagaacaagctgaagccccccggcacccccccccccagcagcagaaagctgatccacctgatccccggcttcaccgccctgcacagaagcaagagccacgagttccagctgggccacagagtggacgaggcccacacccccaaggccaagaagaagagcaagcccctgaacctgaagatccacagcagcgtgggcagctgcgagaacatccccagccagcagagaagccccctgctgagcgagagaagcctgagaagcttcttcgtgggccacgcccccttcctgcccagcaccccccccgtgcacaccgaggccaacttcagcgccaacaccctgagcgtgcccagatggagcccccagatccccagaagagacctgggcaacagcatcaagcacagattcagcaccaagtactggatgagccagacctgcaccgtgtgcggcaagggcatgctgttcggcctgaagtgcaagaactgcaagctgaagtgccacaacaagtgcaccaaggaggcccccccctgccacctgctgatcatccacagaggcgaccccgccagactggtgagaaccgagagcgtgccctgcgacatcaacaaccccctgagaaagccccccagatacagcgacctgcacatcagccagaccctgcccaagaccaacaagatcaacaaggaccacatccccgtgccctaccagcccgacagcagcagcaaccccagcagcaccaccagcagcacccccagcagccccgccccccccctgccccccagcgccaccccccccagccccctgcaccccagcccccagtgcaccagacagcagaagaacttcaacctgcccgccagccactactacaagtacaagcagcagttcatcttccccgacgtggtgcccgtgcccgagacccccaccagagccccccaggtgatcctgcaccccgtgaccagcaaccccatcctggagggcaaccccctgctgcagatcgaggtggagcccaccagcgagaacgaggaggtgcacgacgaggccgaggagagcgaggacgacttcgaggagatgaacctgagcctgctgagcgccagaagcttccccagaaaggccagccagaccagcatcttcctgcaggagtgggacatccccttcgagcagctggagatcggcgagctgatcggcaagggcagattcggccaggtgtaccacggcagatggcacggcgaggtggccatcagactgatcgacatcgagagagacaacgaggaccagctgaaggccttcaagagagaggtgatggcctacagacagaccagacacgagaacgtggtgctgttcatgggcgcctgcatgagccccccccacctggccatcatcaccagcctgtgcaagggcagaaccctgtacagcgtggtgagagacgccaagatcgtgctggacgtgaacaagaccagacagatcgcccaggagatcgtgaagggcatgggctacctgcacgccaagggcatcctgcacaaggacctgaagagcaagaacgtgttctacgacaacggcaaggtggtgatcaccgacttcggcctgttcagcatcagcggcgtgctgcaggccggcagaagagaggacaagctgagaatccagaacggctggctgtgccacctggcccccgagatcatcagacagctgagccccgacaccgaggaggacaagctgcccttcagcaagcacagcgacgtgttcgccctgggcaccatctggtacgagctgcacgccagagagtggcccttcaagacccagcccgccgaggccatcatctggcagatgggcaccggcatgaagcccaacctgagccagatcggcatgggcaaggagatcagcgacatcctgctgttctgctgggccttcgagcaggaggagagacccaccttcaccaagctgatggacatgctggagaagctgcccaagagaaacagaagactgagccaccccggccacttctggaagagcgccgagctgtag

SEQ ID NO: 86202 - DNA, 1245 bp, Artificial Sequence
  Description of Artificial Sequence: Synthetic coding sequence
agagccaagaagaagagcaagcccctgaacctgaagatccacagcagcgtgggcagctgcgagaacatccccagccagcagagaagccccctgctgagcgagagaagcctgagaagcttcttcgtgggccacgcccccttcctgcccagcaccccccccgtgcacaccgaggccaacttcagcgccaacaccctgagcgtgcccagatggagcccccagatccccagaagagacctgggcaacagcatcaagcacagattcagcaccaagtactggatgagccagacctgcaccgtgtgcggcaagggcatgctgttcggcctgaagtgcaagaactgcaagctgaagtgccacaacaagtgcaccaaggaggcccccccctgccacctgctgatcatccacagaggcgaccccgccagactggtgagaaccgagagcgtgccctgcgacatcaacaaccccctgagaaagccccccagatacagcgacctgcacatcagccagaccctgcccaagaccaacaagatcaacaaggaccacatccccgtgccctaccagcccgacagcagcagcaaccccagcagcaccaccagcagcacccccagcagccccgccccccccctgccccccagcgccaccccccccagccccctgcaccccagcccccagtgcaccagacagcagaagaacttcaacctgcccgccagccactactacaagtacaagcagcagttcatcttccccgacgtggtgcccgtgcccgagacccccaccagagccccccaggtgatcctgcaccccgtgaccagcaaccccatcctggagggcaaccccctgctgcagatcgaggtggagcccaccagcgagaacgaggaggtgcacgacgaggccgaggagagcgaggacgacttcgaggagatgaacctgagcctgctgagcgccagaagcttccccagaaaggccagccagaccagcatcttcctgcaggagtgggacatccccttcgagcagctggagatcggcgagctgatcggcaagggcagattcggccaggtgtaccacggcagatggcacggcgaggtggccatcagactgatcgacatcgagagagacaacgaggaccagctgaaggccttcaagagagaggtgatggcctacagacagaccagacacgagaacgtggtgctgttcatgggcgcctgcatgagccccccccacctggccatcatcaccagacccgtgtag

SEQ ID NO: 86203 - DNA, 3921 bp, Artificial Sequence
  Description of Artificial Sequence: Synthetic coding sequence
atggagttctacgagagcgcctacttcatcgtgctgatccccagcatcgtgatcaccgtgatcttcctgttcttctggctgttcatgaaggagaccctgtacgacgaggtgctggccaagcagaagagagagcagaagctgatccccaccaagaccgacaagaagaaggccgagaagaagaagaacaagaagaaggagatccagaacggcaacctgcacgagagcgacagcgagagcgtgcccagagacttcaagctgagcgacgccctggccgtggaggacgaccaggtggcccccgtgcccctgaacgtggtggagaccagcagcagcgtgagagagagaaagaagaaggagaagaagcagaagcccgtgctggaggagcaggtgatcaaggagagcgacgccagcaagatccccggcaagaaggtggagcccgtgcccgtgaccaagcagcccaccccccccagcgaggccgccgccagcaagaagaagcccggccagaagaagagcaagaacggcagcgacgaccaggacaagaaggtggagaccctgatggtgcccagcaagagacaggaggccctgcccctgcaccaggagaccaagcaggagagcggcagcggcaagaagaaggccagcagcaagaagcagaagaccgagaacgtgttcgtggacgagcccctgatccacgccaccacctacatccccctgatggacaacgccgacagcagccccgtggtggacaagagagaggtgatcgacctgctgaagcccgaccaggtggagggcatccagaagagcggcaccaagaagctgaagaccgagaccgacaaggagaacgccgaggtgaagttcaaggacttcctgctgagcctgaagaccatgatgttcagcgaggacgaggccctgtgcgtggtggacctgctgaaggagaagagcggcgtgatccaggacgccctgaagaagagcagcaagggcgagctgaccaccctgatccaccagctgcaggagaaggacaagctgctggccgccgtgaaggaggacgccgccgccaccaaggacagatgcaagcagctgacccaggagatgatgaccgagaaggagagaagcaacgtggtgatcaccagaatgaaggacagaatcggcaccctggagaaggagcacaacgtgttccagaacaagatccacgtgagctaccaggagacccagcagatgcagatgaagttccagcaggtgagagagcagatggaggccgagatcgcccacctgaagcaggagaacggcatcctgagagacgccgtgagcaacaccaccaaccagctggagagcaagcagagcgccgagctgaacaagctgagacaggactacgccagactggtgaacgagctgaccgagaagaccggcaagctgcagcaggaggaggtgcagaagaagaacgccgagcaggccgccacccagctgaaggtgcagctgcaggaggccgagagaagatgggaggaggtgcagagctacatcagaaagagaaccgccgagcacgaggccgcccagcaggacctgcagagcaagttcgtggccaaggagaacgaggtgcagagcctgcacagcaagctgaccgacaccctggtgagcaagcagcagctggagcagagactgatgcagctgatggagagcgagcagaagagagtgaacaaggaggagagcctgcagatgcaggtgcaggacatcctggagcagaacgaggccctgaaggcccagatccagcagttccacagccagatcgccgcccagaccagcgccagcgtgctggccgaggagctgcacaaggtgatcgccgagaaggacaagcagatcaagcagaccgaggacagcctggccagcgagagagacagactgaccagcaaggaggaggagctgaaggacatccagaacatgaacttcctgctgaaggccgaggtgcagaagctgcaggccctggccaacgagcaggccgccgccgcccacgagctggagaagatgcagcagagcgtgtacgtgaaggacgacaagatcagactgctggaggagcagctgcagcacgagatcagcaacaagatggaggagttcaagatcctgaacgaccagaacaaggccctgaagagcgaggtgcagaagctgcagaccctggtgagcgagcagcccaacaaggacgtggtggagcagatggagaagtgcatccaggagaaggacgagaagctgaagaccgtggaggagctgctggagaccggcctgatccaggtggccaccaaggaggaggagctgaacgccatcagaaccgagaacagcagcctgaccaaggaggtgcaggacctgaaggccaagcagaacgaccaggtgagcttcgccagcctggtggaggagctgaagaaggtgatccacgagaaggacggcaagatcaagagcgtggaggagctgctggaggccgagctgctgaaggtggccaacaaggagaagaccgtgcagctgagcatcaccagcaaggtgcaggagctgcagaacctgctgaagggcaaggaggagcagatgaacaccatgaaggccgtgctggaggagaaggagaaggacctggccaacaccggcaagtggctgcaggacctgcaggaggagaacgagagcctgaaggcccacgtgcaggaggtggcccagcacaacctgaaggaggccagcagcgccagccagttcgaggagctggagatcgtgctgaaggagaaggagaacgagctgaagagactggaggccatgctgaaggagagagagagcgacctgagcagcaagacccagctgctgcaggacgtgcaggacgagaacaagctgttcaagagccagatcgagcagctgaagcagcagaactaccagcaggccagcagcttccccccccacgaggagctgctgaaggtgatcagcgagagagagaaggagatcagcggcctgtggaacgagctggacagcctgaaggacgccgtggagcaccagagaaagaagaacaacgacctgagagagaagaactgggaggccatggaggccctggccagcaccgagaagatgctgcaggacaaggtgaacaagaccagcaaggagagacagcagcaggtggaggccgtggagctggaggccaaggaggtgctgaagaagctgttccccaaggtgagcgtgcccagcaacctgagctacggcgagtggctgcacggcttcgagaagaaggccaaggagtgcatggccggcaccagcggcagcgaggaggtgaaggtgctggagcacaagctgaaggaggccgacgagatgcacaccctgctgcagctggagtgcgagaagtacaagagcgtgctggccgagaccgagggcatcctgcagaagctgcagagaagcgtggagcaggaggagaacaagtggaaggtgaaggtggacgagagccacaagaccatcaagcagatgcagagcagcttcaccagcagcgagcaggagctggagagactgagaagcgagaacaaggacatcgagaacctgagaagagagagagagcacctggagatggagctggagaaggccgagatggagagaagcacctacgtgaccgaggtgagagagctgaaggcccagctgaacgagaccctgaccaagctgagaaccgagcagaacgagagacagaaggtggccggcgacctgcacaaggcccagcagagcctggagctgatccagagcaagatcgtgaaggccgccggcgacaccaccgtgatcgagaacagcgacgtgagccccgagaccgagagcagcgagaaggagaccatgagcgtgagcctgaaccagaccgtgacccagctgcagcagctgctgcaggccgtgaaccagcagctgaccaaggagaaggagcactaccaggtgctggagtag

SEQ ID NO: 86204 - DNA, 4074 bp, Artificial Sequence
  Description of Artificial Sequence: Synthetic coding sequence
atggagttctacgagagcgcctacttcatcgtgctgatccccagcatcgtgatcaccgtgatcttcctgttcttctggctgttcatgaaggagaccctgtacgacgaggtgctggccaagcagaagagagagcagaagctgatccccaccaagaccgacaagaagaaggccgagaagaagaagaacaagaagaaggagatccagaacggcaacctgcacgagagcgacagcgagagcgtgcccagagacttcaagctgagcgacgccctggccgtggaggacgaccaggtggcccccgtgcccctgaacgtggtggagaccagcagcagcgtgagagagagaaagaagaaggagaagaagcagaagcccgtgctggaggagcaggtgatcaaggagagcgacgccagcaagatccccggcaagaaggtggagcccgtgcccgtgaccaagcagcccaccccccccagcgaggccgccgccagcaagaagaagcccggccagaagaagagcaagaacggcagcgacgaccaggacaagaaggtggagaccctgatggtgcccagcaagagacaggaggccctgcccctgcaccaggagaccaagcaggagagcggcagcggcaagaagaaggccagcagcaagaagcagaagaccgagaacgtgttcgtggacgagcccctgatccacgccaccacctacatccccctgatggacaacgccgacagcagccccgtggtggacaagagagaggtgatcgacctgctgaagcccgaccaggtggagggcatccagaagagcggcaccaagaagctgaagaccgagaccgacaaggagaacgccgaggtgaagttcaaggacttcctgctgagcctgaagaccatgatgttcagcgaggacgaggccctgtgcgtggtggacctgctgaaggagaagagcggcgtgatccaggacgccctgaagaagagcagcaagggcgagctgaccaccctgatccaccagctgcaggagaaggacaagctgctggccgccgtgaaggaggacgccgccgccaccaaggacagatgcaagcagctgacccaggagatgatgaccgagaaggagagaagcaacgtggtgatcaccagaatgaaggacagaatcggcaccctggagaaggagcacaacgtgttccagaacaagatccacgtgagctaccaggagacccagcagatgcagatgaagttccagcaggtgagagagcagatggaggccgagatcgcccacctgaagcaggagaacggcatcctgagagacgccgtgagcaacaccaccaaccagctggagagcaagcagagcgccgagctgaacaagctgagacaggactacgccagactggtgaacgagctgaccgagaagaccggcaagctgcagcaggaggaggtgcagaagaagaacgccgagcaggccgccacccagctgaaggtgcagctgcaggaggccgagagaagatgggaggaggtgcagagctacatcagaaagagaaccgccgagcacgaggccgcccagcaggacctgcagagcaagttcgtggccaaggagaacgaggtgcagagcctgcacagcaagctgaccgacaccctggtgagcaagcagcagctggagcagagactgatgcagctgatggagagcgagcagaagagagtgaacaaggaggagagcctgcagatgcaggtgcaggacatcctggagcagaacgaggccctgaaggcccagatccagcagttccacagccagatcgccgcccagaccagcgccagcgtgctggccgaggagctgcacaaggtgatcgccgagaaggacaagcagatcaagcagaccgaggacagcctggccagcgagagagacagactgaccagcaaggaggaggagctgaaggacatccagaacatgaacttcctgctgaaggccgaggtgcagaagctgcaggccctggccaacgagcaggccgccgccgcccacgagctggagaagatgcagcagagcgtgtacgtgaaggacgacaagatcagactgctggaggagcagctgcagcacgagatcagcaacaagatggaggagttcaagatcctgaacgaccagaacaaggccctgaagagcgaggtgcagaagctgcagaccctggtgagcgagcagcccaacaaggacgtggtggagcagatggagaagtgcatccaggagaaggacgagaagctgaagaccgtggaggagctgctggagaccggcctgatccaggtggccaccaaggaggaggagctgaacgccatcagaaccgagaacagcagcctgaccaaggaggtgcaggacctgaaggccaagcagaacgaccaggtgagcttcgccagcctggtggaggagctgaagaaggtgatccacgagaaggacggcaagatcaagagcgtggaggagctgctggaggccgagctgctgaaggtggccaacaaggagaagaccgtgcaggacctgaagcaggagatcaaggccctgaaggaggagatcggcaacgtgcagctggagaaggcccagcagctgagcatcaccagcaaggtgcaggagctgcagaacctgctgaagggcaaggaggagcagatgaacaccatgaaggccgtgctggaggagaaggagaaggacctggccaacaccggcaagtggctgcaggacctgcaggaggagaacgagagcctgaaggcccacgtgcaggaggtggcccagcacaacctgaaggaggccagcagcgccagccagttcgaggagctggagatcgtgctgaaggagaaggagaacgagctgaagagactggaggccatgctgaaggagagagagagcgacctgagcagcaagacccagctgctgcaggacgtgcaggacgagaacaagctgttcaagagccagatcgagcagctgaagcagcagaactaccagcaggccagcagcttccccccccacgaggagctgctgaaggtgatcagcgagagagagaaggagatcagcggcctgtggaacgagctggacagcctgaaggacgccgtggagcaccagagaaagaagaacaacgacctgagagagaagaactgggaggccatggaggccctggccagcaccgagaagatgctgcaggacaaggtgaacaagaccagcaaggagagacagcagcaggtggaggccgtggagctggaggccaaggaggtgctgaagaagctgttccccaaggtgagcgtgcccagcaacctgagctacggcgagtggctgcacggcttcgagaagaaggccaaggagtgcatggccggcaccagcggcagcgaggaggtgaaggtgctggagcacaagctgaaggaggccgacgagatgcacaccctgctgcagctggagtgcgagaagtacaagagcgtgctggccgagaccgagggcatcctgcagaagctgcagagaagcgtggagcaggaggagaacaagtggaaggtgaaggtggacgagagccacaagaccatcaagcagatgcagagcagcttcaccagcagcgagcaggagctggagagactgagaagcgagaacaaggacatcgagaacctgagaagagagagagagcacctggagatggagctggagaaggccgagatggagagaagcacctacgtgaccgaggtgagagagctgaaggacctgctgaccgagctgcagaagaagctggacgacagctacagcgaggccgtgagacagaacgaggagctgaacctgctgaaggcccagctgaacgagaccctgaccaagctgagaaccgagcagaacgagagacagaaggtggccggcgacctgcacaaggcccagcagagcctggagctgatccagagcaagatcgtgaaggccgccggcgacaccaccgtgatcgagaacagcgacgtgagccccgagaccgagagcagcgagaaggagaccatgagcgtgagcctgaaccagaccgtgacccagctgcagcagctgctgcaggccgtgaaccagcagctgaccaaggagaaggagcactaccaggtgctggagtag

SEQ ID NO: 86205 - DNA, 3921 bp, Artificial Sequence; identical to SEQ ID NO: 86203
  Description of Artificial Sequence: Synthetic coding sequence

SEQ ID NO: 86206 - DNA, 4074 bp, Artificial Sequence; identical to SEQ ID NO: 86204
  Description of Artificial Sequence: Synthetic coding sequence

SEQ ID NO: 86207 - DNA, 3921 bp, Artificial Sequence; identical to SEQ ID NO: 86203
  Description of Artificial Sequence: Synthetic coding sequence

SEQ ID NO: 86208 - DNA, 4074 bp, Artificial Sequence; identical to SEQ ID NO: 86204
  Description of Artificial Sequence: Synthetic coding sequence

SEQ ID NO: 86209 - DNA, 3903 bp, Artificial Sequence
  Description of Artificial Sequence: Synthetic coding sequence
atggagttctacgagagcgcctacttcatcgtgctgatccccagcatcgtgatcaccgtgatcttcctgttcttctggctgttcatgaaggagaccctgtacgacgaggtgctggccaagcagaagagagagcagaagctgatccccaccaagaccgacaagaagaaggccgagaagaagaagaacaagaagaaggagatccagaacggcaacctgcacgagagcgacagcgagagcgtgcccagagacttcaagctgagcgacgccctggccgtggaggacgaccaggtggcccccgtgcccctgaacgtggtggagaccagcagcagcgtgagagagagaaagaagaaggagaagaagcagaagcccgtgctggaggagcaggtgatcaaggagagcgacgccagcaagatccccggcaagaaggtggagcccgtgcccgtgaccaagcagcccaccccccccagcgaggccgccgccagcaagaagaagcccggccagaagaagagcaagaacggcagcgacgaccaggacaagaaggtggagaccctgatggtgcccagcaagagacaggaggccctgcccctgcaccaggagaccaagcaggagagcggcagcggcaagaagaaggccagcagcaagaagcagaagaccgagaacgtgttcgtggacgagcccctgatccacgccaccacctacatccccctgatggacaacgccgacagcagccccgtggtggacaagagagaggtgatcgacctgctgaagcccgaccaggtggagggcatccagaagagcggcaccaagaagctgaagaccgagaccgacaaggagaacgccgaggtgaagttcaaggacttcctgctgagcctgaagaccatgatgttcagcgaggacgaggccctgtgcgtggtggacctgctgaaggagaagagcggcgtgatccaggacgccctgaagaagagcagcaagggcgagctgaccaccctgatccaccagctgcaggagaaggacaagctgctggccgccgtgaaggaggacgccgccgccaccaaggacagatgcaagcagctgacccaggagatgatgaccgagaaggagagaagcaacgtggtgatcaccagaatgaaggacagaatcggcaccctggagaaggagcacaacgtgttccagaacaagatccacgtgagctaccaggagacccagcagatgcagatgaagttccagcaggtgagagagcagatggaggccgagatcgcccacctgaagcaggagaacggcatcctgagagacgccgtgagcaacaccaccaaccagctggagagcaagcagagcgccgagctgaacaagctgagacaggactacgccagactggtgaacgagctgaccgagaagaccggcaagctgcagcaggaggaggtgcagaagaagaacgccgagcaggccgccacccagctgaaggtgcagctgcaggaggccgagagaagatgggaggaggtgcagagctacatcagaaagagaaccgccgagcacgaggccgcccagcaggacctgcagagcaagttcgtggccaaggagaacgaggtgcagagcctgcacagcaagctgaccgacaccctggtgagcaagcagcagctggagcagagactgatgcagctgatggagagcgagcagaagagagtgaacaaggaggagagcctgcagatgcaggtgcaggacatcctggagcagaacgaggccctgaaggcccagatccagcagttccacagccagatcgccgcccagaccagcgccagcgtgctggccgaggagctgcacaaggtgatcgccgagaaggacaagcagatcaagcagaccgaggacagcctggccagcgagagagacagactgaccagcaaggaggaggagctgaaggacatccagaacatgaacttcctgctgaaggccgaggtgcagaagctgcaggccctggccaacgagcaggccgccgccgcccacgagctggagaagatgcagcagagcgtgtacgtgaaggacgacaagatcagactgctggaggagcagctgcagcacgagatcagcaacaagatggaggagttcaagatcctgaacgaccagaacaaggccctgaagagcgaggtgcagaagctgcagaccctggtgagcgagcagcccaacaaggacgtggtggagcagatggagaagtgcatccaggagaaggacgagaagctgaagaccgtggaggagctgctggagaccggcctgatccaggtggccaccaaggaggaggagctgaacgccatcagaaccgagaacagcagcctgaccaaggaggtgcaggacctgaaggccaagcagaacgaccaggtgagcttcgccagcctggtggaggagctgaagaaggtgatccacgagaaggacggcaagatcaagagcgtggaggagctgctggaggccgagctgctgaaggtggccaacaaggagaagaccgtgcaggacctgaagcaggagatcaaggccctgaaggaggagatcggcaacgtgcagctggagaaggcccagcagctgagcatcaccagcaaggtgcaggagctgcagaacctgctgaagggcaaggaggagcagatgaacaccatgaaggccgtgctggaggagaaggagaaggacctggccaacaccggcaagtggctgcaggacctgcaggaggagaacgagagcctgaaggcccacgtgcaggaggtggcccagcacaacctgaaggaggccagcagcgccagccagttcgaggagctggagatcgtgctgaaggagaaggagaacgagctgaagagactggaggccatgctgaaggagagagagagcgacctgagcagcaagacccagctgctgcaggacgtgcaggacgagaacaagctgttcaagagccagatcgagcagctgaagcagcagaactaccagcaggccagcagcttccccccccacgaggagctgctgaaggtgatcagcgagagagagaaggagatcagcggcctgtggaacgagctggacagcctgaaggacgccgtggagcaccagagaaagaagaacaacgagagacagcagcaggtggaggccgtggagctggaggccaaggaggtgctgaagaagctgttccccaaggtgagcgtgcccagcaacctgagctacggcgagtggctgcacggcttcgagaagaaggccaaggagtgcatggccggcaccagcggcagcgaggaggtgaaggtgctggagcacaagctgaaggaggccgacgagatgcacaccctgctgcagctggagtgcgagaagtacaagagcgtgctggccgagaccgagggcatcctgcagaagctgcagagaagcgtggagcaggaggagaacaagtggaaggtgaaggtggacgagagccacaagaccatcaagcagatgcagagcagcttcaccagcagcgagcaggagctggagagactgagaagcgagaacaaggacatcgagaacctgagaagagagagagagcacctggagatggagctggagaaggccgagatggagagaagcacctacgtgaccgaggtgagagagctgaaggcccagctgaacgagaccctgaccaagctgagaaccgagcagaacgagagacagaaggtggccggcgacctgcacaaggcccagcagagcctggagctgatccagagcaagatcgtgaaggccgccggcgacaccaccgtgatcgagaacagcgacgtgagccccgagaccgagagcagcgagaaggagaccatgagcgtgagcctgaaccagaccgtgacccagctgcagcagctgctgcaggccgtgaaccagcagctgaccaaggagaaggagcactaccaggtgctggagtag

SEQ ID NO: 86210 - DNA, 4074 bp, Artificial Sequence; identical to SEQ ID NO: 86204
  Description of Artificial Sequence: Synthetic coding sequence

SEQ ID NO: 86211 - DNA, 228 bp, Artificial Sequence
  Description of Artificial Sequence: Synthetic coding sequence
atggagttctacgagagcgcctacttcatcgtgctgatccccagcatcgtgatcaccgtgatcttcctgttcttctggctgttcatgaaggagaccctgtacgacgaggtgctggccaagcagaagagagagcagaagctgatccccaccaagaccgacaagaagaaggccgagaagaagaagaacaagaagaaggagatccagaacggcaacctgcacgagagctag

SEQ ID NO: 86212 - DNA, 183 bp, Artificial Sequence
  Description of Artificial Sequence: Synthetic coding sequence
atggagttctacgagagcgcctacttcatcgtgctgatccccagcatcgtgatcaccgtgatcttcctgttcttctggctgttcatgaaggagaccctgtacgacgaggtgctggccaagcagaagagagagcagaagctgatccccaccaagaccgacaagaagaaggccgagaagaagtag

SEQ ID NO: 86213 - DNA, 3171 bp, Artificial Sequence
  Description of Artificial Sequence: Synthetic coding sequence
atggccagccagcccaacagcagcgccaagaagaaggaggagaagggcaagaacatccaggtggtggtgagatgcagacccttcaacctggccgagagaaaggccagcgcccacagcatcgtggagtgcgaccccgtgagaaaggaggtgagcgtgagaaccggcggcctggccgacaagagcagcagaaagacctacaccttcgacatggtgttcggcgccagcaccaagcagatcgacgtgtacagaagcgtggtgtgccccatcctggacgaggtgatcatgggctacaactgcaccatcttcgcctacggccagaccggcaccggcaagaccttcaccatggagggcgagagaagccccaacgaggagtacacctgggaggaggaccccctggccggcatcatccccagaaccctgcaccagatcttcgagaagctgaccgacaacggcaccgagttcagcgtgaaggtgagcctgctggagatctacaacgaggagctgttcgacctgctgaaccccagcagcgacgtgagcgagagactgcagatgttcgacgaccccagaaacaagagaggcgtgatcatcaagggcctggaggagatcaccgtgcacaacaaggacgaggtgtaccagatcctggagaagggcgccgccaagagaaccaccgccgccaccctgatgaacgcctacagcagcagaagccacagcgtgttcagcgtgaccatccacatgaaggagaccaccatcgacggcgaggagctggtgaagatcggcaagctgaacctggtggacctggccggcagcgagaacatcggcagaagcggcgccgtggacaagagagccagagaggccggcaacatcaaccagagcctgctgaccctgggcagagtgatcaccgccctggtggagagaaccccccacgtgccctacagagagagcaagctgaccagaatcctgcaggacagcctgggcggcagaaccagaaccagcatcatcgccaccatcagccccgccagcctgaacctggaggagaccctgagcaccctggagtacgcccacagagccaagaacatcctgaacaagcccgaggtgaaccagaagctgaccaagaaggccctgatcaaggagtacaccgaggagatcgagagactgaagagagacctggccgccgccagagagaagaacggcgtgtacatcagcgaggagaacttcagagtgatgagcggcaagctgaccgtgcaggaggagcagatcgtggagctgatcgagaagatcggcgccgtggaggaggagctgaacagagtgaccgagctgttcatggacaacaagaacgagctggaccagtgcaagagcgacctgcagaacaagacccaggagctggagaccacccagaagcacctgcaggagaccaagctgcagctggtgaaggaggagtacatcaccagcgccctggagagcaccgaggagaagctgcacgacgccgccagcaagctgctgaacaccgtggaggagaccaccaaggacgtgagcggcctgcacagcaagctggacagaaagaaggccgtggaccagcacaacgccgaggcccaggacatcttcggcaagaacctgaacagcctgttcaacaacatggaggagctgatcaaggacggcagcagcaagcagaaggccatgctggaggtgcacaagaccctgttcggcaacctgctgagcagcagcgtgagcgccctggacaccatcaccaccgtggccctgggcagcctgaccagcatccccgagaacgtgagcacccacgtgagccagatcttcaacatgatcctgaaggagcagagcctggccgccgagagcaagaccgtgctgcaggagctgatcaacgtgctgaagaccgacctgctgagcagcctggagatgatcctgagccccaccgtggtgagcatcctgaagatcaacagccagctgaagcacatcttcaagaccagcctgaccgtggccgacaagatcgaggaccagaagaaggagctggacggcttcctgagcatcctgtgcaacaacctgcacgagctgcaggagaacaccatctgcagcctggtggagagccagaagcagtgcggcaacctgaccgaggacctgaagaccatcaagcagacccacagccaggagctgtgcaagctgatgaacctgtggaccgagagattctgcgccctggaggagaagtgcgagaacatccagaagcccctgagcagcgtgcaggagaacatccagcagaagagcaaggacatcgtgaacaagatgaccttccacagccagaagttctgcgccgacagcgacggcttcagccaggagctgagaaacttcaaccaggagggcaccaagctggtggaggagagcgtgaagcacagcgacaagctgaacggcaacctggagaagatcagccaggagaccgagcagagatgcgagagcctgaacaccagaaccgtgtacttcagcgagcagtgggtgagcagcctgaacgagagagagcaggagctgcacaacctgctggaggtggtgagccagtgctgcgaggccagcagcagcgacatcaccgagaagagcgacggcagaaaggccgcccacgagaagcagcacaacatcttcctggaccagatgaccatcgacgaggacaagctgatcgcccagaacctggagctgaacgagaccatcaagatcggcctgaccaagctgaactgcttcctggagcaggacctgaagctggacatccccaccggcaccaccccccagagaaagagctacctgtaccccagcaccctggtgagaaccgagcccagagagcacctgctggaccagctgaagagaaagcagcccgagctgctgatgatgctgaactgcagcgagaacaacaaggaggagaccatccccgacgtggacgtggaggaggccgtgctgggccagtacaccgaggagcccctgagccaggagcccagcgtggacgccggcgtggactgcagcagcatcggcggcgtgcccttcttccagcacaagaagagccacggcaaggacaaggagaacagaggcatcaacaccctggagagaagcaaggtggaggagaccaccgagcacctggtgaccaagagcagactgcccctgagagcccagatcaacctgtag

SEQ ID NO: 86214 - DNA, 5418 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagaaagccccccaaggtgttcgccttcgactactgcttctggagcatggacgagagcaacaccaccaagtacgccggccaggaggtggtgttcaagtgcctgggcgagggcatcctggagaaggccttccagggctacaacgcctgcatcttcgcctacggccagaccggcagcggcaagagcttcagcatgatgggccacgccgagcagctgggcctgatccccagactgtgctgcgccctgttcaagagaatcagcctggagcagaacgagagccagaccttcaaggtggaggtgagctacatggagatctacaacgagaaggtgagagacctgctggaccccaagggcagcagacagagcctgaaggtgagagagcacaaggtgctgggcccctacgtggacggcctgagccagctggccgtgaccagcttcgaggacatcgagagcctgatgagcgagggcaacaagagcagaaccgtggccgccaccaacatgaacgaggagagcagcagaagccacgccgtgttcaacatcatcatcacccagaccctgtacgacctgcagagcggcaacagcggcgagaaggtgagcaaggtgagcctggtggacctggccggcagcgagagagtgagcaagaccggcgccgccggcgagagactgaaggagggcagcaacatcaacaagagcctgaccaccctgggcctggtgatcagcagcctggccgaccaggccgccggcaagggcaagagcaagttcgtgccctacagagacagcgtgctgacctggctgctgaaggacaacctgggcggcaacagccagaccagcatgatcgccaccatcagccccgccgccgacaactacgaggagaccctgagcaccctgagatacgccgacagagccaagagaatcgtgaaccacgccgtggtgaacgaggaccccaacgccaaggtgatcagagagctgagagaggaggtggagaagctgagagagcagctgagccaggccgaggccatgaaggcccccgagctgaaggagaagctggaggagagcgagaagctgatcaaggagctgaccgtgacctgggaggagaagctgagaaagaccgaggagatcgcccaggagagacagagacagctggagagcatgggcatcagcctggagatgagcggcatcaaggtgggcgacgacaagtgctacctggtgaacctgaacgccgaccccgccctgaacgagctgctggtgtactacctgaaggaccacaccagagtgggcgccgacaccagccaggacatccagctgttcggcatcggcatccagccccagcactgcgagatcgacatcgccagcgacggcgacgtgaccctgacccccaaggagaacgccagaagctgcgtgaacggcaccctggtgtgcagcaccacccagctgtggcacggcgacagaatcctgtggggcaacaaccacttcttcagaatcaacctgcccaagagaaagagaagagactggctgaaggacttcgagaaggagaccggcccccccgagcacgacctggacgccgccagcgaggccagcagcgagcccgactacaactacgagttcgcccagatggaggtgatcatgaagaccctgaacagcaacgaccccgtgcagaacgtggtgcaggtgctggagaagcagtacctggaggagaagagaagcgccctggaggagcagagactgatgtacgagagagagctggagcagctgagacagcagctgagccccgacagacagccccagagcagcggccccgacagactggcctacagcagccagaccgcccagcagaaggtgacccagtgggccgaggagagagacgagctgttcagacagagcctggccaagctgagagagcagctggtgaaggccaacaccctggtgagagaggccaacttcctggccgaggagatgagcaagctgaccgactaccaggtgaccctgcagatccccgccgccaacctgagcgccaacagaaagagaggcgccatcgtgagcgagcccgccatccaggtgagaagaaagggcaagagcacccaggtgtggaccatcgagaagctggagaacaagctgatcgacatgagagacctgtaccaggagtggaaggagaaggtgcccgaggccaagagactgtacggcaagagaggcgaccccttctacgaggcccaggagaaccacaacctgatcggcgtggccaacgtgttcctggagtgcctgttctgcgacgtgaagctgcagtacgccgtgcccatcatcagccagcagggcgaggtggccggcagactgcacgtggaggtgatgagagtgaccggcgccgtgcccgagagagtggtggaggacgacagcagcgagaacagcagcgagagcggcagcctggaggtggtggacagcagcggcgagatcatccacagagtgaagaagctgacctgcagagtgaagatcaaggaggccaccggcctgcccctgaacctgagcaacttcgtgttctgccagtacaccttctgggaccagtgcgagagcaccgtggccgcccccgtggtggaccccgaggtgcccagcccccagagcaaggacgcccagtacaccgtgaccttcagccactgcaaggactacgtggtgaacgtgaccgaggagttcctggagttcatcagcgacggcgccctggccatcgaggtgtggggccacagatgcgccggcaacggcagcagcatctgggaggtggacagcctgcacgccaagaccagaaccctgcacgacagatggaacgaggtgaccagaagaatcgagatgtggatcagcatcctggagctgaacgagctgggcgagtacgccgccgtggagctgcaccaggccaaggacgtgaacaccggcggcatcttccagctgagacagggccacagcagaagagtgcaggtgaccgtgaagcccgtgcagcacagcggcaccctgcccctgatggtggaggccatcctgagcgtgagcatcggctgcgtgaccgccagaagcaccaagctgcagagaggcctggacagctaccagagagacgacgaggacggcgacgacatggacagctaccaggaggaggacctgaactgcgtgagagagagatggagcgacgccctgatcaagagaagagagtacctggacgagcagatcaagaaggtgagcaacaagaccgagaagaccgaggacgacgtggagagagaggcccagctggtggagcagtgggtgggcctgaccgaggagagaaacgccgtgctggtgcccgcccccggcagcggcatccccggcgcccccgccgactggatccccccccccggcatggagacccacatccccgtgctgttcctggacctgaacgccgacgacctgagcgccaacgagcagctggtgggcccccacgccagcggcgtgaacagcatcctgcccaaggagcacggcagccagttcttctacctgcccatcatcaagcacagcgacgacgaggtgagcgccaccgccagctgggacagcagcgtgcacgacagcgtgcacctgaacagagtgaccccccagaacgagagaatctacctgatcgtgaagaccaccgtgcagctgagccaccccgccgccatggagctggtgctgagaaagagaatcgccgccaacatctacaacaagcagagcttcacccagagcctgaagagaagaatcagcctgaagaacatcttctacagctgcggcgtgacctacgagatcgtgagcaacatccccaaggccaccgaggagatcgaggacagagagaccctggccctgctggccgccagaagcgagaacgagggcaccagcgacggcgagacctacatcgagaagtacaccagaggcgtgctgcaggtggagaacatcctgagcctggagagactgagacaggccgtgaccgtgaaggaggccctgagcaccaaggccagacacatcagaagaagcctgagcacccccaacgtgcacaacgtgagcagcagcagacccgacctgagcggcttcgacgaggacgacaagggctggcccgagaaccagctggacatgagcgactacagcagcagctaccaggacgtggcctgctacggcaccctgcccagagacagccccagaagaaacaaggagggctgcaccagcgagaccccccacgccctgaccgtgagccccttcaaggccttcagcccccagccccccaagttcttcaagcccctgatgcccgtgaaggaggagcacaagaagagaatcgccctggaggccagacccctgctgagccaggagagcatgccccccccccaggcccacaaccccggctgcatcgtgcccagcggcagcaacggcagcagcatgcccgtggagcacaacagcaagagagagaagaagatcgacagcgaggaggaggagaacgagctggaggccatcaacagaaagctgatcagcagccagccctacgtgcccgtggagttcgccgacttcagcgtgtacaacgccagcctggagaacagagagtggttcagcagcaaggtggacctgagcaacagcagagtgctggagaaggaggtgagcagaagccccaccaccagcagcatcaccagcggctacttcagccacagcgccagcaacgccaccctgagcgacatggtggtgcccagcagcgacagcagcgaccagctggccatccagaccaaggacgccgacagcaccgagcacagcacccccagcctggtgcacgacttcagacccagcagcaacaaggagctgaccgaggtggagaagggcctggtgaaggacaagatcatcgtggtgcccctgaaggagaacagcgccctggccaagggcagccccagcagccagagcatccccgagaagaacagcaagagcctgtgcagaaccggcagctgcagcgagctggacgcctgccccagcaagatcagccagcccgccagaggcttctgccccagagaggtgaccgtggagcacaccaccaacatcctggaggaccacagcttcaccgagttcatgggcgtgagcgagggcaaggacttcgacggcctgaccgacagcagcgccggcgagctgagcagcagaagaagcctgcccaacaagaccggcggcaagaccgtgagcgacggcctgcaccaccccagccagctgcacagcaagctggagaacgaccaggtgatcatccccgaggccgccttctgggtgctgtgctgccagtag

SEQ ID NO: 86215 - DNA, 5250 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagaaagccccccaaggtgttcgccttcgactactgcttctggagcatggacgagagcaacaccaccaagtacgccggccaggaggtggtgttcaagtgcctgggcgagggcatcctggagaaggccttccagggctacaacgcctgcatcttcgcctacggccagaccggcagcggcaagagcttcagcatgatgggccacgccgagcagctgggcctgatccccagactgtgctgcgccctgttcaagagaatcagcctggagcagaacgagagccagaccttcaaggtggaggtgagctacatggagatctacaacgagaaggtgagagacctgctggaccccaagggcagcagacagagcctgaaggtgagagagcacaaggtgctgggcccctacgtggacggcctgagccagctggccgtgaccagcttcgaggacatcgagagcctgatgagcgagggcaacaagagcagaaccgtggccgccaccaacatgaacgaggagagcagcagaagccacgccgtgttcaacatcatcatcacccagaccctgtacgacctgcagagcggcaacagcggcgagaaggtgagcaaggtgagcctggtggacctggccggcagcgagagagtgagcaagaccggcgccgccggcgagagactgaaggagggcagcaacatcaacaagagcctgaccaccctgggcctggtgatcagcagcctggccgaccaggccgccggcaagggcaagagcaagttcgtgccctacagagacagcgtgctgacctggctgctgaaggacaacctgggcggcaacagccagaccagcatgatcgccaccatcagccccgccgccgacaactacgaggagaccctgagcaccctgagatacgccgacagagccaagagaatcgtgaaccacgccgtggtgaacgaggaccccaacgccaaggtgatcagagagctgagagaggaggtggagaagctgagagagcagctgagccaggccgaggccatgaaggcccccgagctgaaggagaagctggaggagagcgagaagctgatcaaggagctgaccgtgacctgggaggagaagctgagaaagaccgaggagatcgcccaggagagacagagacagctggagagcatgggcatcagcctggagatgagcggcatcaaggtgggcgacgacaagtgctacctggtgaacctgaacgccgaccccgccctgaacgagctgctggtgtactacctgaaggaccacaccagagtgggcgccgacaccagccaggacatccagctgttcggcatcggcatccagccccagcactgcgagatcgacatcgccagcgacggcgacgtgaccctgacccccaaggagaacgccagaagctgcgtgaacggcaccctggtgtgcagcaccacccagctgtggcacggcgacagaatcctgtggggcaacaaccacttcttcagaatcaacctgcccaagagaaagagaagagactggctgaaggacttcgagaaggagaccggcccccccgagcacgacctggacgccgccagcgaggccagcagcgagcccgactacaactacgagttcgcccagatggaggtgatcatgaagaccctgaacagcaacgaccccgtgcagaacgtggtgcaggtgctggagaagcagtacctggaggagaagagaagcgccctggaggagcagagactgatgtacgagagagagctggagcagctgagacagcagctgagccccgacagacagccccagagcagcggccccgacagactggcctacagcagccagaccgcccagcagaaggtgacccagtgggccgaggagagagacgagctgttcagacagagcctggccaagctgagagagcagctggtgaaggccaacaccctggtgagagaggccaacttcctggccgaggagatgagcaagctgaccgactaccaggtgaccctgcagatccccgccgccaacctgagcgccaacagaaagagaggcgccatcgtgagcgagcccgccatccaggtgagaagaaagggcaagagcacccaggtgtggaccatcgagaagctggagaacaagctgatcgacatgagagacctgtaccaggagtggaaggagaaggtgcccgaggccaagagactgtacggcaagagaggcgaccccttctacgaggcccaggagaaccacaacctgatcggcgtggccaacgtgttcctggagtgcctgttctgcgacgtgaagctgcagtacgccgtgcccatcatcagccagcagggcgaggtggccggcagactgcacgtggaggtgatgagagtgaccggcgccgtgcccgagagagtggtggaggacgacagcagcgagaacagcagcgagagcggcagcctggaggtggtggacagcagcggcgagatcatccacagagtgaagaagctgacctgcagagtgaagatcaaggaggccaccggcctgcccctgaacctgagcaacttcgtgttctgccagtacaccttctgggaccagtgcgagagcaccgtggccgcccccgtggtggaccccgaggtgcccagcccccagagcaaggacgcccagtacaccgtgaccttcagccactgcaaggactacgtggtgaacgtgaccgaggagttcctggagttcatcagcgacggcgccctggccatcgaggtgtggggccacagatgcgccggcaacggcagcagcatctgggaggtggacagcctgcacgccaagaccagaaccctgcacgacagatggaacgaggtgaccagaagaatcgagatgtggatcagcatcctggagctgaacgagctgggcgagtacgccgccgtggagctgcaccaggccaaggacgtgaacaccggcggcatcttccagctgagacagggccacagcagaagagtgcaggtgaccgtgaagcccgtgcagcacagcggcaccctgcccctgatggtggaggccatcctgagcgtgagcatcggctgcgtgaccgccagaagcaccaagctgcagagaggcctggacagctaccaggaggaggacctgaactgcgtgagagagagatggagcgacgccctgatcaagagaagagagtacctggacgagcagatcaagaaggtgagcaacaagaccgagaagaccgaggacgacgtggagagagaggcccagctggtggagcagtgggtgggcctgaccgaggagagaaacgccgtgctggtgcccgcccccggcagcggcatccccggcgcccccgccgactggatccccccccccggcatggagacccacatccccgtgctgttcctggacctgaacgccgacgacctgagcgccaacgagcagctggtgggcccccacgccagcggcgtgaacagcatcctgcccaaggagcacggcagccagttcttctacctgcccatcatcaagcacagcgacgacgaggtgagcgccaccgccagctgggacagcagcgtgcacgacagcgtgcacctgaacagagtgaccccccagaacgagagaatctacctgatcgtgaagaccaccgtgcagctgagccaccccgccgccatggagctggtgctgagaaagagaatcgccgccaacatctacaacaagcagagcttcacccagagcctgaagagaagaatcagcctgaagaacatcttctacagctgcggcgtgacctacgagatcgtgagcaacatccccaaggccaccgaggagatcgaggacagagagaccctggccctgctggccgccagaagcgagaacgagggcaccagcgacggcgagacctacatcgagaagtacaccagaggcgtgctgcaggtggagaacatcctgagcctggagagactgagacaggccgtgaccgtgaaggaggccctgagcaccaaggccagacacatcagaagaagcctgagcacccccaacgtgcacaacgtgagcagcagcagacccgacctgagcggcttcgacgaggacgacaagggctggcccgagaaccagctggacatgagcgactacagcagcagctaccaggacgtggcctgctacggcaccctgcccagagacagccccagaagaaacaaggagggctgcaccagcgagaccccccacgccctgaccgtgagccccttcaaggccttcagcccccagccccccaagttcttcaagcccctgatgcccgtgaaggaggagcacaagaagagaatcgccctggaggccagacccctgctgagccaggaggacagcgaggaggaggagaacgagctggaggccatcaacagaaagctgatcagcagccagccctacgtgcccgtggagttcgccgacttcagcgtgtacaacgccagcctggagaacagagagtggttcagcagcaaggtggacctgagcaacagcagagtgctggagaaggaggtgagcagaagccccaccaccagcagcatcaccagcggctacttcagccacagcgccagcaacgccaccctgagcgacatggtggtgcccagcagcgacagcagcgaccagctggccatccagaccaaggacgccgacagcaccgagcacagcacccccagcctggtgcacgacttcagacccagcagcaacaaggagctgaccgaggtggagaagggcctggtgaaggacaagatcatcgtggtgcccctgaaggagaacagcgccctggccaagggcagccccagcagccagagcatccccgagaagaacagcaagagcctgtgcagaaccggcagctgcagcgagctggacgcctgccccagcaagatcagccagcccgccagaggcttctgccccagagaggtgaccgtggagcacaccaccaacatcctggaggaccacagcttcaccgagttcatgggcgtgagcgagggcaaggacttcgacggcctgaccgacagcagcgccggcgagctgagcagcagaagaagcctgcccaacaagaccggcggcaagaccgtgagcgacggcctgcaccaccccagccagctgcacagcaagctggagaacgaccagggcggcaccaccagcagatag

SEQ ID NO: 86216 - DNA, 5313 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagaagacccagccaggtgttcgccttcgactactgcttctggagcatggacgagagcaacaccaccaagtacgccggccaggaggtggtgttcaagtgcctgggcgagggcatcctggagaaggccttccagggctacaacgcctgcatcttcgcctacggccagaccggcagcggcaagagcttcagcatgatgggccacgccgagcagctgggcctgatccccagactgtgctgcgccctgttcaagagaatcagcctggagcagaacgagagccagaccttcaaggtggaggtgagctacatggagatctacaacgagaaggtgagagacctgctggaccccaagggcagcagacagagcctgaaggtgagagagcacaaggtgctgggcccctacgtggacggcctgagccagctggccgtgaccagcttcgaggacatcgagagcctgatgagcgagggcaacaagagcagaaccgtggccgccaccaacatgaacgaggagagcagcagaagccacgccgtgttcaacatcatcatcacccagaccctgtacgacctgcagagcggcaacagcggcgagaaggtgagcaaggtgagcctggtggacctggccggcagcgagagagtgagcaagaccggcgccgccggcgagagactgaaggagggcagcaacatcaacaagagcctgaccaccctgggcctggtgatcagcagcctggccgaccaggccgccggcaagggcaagagcaagttcgtgccctacagagacagcgtgctgacctggctgctgaaggacaacctgggcggcaacagccagaccagcatgatcgccaccatcagccccgccgccgacaactacgaggagaccctgagcaccctgagatacgccgacagagccaagagaatcgtgaaccacgccgtggtgaacgaggaccccaacgccaaggtgatcagagagctgagagaggaggtggagaagctgagagagcagctgagccaggccgaggccatgaaggcccccgagctgaaggagaagctggaggagagcgagaagctgatcaaggagctgaccgtgacctgggaggagaagctgagaaagaccgaggagatcgcccaggagagacagagacagctggagagcatgggcatcagcctggagatgagcggcatcaaggtgggcgacgacaagtgctacctggtgaacctgaacgccgaccccgccctgaacgagctgctggtgtactacctgaaggaccacaccagagtgggcgccgacaccagccaggacatccagctgttcggcatcggcatccagccccagcactgcgagatcgacatcgccagcgacggcgacgtgaccctgacccccaaggagaacgccagaagctgcgtgaacggcaccctggtgtgcagcaccacccagctgtggcacggcgacagaatcctgtggggcaacaaccacttcttcagaatcaacctgcccaagagaaagagaagagactggctgaaggacttcgagaaggagaccggcccccccgagcacgacctggacgccgccagcgaggccagcagcgagcccgactacaactacgagttcgcccagatggaggtgatcatgaagaccctgaacagcaacgaccccgtgcagaacgtggtgcaggtgctggagaagcagtacctggaggagaagagaagcgccctggaggagcagagactgatgtacgagagagagctggagcagctgagacagcagctgagccccgacagacagccccagagcagcggccccgacagactggcctacagcagccagaccgcccagcagaaggtgacccagtgggccgaggagagagacgagctgttcagacagagcctggccaagctgagagagcagctggtgaaggccaacaccctggtgagagaggccaacttcctggccgaggagatgagcaagctgaccgactaccaggtgaccctgcagatccccgccgccaacctgagcgccaacagaaagagaggcgccatcgtgagcgagcccgccatccaggtgagaagaaagggcaagagcacccaggtgtggaccatcgagaagctggagaacaagctgatcgacatgagagacctgtaccaggagtggaaggagaaggtgcccgaggccaagagactgtacggcaagagaggcgaccccttctacgaggcccaggagaaccacaacctgatcggcgtggccaacgtgttcctggagtgcctgttctgcgacgtgaagctgcagtacgccgtgcccatcatcagccagcagggcgaggtggccggcagactgcacgtggaggtgatgagagtgaccggcgccgtgcccgagagagtggtggaggacgacagcagcgagaacagcagcgagagcggcagcctggaggtggtggacagcagcggcgagatcatccacagagtgaagaagctgacctgcagagtgaagatcaaggaggccaccggcctgcccctgaacctgagcaacttcgtgttctgccagtacaccttctgggaccagtgcgagagcaccgtggccgcccccgtggtggaccccgaggtgcccagcccccagagcaaggacgcccagtacaccgtgaccttcagccactgcaaggactacgtggtgaacgtgaccgaggagttcctggagttcatcagcgacggcgccctggccatcgaggtgtggggccacagatgcgccggcaacggcagcagcatctgggaggtggacagcctgcacgccaagaccagaaccctgcacgacagatggaacgaggtgaccagaagaatcgagatgtggatcagcatcctggagctgaacgagctgggcgagtacgccgccgtggagctgcaccaggccaaggacgtgaacaccggcggcatcttccagctgagacagggccacagcagaagagtgcaggtgaccgtgaagcccgtgcagcacagcggcaccctgcccctgatggtggaggccatcctgagcgtgagcatcggctgcgtgaccgccagaagcaccaagctgcagagaggcctggacagctaccagagagacgacgaggacggcgacgacatggacagctaccaggaggaggacctgaactgcgtgagagagagatggagcgacgccctgatcaagagaagagagtacctggacgagcagatcaagaaggtgagcaacaagaccgagaagaccgaggacgacgtggagagagaggcccagctggtggagcagtgggtgggcctgaccgaggagagaaacgccgtgctggtgcccgcccccggcagcggcatccccggcgcccccgccgactggatccccccccccggcatggagacccacatccccgtgctgttcctggacctgaacgccgacgacctgagcgccaacgagcagctggtgggcccccacgccagcggcgtgaacagcatcctgcccaaggagcacggcagccagttcttctacctgcccatcatcaagcacagcgacgacgaggtgagcgccaccgccagctgggacagcagcgtgcacgacagcgtgcacctgaacagagtgaccccccagaacgagagaatctacctgatcgtgaagaccaccgtgcagctgagccaccccgccgccatggagctggtgctgagaaagagaatcgccgccaacatctacaacaagcagagcttcacccagagcctgaagagaagaatcagcctgaagaacatcttctacagctgcggcgtgacctacgagatcgtgagcaacatccccaaggccaccgaggagatcgaggacagagagaccctggccctgctggccgccagaagcgagaacgagggcaccagcgacggcgagacctacatcgagaagtacaccagaggcgtgctgcaggtggagaacatcctgagcctggagagactgagacaggccgtgaccgtgaaggaggccctgagcaccaaggccagacacatcagaagaagcctgagcacccccaacgtgcacaacgtgagcagcagcagacccgacctgagcggcttcgacgaggacgacaagggctggcccgagaaccagctggacatgagcgactacagcagcagctaccaggacgtggcctgctacggcaccctgcccagagacagccccagaagaaacaaggagggctgcaccagcgagaccccccacgccctgaccgtgagccccttcaaggccttcagcccccagccccccaagttcttcaagcccctgatgcccgtgaaggaggagcacaagaagagaatcgccctggaggccagacccctgctgagccaggaggacagcgaggaggaggagaacgagctggaggccatcaacagaaagctgatcagcagccagccctacgtgcccgtggagttcgccgacttcagcgtgtacaacgccagcctggagaacagagagtggttcagcagcaaggtggacctgagcaacagcagagtgctggagaaggaggtgagcagaagccccaccaccagcagcatcaccagcggctacttcagccacagcgccagcaacgccaccctgagcgacatggtggtgcccagcagcgacagcagcgaccagctggccatccagaccaaggacgccgacagcaccgagcacagcacccccagcctggtgcacgacttcagacccagcagcaacaaggagctgaccgaggtggagaagggcctggtgaaggacaagatcatcgtggtgcccctgaaggagaacagcgccctggccaagggcagccccagcagccagagcatccccgagaagaacagcaagagcctgtgcagaaccggcagctgcagcgagctggacgcctgccccagcaagatcagccagcccgccagaggcttctgccccagagaggtgaccgtggagcacaccaccaacatcctggaggaccacagcttcaccgagttcatgggcgtgagcgagggcaaggacttcgacggcctgaccgacagcagcgccggcgagctgagcagcagaagaagcctgcccaacaagaccggcggcaagaccgtgagcgacggcctgcaccaccccagccagctgcacagcaagctggagaacgaccaggtgatcatccccgaggccgccttctgggtgctgtgctgccagtag

SEQ ID NO: 86217 - DNA, 5313 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagaaagccccccaaggtgttcgccttcgactactgcttctggagcatggacgagagcaacaccaccaagtacgccggccaggaggtggtgttcaagtgcctgggcgagggcatcctggagaaggccttccagggctacaacgcctgcatcttcgcctacggccagaccggcagcggcaagagcttcagcatgatgggccacgccgagcagctgggcctgatccccagactgtgctgcgccctgttcaagagaatcagcctggagcagaacgagagccagaccttcaaggtggaggtgagctacatggagatctacaacgagaaggtgagagacctgctggaccccaagggcagcagacagagcctgaaggtgagagagcacaaggtgctgggcccctacgtggacggcctgagccagctggccgtgaccagcttcgaggacatcgagagcctgatgagcgagggcaacaagagcagaaccgtggccgccaccaacatgaacgaggagagcagcagaagccacgccgtgttcaacatcatcatcacccagaccctgtacgacctgcagagcggcaacagcggcgagaaggtgagcaaggtgagcctggtggacctggccggcagcgagagagtgagcaagaccggcgccgccggcgagagactgaaggagggcagcaacatcaacaagagcctgaccaccctgggcctggtgatcagcagcctggccgaccaggccgccggcaagggcaagagcaagttcgtgccctacagagacagcgtgctgacctggctgctgaaggacaacctgggcggcaacagccagaccagcatgatcgccaccatcagccccgccgccgacaactacgaggagaccctgagcaccctgagatacgccgacagagccaagagaatcgtgaaccacgccgtggtgaacgaggaccccaacgccaaggtgatcagagagctgagagaggaggtggagaagctgagagagcagctgagccaggccgaggccatgaaggcccccgagctgaaggagaagctggaggagagcgagaagctgatcaaggagctgaccgtgacctgggaggagaagctgagaaagaccgaggagatcgcccaggagagacagagacagctggagagcatgggcatcagcctggagatgagcggcatcaaggtgggcgacgacaagtgctacctggtgaacctgaacgccgaccccgccctgaacgagctgctggtgtactacctgaaggaccacaccagagtgggcgccgacaccagccaggacatccagctgttcggcatcggcatccagccccagcactgcgagatcgacatcgccagcgacggcgacgtgaccctgacccccaaggagaacgccagaagctgcgtgaacggcaccctggtgtgcagcaccacccagctgtggcacggcgacagaatcctgtggggcaacaaccacttcttcagaatcaacctgcccaagagaaagagaagagactggctgaaggacttcgagaaggagaccggcccccccgagcacgacctggacgccgccagcgaggccagcagcgagcccgactacaactacgagttcgcccagatggaggtgatcatgaagaccctgaacagcaacgaccccgtgcagaacgtggtgcaggtgctggagaagcagtacctggaggagaagagaagcgccctggaggagcagagactgatgtacgagagagagctggagcagctgagacagcagctgagccccgacagacagccccagagcagcggccccgacagactggcctacagcagccagaccgcccagcagaaggtgacccagtgggccgaggagagagacgagctgttcagacagagcctggccaagctgagagagcagctggtgaaggccaacaccctggtgagagaggccaacttcctggccgaggagatgagcaagctgaccgactaccaggtgaccctgcagatccccgccgccaacctgagcgccaacagaaagagaggcgccatcgtgagcgagcccgccatccaggtgagaagaaagggcaagagcacccaggtgtggaccatcgagaagctggagaacaagctgatcgacatgagagacctgtaccaggagtggaaggagaaggtgcccgaggccaagagactgtacggcaagagaggcgaccccttctacgaggcccaggagaaccacaacctgatcggcgtggccaacgtgttcctggagtgcctgttctgcgacgtgaagctgcagtacgccgtgcccatcatcagccagcagggcgaggtggccggcagactgcacgtggaggtgatgagagtgaccggcgccgtgcccgagagagtggtggaggacgacagcagcgagaacagcagcgagagcggcagcctggaggtggtggacagcagcggcgagatcatccacagagtgaagaagctgacctgcagagtgaagatcaaggaggccaccggcctgcccctgaacctgagcaacttcgtgttctgccagtacaccttctgggaccagtgcgagagcaccgtggccgcccccgtggtggaccccgaggtgcccagcccccagagcaaggacgcccagtacaccgtgaccttcagccactgcaaggactacgtggtgaacgtgaccgaggagttcctggagttcatcagcgacggcgccctggccatcgaggtgtggggccacagatgcgccggcaacggcagcagcatctgggaggtggacagcctgcacgccaagaccagaaccctgcacgacagatggaacgaggtgaccagaagaatcgagatgtggatcagcatcctggagctgaacgagctgggcgagtacgccgccgtggagctgcaccaggccaaggacgtgaacaccggcggcatcttccagctgagacagggccacagcagaagagtgcaggtgaccgtgaagcccgtgcagcacagcggcaccctgcccctgatggtggaggccatcctgagcgtgagcatcggctgcgtgaccgccagaagcaccaagctgcagagaggcctggacagctaccagagagacgacgaggacggcgacgacatggacagctaccaggaggaggacctgaactgcgtgagagagagatggagcgacgccctgatcaagagaagagagtacctggacgagcagatcaagaaggtgagcaacaagaccgagaagaccgaggacgacgtggagagagaggcccagctggtggagcagtgggtgggcctgaccgaggagagaaacgccgtgctggtgcccgcccccggcagcggcatccccggcgcccccgccgactggatccccccccccggcatggagacccacatccccgtgctgttcctggacctgaacgccgacgacctgagcgccaacgagcagctggtgggcccccacgccagcggcgtgaacagcatcctgcccaaggagcacggcagccagttcttctacctgcccatcatcaagcacagcgacgacgaggtgagcgccaccgccagctgggacagcagcgtgcacgacagcgtgcacctgaacagagtgaccccccagaacgagagaatctacctgatcgtgaagaccaccgtgcagctgagccaccccgccgccatggagctggtgctgagaaagagaatcgccgccaacatctacaacaagcagagcttcacccagagcctgaagagaagaatcagcctgaagaacatcttctacagctgcggcgtgacctacgagatcgtgagcaacatccccaaggccaccgaggagatcgaggacagagagaccctggccctgctggccgccagaagcgagaacgagggcaccagcgacggcgagacctacatcgagaagtacaccagaggcgtgctgcaggtggagaacatcctgagcctggagagactgagacaggccgtgaccgtgaaggaggccctgagcaccaaggccagacacatcagaagaagcctgagcacccccaacgtgcacaacgtgagcagcagcagacccgacctgagcggcttcgacgaggacgacaagggctggcccgagaaccagctggacatgagcgactacagcagcagctaccaggacgtggcctgctacggcaccctgcccagagacagccccagaagaaacaaggagggctgcaccagcgagaccccccacgccctgaccgtgagccccttcaaggccttcagcccccagccccccaagttcttcaagcccctgatgcccgtgaaggaggagcacaagaagagaatcgccctggaggccagacccctgctgagccaggaggacagcgaggaggaggagaacgagctggaggccatcaacagaaagctgatcagcagccagccctacgtgcccgtggagttcgccgacttcagcgtgtacaacgccagcctggagaacagagagtggttcagcagcaaggtggacctgagcaacagcagagtgctggagaaggaggtgagcagaagccccaccaccagcagcatcaccagcggctacttcagccacagcgccagcaacgccaccctgagcgacatggtggtgcccagcagcgacagcagcgaccagctggccatccagaccaaggacgccgacagcaccgagcacagcacccccagcctggtgcacgacttcagacccagcagcaacaaggagctgaccgaggtggagaagggcctggtgaaggacaagatcatcgtggtgcccctgaaggagaacagcgccctggccaagggcagccccagcagccagagcatccccgagaagaacagcaagagcctgtgcagaaccggcagctgcagcgagctggacgcctgccccagcaagatcagccagcccgccagaggcttctgccccagagaggtgaccgtggagcacaccaccaacatcctggaggaccacagcttcaccgagttcatgggcgtgagcgagggcaaggacttcgacggcctgaccgacagcagcgccggcgagctgagcagcagaagaagcctgcccaacaagaccggcggcaagaccgtgagcgacggcctgcaccaccccagccagctgcacagcaagctggagaacgaccaggtgatcatccccgaggccgccttctgggtgctgtgctgccagtag

SEQ ID NO: 86218 - DNA, 5274 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagaaagccccccaaggtgttcgccttcgactactgcttctggagcatggacgagagcaacaccaccaagtacgccggccaggaggtggtgttcaagtgcctgggcgagggcatcctggagaaggccttccagggctacaacgcctgcatcttcgcctacggccagaccggcagcggcaagagcttcagcatgatgggccacgccgagcagctgggcctgatccccagactgtgctgcgccctgttcaagagaatcagcctggagcagaacgagagccagaccttcaaggtggaggtgagctacatggagatctacaacgagaaggtgagagacctgctggaccccaagggcagcagacagagcctgaaggtgagagagcacaaggtgctgggcccctacgtggacggcctgagccagctggccgtgaccagcttcgaggacatcgagagcctgatgagcgagggcaacaagagcagaaccgtggccgccaccaacatgaacgaggagagcagcagaagccacgccgtgttcaacatcatcatcacccagaccctgtacgacctgcagagcggcaacagcggcgagaaggtgagcaaggtgagcctggtggacctggccggcagcgagagagtgagcaagaccggcgccgccggcgagagactgaaggagggcagcaacatcaacaagagcctgaccaccctgggcctggtgatcagcagcctggccgaccaggccgccggcaagggcaagagcaagttcgtgccctacagagacagcgtgctgacctggctgctgaaggacaacctgggcggcaacagccagaccagcatgatcgccaccatcagccccgccgccgacaactacgaggagaccctgagcaccctgagatacgccgacagagccaagagaatcgtgaaccacgccgtggtgaacgaggaccccaacgccaaggtgatcagagagctgagagaggaggtggagaagctgagagagcagctgagccaggccgaggccatgaaggcccccgagctgaaggagaagctggaggagagcgagaagctgatcaaggagctgaccgtgacctgggaggagaagctgagaaagaccgaggagatcgcccaggagagacagagacagctggagagcatgggcatcagcctggagatgagcggcatcaaggtgggcgacgacaagtgctacctggtgaacctgaacgccgaccccgccctgaacgagctgctggtgtactacctgaaggaccacaccagagtgggcgccgacaccagccaggacatccagctgttcggcatcggcatccagccccagcactgcgagatcgacatcgccagcgacggcgacgtgaccctgacccccaaggagaacgccagaagctgcgtgaacggcaccctggtgtgcagcaccacccagctgtggcacggcgacagaatcctgtggggcaacaaccacttcttcagaatcaacctgcccaagagaaagagaagagactggctgaaggacttcgagaaggagaccggcccccccgagcacgacctggacgccgccagcgaggccagcagcgagcccgactacaactacgagttcgcccagatggaggtgatcatgaagaccctgaacagcaacgaccccgtgcagaacgtggtgcaggtgctggagaagcagtacctggaggagaagagaagcgccctggaggagcagagactgatgtacgagagagagctggagcagctgagacagcagctgagccccgacagacagccccagagcagcggccccgacagactggcctacagcagccagaccgcccagcagaaggtgacccagtgggccgaggagagagacgagctgttcagacagagcctggccaagctgagagagcagctggtgaaggccaacaccctggtgagagaggccaacttcctggccgaggagatgagcaagctgaccgactaccaggtgaccctgcagatccccgccgccaacctgagcgccaacagaaagagaggcgccatcgtgagcgagcccgccatccaggtgagaagaaagggcaagagcacccaggtgtggaccatcgagaagctggagaacaagctgatcgacatgagagacctgtaccaggagtggaaggagaaggtgcccgaggccaagagactgtacggcaagagaggcgaccccttctacgaggcccaggagaaccacaacctgatcggcgtggccaacgtgttcctggagtgcctgttctgcgacgtgaagctgcagtacgccgtgcccatcatcagccagcagggcgaggtggccggcagactgcacgtggaggtgatgagagtgaccggcgccgtgcccgagagagtggtggaggacgacagcagcgagaacagcagcgagagcggcagcctggaggtggtggacagcagcggcgagatcatccacagagtgaagaagctgacctgcagagtgaagatcaaggaggccaccggcctgcccctgaacctgagcaacttcgtgttctgccagtacaccttctgggaccagtgcgagagcaccgtggccgcccccgtggtggaccccgaggtgcccagcccccagagcaaggacgcccagtacaccgtgaccttcagccactgcaaggactacgtggtgaacgtgaccgaggagttcctggagttcatcagcgacggcgccctggccatcgaggtgtggggccacagatgcgccggcaacggcagcagcatctgggaggtggacagcctgcacgccaagaccagaaccctgcacgacagatggaacgaggtgaccagaagaatcgagatgtggatcagcatcctggagctgaacgagctgggcgagtacgccgccgtggagctgcaccaggccaaggacgtgaacaccggcggcatcttccagctgagacagggccacagcagaagagtgcaggtgaccgtgaagcccgtgcagcacagcggcaccctgcccctgatggtggaggccatcctgagcgtgagcatcggctgcgtgaccgccagaagcaccaagctgcagagaggcctggacagctaccaggaggaggacctgaactgcgtgagagagagatggagcgacgccctgatcaagagaagagagtacctggacgagcagatcaagaaggtgagcaacaagaccgagaagaccgaggacgacgtggagagagaggcccagctggtggagcagtgggtgggcctgaccgaggagagaaacgccgtgctggtgcccgcccccggcagcggcatccccggcgcccccgccgactggatccccccccccggcatggagacccacatccccgtgctgttcctggacctgaacgccgacgacctgagcgccaacgagcagctggtgggcccccacgccagcggcgtgaacagcatcctgcccaaggagcacggcagccagttcttctacctgcccatcatcaagcacagcgacgacgaggtgagcgccaccgccagctgggacagcagcgtgcacgacagcgtgcacctgaacagagtgaccccccagaacgagagaatctacctgatcgtgaagaccaccgtgcagctgagccaccccgccgccatggagctggtgctgagaaagagaatcgccgccaacatctacaacaagcagagcttcacccagagcctgaagagaagaatcagcctgaagaacatcttctacagctgcggcgtgacctacgagatcgtgagcaacatccccaaggccaccgaggagatcgaggacagagagaccctggccctgctggccgccagaagcgagaacgagggcaccagcgacggcgagacctacatcgagaagtacaccagaggcgtgctgcaggtggagaacatcctgagcctggagagactgagacaggccgtgaccgtgaaggaggccctgagcaccaaggccagacacatcagaagaagcctgagcacccccaacgtgcacaacgtgagcagcagcagacccgacctgagcggcttcgacgaggacgacaagggctggcccgagaaccagctggacatgagcgactacagcagcagctaccaggacgtggcctgctacggcaccctgcccagagacagccccagaagaaacaaggagggctgcaccagcgagaccccccacgccctgaccgtgagccccttcaaggccttcagcccccagccccccaagttcttcaagcccctgatgcccgtgaaggaggagcacaagaagagaatcgccctggaggccagacccctgctgagccaggaggacagcgaggaggaggagaacgagctggaggccatcaacagaaagctgatcagcagccagccctacgtgcccgtggagttcgccgacttcagcgtgtacaacgccagcctggagaacagagagtggttcagcagcaaggtggacctgagcaacagcagagtgctggagaaggaggtgagcagaagccccaccaccagcagcatcaccagcggctacttcagccacagcgccagcaacgccaccctgagcgacatggtggtgcccagcagcgacagcagcgaccagctggccatccagaccaaggacgccgacagcaccgagcacagcacccccagcctggtgcacgacttcagacccagcagcaacaaggagctgaccgaggtggagaagggcctggtgaaggacaagatcatcgtggtgcccctgaaggagaacagcgccctggccaagggcagccccagcagccagagcatccccgagaagaacagcaagagcctgtgcagaaccggcagctgcagcgagctggacgcctgccccagcaagatcagccagcccgccagaggcttctgccccagagaggtgaccgtggagcacaccaccaacatcctggaggaccacagcttcaccgagttcatgggcgtgagcgagggcaaggacttcgacggcctgaccgacagcagcgccggcgagctgagcagcagaagaagcctgcccaacaagaccggcggcaagaccgtgagcgacggcctgcaccaccccagccagctgcacagcaagctggagaacgaccaggtgatcatccccgaggccgccttctgggtgctgtgctgccagtag

SEQ ID NO: 86219 - DNA, 213 bp, Artificial Sequence
  Description of Artificial Sequence: Synthetic coding sequence
atgagcgacaccaaggtgaaggtggccgtgagagtgagacccatgaacagaagagagctggagctgaacaccaagtgcgtggtggagatggagggcaaccagaccgtgctgcaccccccccccagcaacaccaagcagggcgagagactggtgaccgtggcccacatcagcaacagcagcaccctgggcggccagggcaagagaatcacctag

SEQ ID NO: 86220 - DNA, 1038 bp, Artificial Sequence
  Description of Artificial Sequence: Synthetic coding sequence
atgcccaagctgctgaagagcctgttccccgtgagagacgagaagagaggcaagagacccagccccctggcccaccaggcccagcccgagatgggccccgacgtgctggtgcagaccatgggcgcccccgccctgaagatctgcgacaagcccgccaaggtgcccagccccccccccgtgatcgccgtgaccgccgtgacccccgcccccgaggcccaggacggcccccccagccccctgagcgaggccagcagcggctacttcagccacagcgtgagcaccgccaccctgagcgacgccctgggccccggcctggacgccgccgccccccccggcagcatgcccaccgcccccgaggccgagcccgaggcccccatcagccacccccccccccccaccgccgtgcccgccgaggagccccccggcccccagcagctggtgagccccggcagagagagacccgacctggaggcccccgcccccggcagccccttcagagtgagaagagtgagagccagcgagctgagaagcttcagcagaatgctggccggcgaccccggctgcagccccggcgccgagggcaacgcccccgcccccggcgccggcggccaggccctggccagcgacagcgaggaggccgacgaggtgcccgagtggctgagagagggcgagttcgtgaccgtgggcgcccacaagaccggcgtggtgagatacgtgggccccgccgacttccaggagggcacctgggtgggcgtggagctggacctgcccagcggcaagaacgacggcagcatcggcggcaagcagtacttcagatgcaaccccggctacggcctgctggtgagacccagcagagtgagaagagccaccggccccgtgagaagaagaagcaccggcctgagactgggcgcccccgaggccagaagaagcgccaccctgagcggcagcgccaccaacctggccagcctgaccgccgccctggccaaggccgacagaagccacaagaaccccgagaacagaaagagctgggccagctag

SEQ ID NO: 86221 - DNA, 5481 bp, Artificial Sequence
  Description of Artificial Sequence: Synthetic coding sequence
atgggcgacagcaaggtgaaggtggccgtgagaatcagacccatgaacagaagagagaccgacctgcacaccaagtgcgtggtggacgtggacgccaacaaggtgatcctgaaccccgtgaacaccaacctgagcaagggcgacgccagaggccagcccaaggtgttcgcctacgaccactgcttctggagcatggacgagagcgtgaaggagaagtacgccggccaggacatcgtgttcaagtgcctgggcgagaacatcctgcagaacgccttcgacggctacaacgcctgcatcttcgcctacggccagaccggcagcggcaagagctacaccatgatgggcaccgccgaccagcccggcctgatccccagactgtgcagcggcctgttcgagagaacccagaaggaggagaacgaggagcagagcttcaaggtggaggtgagctacatggagatctacaacgagaaggtgagagacctgctggaccccaagggcagcagacagaccctgaaggtgagagagcacagcgtgctgggcccctacgtggacggcctgagcaagctggccgtgaccagctacaaggacatcgagagcctgatgagcgagggcaacaagagcagaaccgtggccgccaccaacatgaacgaggagagcagcagaagccacgccgtgttcaagatcaccctgacccacaccctgtacgacgtgaagagcggcaccagcggcgagaaggtgggcaagctgagcctggtggacctggccggcagcgagagagccaccaagaccggcgccgccggcgacagactgaaggagggcagcaacatcaacaagagcctgaccaccctgggcctggtgatcagcgccctggccgaccagagcgccggcaagaacaagaacaagttcgtgccctacagagacagcgtgctgacctggctgctgaaggacagcctgggcggcaacagcaagaccgccatggtggccaccgtgagccccgccgccgacaactacgacgagaccctgagcaccctgagatacgccgacagagccaagcacatcgtgaaccacgccgtggtgaacgaggaccccaacgccagaatcatcagagacctgagagaggaggtggagaagctgagagagcagctgaccaaggccgaggccatgaagagccccgagctgaaggacagactggaggagagcgagaagctgatccaggagatgaccgtgacctgggaggagaagctgagaaagaccgaggagatcgcccaggagagacagaagcagctggagagcctgggcatcagcctgcagagcagcggcatcaaggtgggcgacgacaagtgcttcctggtgaacctgaacgccgaccccgccctgaacgagctgctggtgtactacctgaaggagcacaccctgatcggcagcgccaacagccaggacatccagctgtgcggcatgggcatcctgcccgagcactgcatcatcgacatcaccagcgagggccaggtgatgctgaccccccagaagaacaccagaaccttcgtgaacggcagcagcgtgagcagccccatccagctgcaccacggcgacagaatcctgtggggcaacaaccacttcttcagactgaacctgcccaagaagaagaagaaggccgagagagaggacgaggaccaggaccccagcatgaagaacgagaacagcagcgagcagctggacgtggacggcgacagcagcagcgaggtgagcagcgaggtgaacttcaactacgagtacgcccagatggaggtgaccatgaaggccctgggcagcaacgaccccatgcagagcatcctgaacagcctggagcagcagcacgaggaggagaagagaagcgccctggagagacagagactgatgtacgagcacgagctggagcagctgagaagaagactgagccccgagaagcagaactgcagaagcatggacagattcagcttccacagccccagcgcccagcagagactgagacagtgggccgaggagagagaggccaccctgaacaacagcctgatgagactgagagagcagatcgtgaaggccaacctgctggtgagagaggccaactacatcgccgaggagctggacaagagaaccgagtacaaggtgaccctgcagatccccgccagcagcctggacgccaacagaaagagaggcagcctgctgagcgagcccgccatccaggtgagaagaaagggcaagggcaagcagatctggagcctggagaagctggacaacagactgctggacatgagagacctgtaccaggagtggaaggagtgcgaggaggacaaccccgtgatcagaagctacttcaagagagccgaccccttctacgacgagcaggagaaccacagcctgatcggcgtggccaacgtgttcctggagagcctgttctacgacgtgaagctgcagtacgccgtgcccatcatcaaccagaagggcgaggtggccggcagactgcacgtggaggtgatgagactgagcggcgacgtgggcgagagaatcgccggcggcgacgaggtggccgaggtgagcttcgagaaggagacccaggagaacaagctggtgtgcatggtgaagatcctgcaggccaccggcctgccccagcacctgagccacttcgtgttctgcaagtacagcttctgggaccagcaggagcccgtgatcgtggcccccgaggtggacaccagcagcagcagcgtgagcaaggagccccactgcatggtggtgttcgaccactgcaacgagttcagcgtgaacatcaccgaggacttcatcgagcacctgagcgagggcgccctggccatcgaggtgtacggccacaagatcaacgaccccagaaagaaccccgccctgtgggacctgggcatcatccaggccaagaccagaagcctgagagacagatggagcgaggtgaccagaaagctggagttctgggtgcagatcctggagcagaacgagaacggcgagtactgccccgtggaggtgatcagcgccaaggacgtgcccaccggcggcatcttccagctgagacagggccagagcagaagagtgcaggtggaggtgaagagcgtgcaggagagcggcaccctgcccctgatggaggagtgcatcctgagcgtgggcatcggctgcgtgaaggtgagacccctgagagcccccagaacccacgagaccttccacgaggaggaggaggacatggacagctaccaggacagagacctggagagactgagaagaaagtggctgaacgccctgaccaagagacaggagtacctggaccagcagctgcagaagctggtgagcaagagagacaagaccgaggacgacgccgacagagaggcccagctgctggagatgagactgaccctgaccgaggagagaaacgccgtgatggtgcccagcgccggcagcggcatccccggcgcccccgccgagtggacccccgtgcccggcatggagacccacatccccgtgatcttcctggacctgaacgccgacgacttcagcagccaggacaacctggacgaccccgaggccggcggctgggacgccaccctgaccggcgaggaggaggaggagttcttcgagctgcagatcgtgaagcagcacgacggcgaggtgaaggccgaggccagctgggacagcgccgtgcacggctgcccccagctgagcagaggcacccccgtggacgagagactgttcctgatcgtgagagtgaccgtgcagctgagccaccccgccgacatgcagctggtgctgagaaagagaatctgcgtgaacgtgcacggcagacagggcttcgcccagagcctgctgaagaagatgagccacagaagcagcatccccggctgcggcgtgaccttcgagatcgtgagcaacatccccgaggacgcccagggcgtggaggagagagaggccctggccagaatggccgccaacgtggagaaccccgccagcgccgacagcgaggcctacatcgagaagtacctgagaagcgtgctggccgtggagaacctgctgaccctggacagactgagacaggaggtggccgtgaaggagcagctgaccggcaagggcaagctgagcagaagaagcatcagcagccccaacgtgaacagactgagcggcagcagacaggacctgatccccagctacagcctgggcagcaacaagggcagatgggagagccagcaggacgtgagccagaccaccgtgagcagaggcatcgcccccgcccccgccctgagcgtgagcccccagaacaaccacagccccgaccccggcctgagcaacctggccgccagctacctgaaccccgtgaagagcttcgtgccccagatgcccaagctgctgaagagcctgttccccgtgagagacgagaagagaggcaagagacccagccccctggcccaccagcccgtgcccagaatcatggtgcagagcgccagccccgacatcagagtgaccagaatggaggaggcccagcccgagatgggccccgacgtgctggtgcagaccatgggcgcccccgccctgaagatctgcgacaagcccgccaaggtgcccagccccccccccgtgatcgccgtgaccgccgtgacccccgcccccgaggcccaggacggcccccccagccccctgagcgaggccagcagcggctacttcagccacagcgtgagcaccgccaccctgagcgacgccctgggccccggcctggacgccgccgccccccccggcagcatgcccaccgcccccgaggccgagcccgaggcccccatcagccacccccccccccccaccgccgtgcccgccgaggagccccccggcccccagcagctggtgagccccggcagagagagacccgacctggaggcccccgcccccggcagccccttcagagtgagaagagtgagagccagcgagctgagaagcttcagcagaatgctggccggcgaccccggctgcagccccggcgccgagggcaacgcccccgcccccggcgccggcggccaggccctggccagcgacagcgaggaggccgacgaggtgcccgagtggctgagagagggcgagttcgtgaccgtgggcgcccacaagaccggcgtggtgagatacgtgggccccgccgacttccaggagggcacctgggtgggcgtggagctggacctgcccagcggcaagaacgacggcagcatcggcggcaagcagtacttcagatgcaaccccggctacggcctgctggtgagacccagcagagtgagaagagccaccggccccgtgagaagaagaagcaccggcctgagactgggcgcccccgaggccagaagaagcgccaccctgagcggcagcgccaccaacctggccagcctgaccgccgccctggccaaggccgacagaagccacaagaaccccgagaacagaaagagctgggccagctag

SEQ ID NO: 86222 - DNA, 4947 bp, Artificial Sequence
  Description of Artificial Sequence: Synthetic coding sequence
atgagcctgcacagcacccacaacagaaacaacagcggcgacatcctggacatccccagcagccagaacagcagcagcctgaacgccctgacccacagcagcagactgaagctgcacctgaagagcgacatgagcgagtgcgagaacgacgaccccctgctgagaagcgccggcaaggtgagagacatcaacagaacctacgtgatcagcgccagcagaaagaccgccgacatgcccctgacccccaaccccgtgggcagactggccctgcagagaagaaccaccagaaacaaggagagcagcctgctggtgagcgagctggaggacaccaccgagaagaccgccgagaccagactgaccctgcagagaagagccaagaccgacagcgccgagaagtggaagaccgccgagatcgacagcgtgaagatgaccctgaacgtgggcggcgagaccgagaacaacggcgtgagcaaggagagcagaaccaacgtgagaatcgtgaacaacgccaagaacagcttcgtggccagcagcgtgcccctggacgaggacccccaggtgatcgagatgatggccgacaagaagtacaaggagaccttcagcgcccccagcagagccaacgagaacgtggccctgaagtacagcagcaacagaccccccatcgccagcctgagccagaccgaggtggtgagaagcggccacctgaccaccaagcccacccagagcaagctggacatcaaggtgctgggcaccggcaacctgtaccacagaagcatcggcaaggagatcgccaagaccagcaacaagttcggcagcctggagaagagaacccccaccaagtgcaccaccgagcacaagctgaccaccaagtgcagcctgccccagctgaagagccccgcccccagcatcctgaagaacagaatgagcaacctgcaggtgaagcagagacccaagagcagcttcctggccaacaagcaggagagaagcgccgagaacaccatcctgcccgaggaggagaccgtggtgcagaacaccagcgccggcaaggaccccctgaaggtggagaacagccaggtgaccgtggccgtgagagtgagacccttcaccaagagagagaagatcgagaaggccagccaggtggtgttcatgagcggcaaggagatcaccgtggagcaccccgacaccaagcaggtgtacaacttcatctacgacgtgagcttctggagcttcgacgagtgccacccccactacgccagccagaccaccgtgtacgagaagctggccgcccccctgctggagagagccttcgagggcttcaacacctgcctgttcgcctacggccagaccggcagcggcaagagctacaccatgatgggcttcagcgaggagcccggcatcatccccagattctgcgaggacctgttcagccaggtggccagaaagcagacccaggaggtgagctaccacatcgagatgagcttcttcgaggtgtacaacgagaagatccacgacctgctggtgtgcaaggacgagaacggccagagaaagcagcccctgagagtgagagagcaccccgtgtacggcccctacgtggaggccctgagcatgaacatcgtgagcagctacgccgacatccagagctggctggagctgggcaacaagcagagagccaccgccgccaccggcatgaacgacaagagcagcagaagccacagcgtgttcaccctggtgatgacccagaccaagaccgagttcgtggagggcgaggagcacgaccacagaatcaccagcagaatcaacctgatcgacctggccggcagcgagagatgcagcaccgcccacaccaacggcgacagactgaaggagggcgtgagcatcaacaagagcctgctgaccctgggcaaggtgatcagcgccctgagcgagcaggccaaccagagaagcgtgttcatcccctacagagagagcgtgctgacctggctgctgaaggagagcctgggcggcaacagcaagaccgccatgatcgccaccatcagccccgccgccagcaacatcgaggagaccctgagcaccctgagatacgccaaccaggccagactgatcgtgaacatcgccaaggtgaacgaggacatgaacgccaagctgatcagagagctgaaggccgagatcgccaagctgaaggccgcccagagaaacagcagaaacatcgaccccgagagatacagactgtgcagacaggagatcaccagcctgagaatgaagctgcaccagcaggagagagacatggccgagatgcagagagtgtggaaggagaagttcgagcaggccgagaagagaaagctgcaggagaccaaggagctgcagaaggccggcatcatgttccagatggacaaccacctgcccaacctggtgaacctgaacgaggacccccagctgagcgagatgctgctgtacatgatcaaggagggcaccaccaccgtgggcaagtacaagcccaacagcagccacgacatccagctgagcggcgtgctgatcgccgacgaccactgcaccatcaagaacttcggcggcaccgtgagcatcatccccgtgggcgaggccaagacctacgtgaacggcaagcacatcctggagatcaccgtgctgagacacggcgacagagtgatcctgggcggcgaccactacttcagattcaaccaccccgtggaggtgcagaagggcaagagacccagcggcagagacacccccatcagcgagggccccaaggacttcgagttcgccaagaacgagctgctgatggcccagagaagccagctggaggccgagatcaaggaggcccagctgaaggccaaggaggagatgatgcagggcatccagatcgccaaggagatggcccagcaggagctgagcagccagaaggccgcctacgagagcaagatcaaggccctggaggccgagctgagagaggagagccagagaaagaagatgcaggagatcaacaaccagaaggccaaccacaagatcgaggagctggagaaggccaagcagcacctggagcaggagatctacgtgaacaagaagagactggagatggagaccctggccaccaagcaggccctggaggaccacagcatcagacacgccagaatcctggaggccctggagaccgagaagcagaagatcgccaaggaggtgcagatcctgcagcagaacagaaacaacagagacaagaccttcaccgtgcagaccacctggagcagcatgaagctgagcatgatgatccaggaggccaacgccatcagcagcaagctgaagacctactacgtgttcggcagacacgacatcagcgacaagagcagcagcgacaccagcatcagagtgagaaacctgaagctgggcatcagcaccttctggagcctggagaagttcgagagcaagctggccgccatgaaggagctgtacgagagcaacggcagcaacagaggcgaggacgccttctgcgaccccgaggacgagtgggagcccgacatcaccgacgcccccgtgagcagcctgagcagaagaagaagcagaagcctgatgaagaacagaagaatcagcggctgcctgcacgacatccaggtgcaccccatcaagaacctgcacagcagccacagcagcggcctgatggacaagagcagcaccatctacagcaacagcgccgagagcttcctgcccggcatctgcaaggagctgatcggcagcagcctggacttcttcggccagagctacgacgaggagagaaccatcgccgacagcctgatcaacagcttcctgaagatctacaacggcctgttcgccatcagcaaggcccacgaggagcaggacgaggagagccaggacaacctgttcagcagcgacagagccatccagagcctgaccatccagaccgcctgcgccttcgagcagctggtggtgctgatgaagcactggctgagcgacctgctgccctgcaccaacatcgccagactggaggacgagctgagacaggaggtgaagaagctgggcggctacctgcagctgttcctgcagggctgctgcctggacatcagcagcatgatcaaggaggcccagaagaacgccatccagatcgtgcagcaggccgtgaagtacgtgggccagctggccgtgctgaagggcagcaagctgcacttcctggagaacggcaacaacaaggccgccagcgtgcaggaggagttcatggacgccgtgtgcgacggcgtgggcctgggcatgaagatcctgctggacagcggcctggagaaggccaaggagctgcagcacgagctgttcagacagtgcaccaagaacgaggtgaccaaggagatgaagaccaacgccatgggcctgatcagaagcctggagaacatcttcgccgagagcaagatcaagagcttcagaagacaggtgcaggaggagaacttcgagtaccaggacttcaagagaatggtgaacagagcccccgagttcctgaagctgaagcactgcctggagaaggccatcgagatcatcatcagcgccctgaagggctgccacagcgacatcaacctgctgcagacctgcgtggagagcatcagaaacctggccagcgacttctacagcgacttcagcgtgcccagcaccagcgtgggcagctacgagagcagagtgacccacatcgtgcaccaggagctggagagcctggccaagagcctgctgttctgcttcgagagcgaggagagccccgacctgctgaagccctgggagacctacaaccagaacaccaaggaggagcaccagcagagcaagagcagcggcatcgacggcagcaagaacaagggcgtgcccaagagagtgtacgagctgcacggcagcagccccgccgtgagcagcgaggagtgcacccccagcagaatccagtgggtgtag

SEQ ID NO: 86223 - DNA, 5073 bp, Artificial Sequence
  Description of Artificial Sequence: Synthetic coding sequence
atggccggcgccagcgtgaaggtggccgtgagagtgagacccttcaacagcagagagatgagcagagacagcaagtgcatcatccagatgagcggcagcaccaccaccatcgtgaaccccaagcagcccaaggagacccccaagagcttcagcttcgactacagctactggagccacaccagccccgaggacatcaactacgccagccagaagcaggtgtacagagacatcggcgaggagatgctgcagcacgccttcgagggctacaacgtgtgcatcttcgcctacggccagaccggcgccggcaagagctacaccatgatgggcaagcaggagaaggaccagcagggcatcatcccccagctgtgcgaggacctgttcagcagaatcaacgacaccaccaacgacaacatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaacgacatccaggacctgatggacagcggcaacaaggccagaaccgtggccgccaccaacatgaacgagaccagcagcagaagccacgccgtgttcaacatcatcttcacccagaagagacacgacgccgagaccaacatcaccaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgagatggacagcggccccaacaagaacaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcagatgcaacgccgtgatcaacgaggaccccaacaacaagctgatcagagagctgaaggacgaggtgaccagactgagagacctgctgtacgcccagggcctgggcgacatcaccgacatgaccaacgccctggtgggcatgagccccagcagcagcctgagcgccctgagcagcagagccgccagcgtgagcagcctgcacgagagaatcctgttcgcccccggcagcgaggaggccatcgagagactgaaggagaccgagaagatcatcgccgagctgaacgagacctgggaggagaagctgagaagaaccgaggccatcagaatggagagagaggccctgctggccgagatgggcgtggccatgagagaggacggcggcaccctgggcgtgttcagccccaagaagaccccccacctggtgaacctgaacgaggaccccctgatgagcgagtgcctgctgtactacatcaaggacggcatcaccagagtgggcagagaggacggcgagagaagacaggacatcgtgctgagcggccacttcatcaaggaggagcactgcgtgttcagaagcgacagcagaggcggcagcgaggccgtggtgaccctggagccctgcgagggcgccgacacctacgtgaacggcaagaaggtgaccgagcccagcatcctgagaagcggcaacagaatcatcatgggcaagagccacgtgttcagattcaaccaccccgagcaggccagacaggagagagagagaaccccctgcgccgagacccccgccgagcccgtggactgggccttcgcccagagagagctgctggagaagcagggcatcgacatgaagcaggagatggagcagagactgcaggagctggaggaccagtacagaagagagagagaggaggccacctacctgctggagcagcagagactggactacgagagcaagctggaggccctgcagaagcagatggacagcagatactaccccgaggtgaacgaggaggaggaggagcccgaggacgaggtgcagtggaccgagagagagtgcgagctggccctgtgggccttcagaaagtggaagtggtaccagttcaccagcctgagagacctgctgtggggcaacgccatcttcctgaaggaggccaacgccatcagcgtggagctgaagaagaaggtgcagttccagttcgtgctgctgaccgacaccctgtacagccccctgccccccgacctgctgccccccgaggccgccaaggacagagagaccagacccttccccagaaccatcgtggccgtggaggtgcaggaccagaagaacggcgccacccactactggaccctggagaagctgagacagagactggacctgatgagagagatgtacgacagagccgccgaggtgcccagcagcgtgatcgaggactgcgacaacgtggtgaccggcggcgaccccttctacgacagattcccctggttcagactggtgggcagagccttcgtgtacctgagcaacctgctgtaccccgtgcccctggtgcacagagtggccatcgtgagcgagaagggcgaggtgaagggcttcctgagagtggccgtgcaggccatcagcgccgacgaggaggcccccgactacggcagcggcgtgagacagagcggcaccgccaagatcagcttcgacgaccagcacttcgagaagttccagagcgagagctgccccgtggtgggcatgagcagaagcggcaccagccaggaggagctgagaatcgtggagggccagggccagggcgccgacgtgggccccagcgccgacgaggtgaacaacaacacctgcagcgccgtgccccccgagggcctgctgctggacagcagcgagaaggccgccctggacggccccctggacgccgccctggaccacctgagactgggcaacaccttcaccttcagagtgaccgtgctgcaggccagcagcatcagcgccgagtacgccgacatcttctgccagttcaacttcatccacagacacgacgaggccttcagcaccgagcccctgaagaacaccggcagaggcccccccctgggcttctaccacgtgcagaacatcgccgtggaggtgaccaagagcttcatcgagtacatcaagagccagcccatcgtgttcgaggtgttcggccactaccagcagcaccccttcccccccctgtgcaaggacgtgctgagccccctgagacccagcagaagacacttccccagagtgatgcccctgagcaagcccgtgcccgccaccaagctgagcaccctgaccagaccctgccccggcccctgccactgcaagtacgacctgctggtgtacttcgagatctgcgagctggaggccaacggcgactacatccccgccgtggtggaccacagaggcggcatgccctgcatgggcaccttcctgctgcaccagggcatccagagaagaatcaccgtgaccctgctgcacgagaccggcagccacatcagatggaaggaggtgagagagctggtggtgggcagaatcagaaacacccccgagaccgacgagagcctgatcgaccccaacatcctgagcctgaacatcctgagcagcggctacatccaccccgcccaggacgacagaaccttctaccagttcgaggccgcctgggacagcagcatgcacaacagcctgctgctgaacagagtgaccccctacagagagaagatctacatgaccctgagcgcctacatcgagatggagaactgcacccagcccgccgtggtgaccaaggacttctgcatggtgttctacagcagagacgccaagctgcccgccagcagaagcatcagaaacctgttcggcagcggcagcctgagagccagcgagagcaacagagtgaccggcgtgtacgagctgagcctgtgccacgtggccgacgccggcagccccggcatgcagagaagaagaagaagagtgctggacaccagcgtggcctacgtgagaggcgaggagaacctggccggctggagacccagaagcgacagcctgatcctggaccaccagtgggagctggagaagctgagcctgctgcaggaggtggagaagaccagacactacctgctgctgagagagaagctggagaccgcccagagacccgtgcccgaggccctgagccccgccttcagcgaggacagcgagagccacggcagcagcagcgccagcagccccctgagcgccgagggcagacccagccccctggaggcccccaacgagagacagagagagctggccgtgaagtgcctgagactgctgacccacaccttcaacagagagtacacccacagccacgtgtgcgtgagcgccagcgagagcaagctgagcgagatgagcgtgaccctgctgagagaccccagcatgagccccctgggcgtggccaccctgacccccagcagcacctgccccagcctggtggagggcagatacggcgccaccgacctgagaaccccccagccctgcagcagacccgccagccccgagcccgagctgctgcccgaggccgacagcaagaagctgcccagccccgccagagccaccgagaccgacaaggagccccagagactgctggtgcccgacatccaggagatcagagtgagccccatcgtgagcaagaagggctacctgcacttcctggagccccacaccagcggctgggccagaagattcgtggtggtgagaagaccctacgcctacatgtacaacagcgacaaggacaccgtggagagattcgtgctgaacctggccaccgcccaggtggagtacagcgaggaccagcaggccatgctgaagacccccaacaccttcgccgtgtgcaccgagcacagaggcatcctgctgcaggccgccagcgacaaggacatgcacgactggctgtacgccttcaaccccctgctggccggcaccatcagaagcaagctgagcagaagaagaagcgcccagatgagagtgtag

SEQ ID NO: 86224 - DNA, 5400 bp, Artificial Sequence
  Description of Artificial Sequence: Synthetic coding sequence
atggccggcgccagcgtgaaggtggccgtgagagtgagacccttcaacagcagagagatgagcagagacagcaagtgcatcatccagatgagcggcagcaccaccaccatcgtgaaccccaagcagcccaaggagacccccaagagcttcagcttcgactacagctactggagccacaccagccccgaggacatcaactacgccagccagaagcaggtgtacagagacatcggcgaggagatgctgcagcacgccttcgagggctacaacgtgtgcatcttcgcctacggccagaccggcgccggcaagagctacaccatgatgggcaagcaggagaaggaccagcagggcatcatcccccagctgtgcgaggacctgttcagcagaatcaacgacaccaccaacgacaacatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaacgacatccaggacctgatggacagcggcaacaaggccagaaccgtggccgccaccaacatgaacgagaccagcagcagaagccacgccgtgttcaacatcatcttcacccagaagagacacgacgccgagaccaacatcaccaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgagatggtgagcggccccgccagaaacaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcagatgcaacgccgtgatcaacgaggaccccaacaacaagctgatcagagagctgaaggacgaggtgaccagactgagagacctgctgtacgcccagggcctgggcgacatcaccgacaccaacaccgtgcccggcggccccaagctgaccaacgccctggtgggcatgagccccagcagcagcctgagcgccctgagcagcagagccgccagcgtgagcagcctgcacgagagaatcctgttcgcccccggcagcgaggaggccatcgagagactgaaggagaccgagaagatcatcgccgagctgaacgagacctgggaggagaagctgagaagaaccgaggccatcagaatggagagagaggccctgctggccgagatgggcgtggccatgagagaggacggcggcaccctgggcgtgttcagccccaagaagaccccccacctggtgaacctgaacgaggaccccctgatgagcgagtgcctgctgtactacatcaaggacggcatcaccagagtgggcagagaggacggcgagagaagacaggacatcgtgctgagcggccacttcatcaaggaggagcactgcgtgttcagaagcgacagcagaggcggcagcgaggccgtggtgaccctggagccctgcgagggcgccgacacctacgtgaacggcaagaaggtgaccgagcccagcatcctgagaagcggcaacagaatcatcatgggcaagagccacgtgttcagattcaaccaccccgagcaggccagacaggagagagagagaaccccctgcgccgagacccccgccgagcccgtggactgggccttcgcccagagagagctgctggagaagcagggcatcgacatgaagcaggagatggagcagagactgcaggagctggaggaccagtacagaagagagagagaggaggccacctacctgctggagcagcagagactggactacgagagcaagctggaggccctgcagaagcagatggacagcagatactaccccgaggtgaacgaggaggaggaggagcccgaggacgaggtgcagtggaccgagagagagtgcgagctggccctgtgggccttcagaaagtggaagtggtaccagttcaccagcctgagagacctgctgtggggcaacgccatcttcctgaaggaggccaacgccatcagcgtggagctgaagaagaaggtgcagttccagttcgtgctgctgaccgacaccctgtacagccccctgccccccgacctgctgccccccgaggccgccaaggacagagagaccagacccttccccagaaccatcgtggccgtggaggtgcaggaccagaagaacggcgccacccactactggaccctggagaagctgagacagagactggacctgatgagagagatgtacgacagagccgccgaggtgcccagcagcgtgatcgaggactgcgacaacgtggtgaccggcggcgaccccttctacgacagattcccctggttcagactggtgggcagcagcgccatcagcggctgcaacagctaccccctgctgaacacctgcatgagcgagagaatggccgccctgacccccagccccaccttcagcagccccgacagcgacgccaccgagcccgccgaggagcagagcgtgggcgaggaggaggaggaggaggaggaggaggaggacgaggaggaggaggacctggaggacgacgtgttccccgagcacgccctgtgcgacggcagagaccccttctacgacagaccccccctgttcagcctggtgggcagagccttcgtgtacctgagcaacctgctgtaccccgtgcccctggtgcacagagtggccatcgtgagcgagaagggcgaggtgaagggcttcctgagagtggccgtgcaggccatcagcgccgacgaggaggcccccgactacggcagcggcgtgagacagagcggcaccgccaagatcagcttcgacgaccagcacttcgagaagttccagagcgagagctgccccgtggtgggcatgagcagaagcggcaccagccaggaggagctgagaatcgtggagggccagggccagggcgccgacgtgggccccagcgccgacgaggtgaacaacaacacctgcagcgccgtgccccccgagggcctgctgctggacagcagcgagaaggccgccctggacggccccctggacgccgccctggaccacctgagactgggcaacaccttcaccttcagagtgaccgtgctgcaggccagcagcatcagcgccgagtacgccgacatcttctgccagttcaacttcatccacagacacgacgaggccttcagcaccgagcccctgaagaacaccggcagaggcccccccctgggcttctaccacgtgcagaacatcgccgtggaggtgaccaagagcttcatcgagtacatcaagagccagcccatcgtgttcgaggtgttcggccactaccagcagcaccccttcccccccctgtgcaaggacgtgctgagccccctgagacccagcagaagacacttccccagagtgatgcccctgagcaagcccgtgcccgccaccaagctgagcaccctgaccagaccctgccccggcccctgccactgcaagtacgacctgctggtgtacttcgagatctgcgagctggaggccaacggcgactacatccccgccgtggtggaccacagaggcggcatgccctgcatgggcaccttcctgctgcaccagggcatccagagaagaatcaccgtgaccctgctgcacgagaccggcagccacatcagatggaaggaggtgagagagctggtggtgggcagaatcagaaacacccccgagaccgacgagagcctgatcgaccccaacatcctgagcctgaacatcctgagcagcggctacatccaccccgcccaggacgacagagtgagcctgggcaacgacaccagaaccttctaccagttcgaggccgcctgggacagcagcatgcacaacagcctgctgctgaacagagtgaccccctacagagagaagatctacatgaccctgagcgcctacatcgagatggagaactgcacccagcccgccgtggtgaccaaggacttctgcatggtgttctacagcagagacgccaagctgcccgccagcagaagcatcagaaacctgttcggcagcggcagcctgagagccagcgagagcaacagagtgaccggcgtgtacgagctgagcctgtgccacgtggccgacgccggcagccccggcatgcagagaagaagaagaagagtgctggacaccagcgtggcctacgtgagaggcgaggagaacctggccggctggagacccagaagcgacagcctgatcctggaccaccagtgggagctggagaagctgagcctgctgcaggaggtggagaagaccagacactacctgctgctgagagagaagctggagaccgcccagagacccgtgcccgaggccctgagccccgccttcagcgaggacagcgagagccacggcagcagcagcgccagcagccccctgagcgccgagggcagacccagccccctggaggcccccaacgagagacagagagagctggccgtgaagtgcctgagactgctgacccacaccttcaacagagagtacacccacagccacgtgtgcgtgagcgccagcgagagcaagctgagcgagatgagcgtgaccctgctgagagaccccagcatgagccccctgggcgtggccaccctgacccccagcagcacctgccccagcctggtggagggcagatacggcgccaccgacctgagaaccccccagccctgcagcagacccgccagccccgagcccgagctgctgcccgaggccgacagcaagaagctgcccagccccgccagagccaccgagaccgacaaggagccccagagactgctggtgcccgacatccaggagatcagagtgagccccatcgtgagcaagaagggctacctgcacttcctggagccccacaccagcggctgggccagaagattcgtggtggtgagaagaccctacgcctacatgtacaacagcgacaaggacaccgtggagagattcgtgctgaacctggccaccgcccaggtggagtacagcgaggaccagcaggccatgctgaagacccccaacaccttcgccgtgtgcaccgagcacagaggcatcctgctgcaggccgccagcgacaaggacatgcacgactggctgtacgccttcaaccccctgctggccggcaccatcagaagcaagctgagcagaagaagaagcgcccagatgagagtgtag

SEQ ID NO: 86225 - DNA, 117 bp, Artificial Sequence
  Description of Artificial Sequence: Synthetic coding sequence
atggccggcgccagcgtgaaggtggccgtgagagtgagacccttcaacagcagagagatgagcagagacagcaagtgcatcatccagatgagcggcagcaccaccaccatcgtgtag

SEQ ID NO: 86226 - DNA, 5376 bp, Artificial Sequence
  Description of Artificial Sequence: Synthetic coding sequence
atggccggcgccagcgtgaaggtggccgtgagagtgagacccttcaacagcagagagatgagcagagacagcaagtgcatcatccagatgagcggcagcaccaccaccatcgtgaaccccaagcagcccaaggagacccccaagagcttcagcttcgactacagctactggagccacaccagccccgaggacatcaactacgccagccagaagcaggtgtacagagacatcggcgaggagatgctgcagcacgccttcgagggctacaacgtgtgcatcttcgcctacggccagaccggcgccggcaagagctacaccatgatgggcaagcaggagaaggaccagcagggcatcatcccccagctgtgcgaggacctgttcagcagaatcaacgacaccaccaacgacaacatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaacgacatccaggacctgatggacagcggcaacaaggccagaaccgtggccgccaccaacatgaacgagaccagcagcagaagccacgccgtgttcaacatcatcttcacccagaagagacacgacgccgagaccaacatcaccaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgagatggacagcggccccaacaagaacaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcagatgcaacgccgtgatcaacgaggaccccaacaacaagctgatcagagagctgaaggacgaggtgaccagactgagagacctgctgtacgcccagggcctgggcgacatcaccgacaccaacaccgtgcccggcggccccaagctgaccaacgccctggtgggcatgagccccagcagcagcctgagcgccctgagcagcagagccgccagcgtgagcagcctgcacgagagaatcctgttcgcccccggcagcgaggaggccatcgagagactgaaggagaccgagaagatcatcgccgagctgaacgagacctgggaggagaagctgagaagaaccgaggccatcagaatggagagagaggccctgctggccgagatgggcgtggccatgagagaggacggcggcaccctgggcgtgttcagccccaagaagaccccccacctggtgaacctgaacgaggaccccctgatgagcgagtgcctgctgtactacatcaaggacggcatcaccagagtgggcagagaggacggcgagagaagacaggacatcgtgctgagcggccacttcatcaaggaggagcactgcgtgttcagaagcgacagcagaggcggcagcgaggccgtggtgaccctggagccctgcgagggcgccgacacctacgtgaacggcaagaaggtgaccgagcccagcatcctgagaagcggcaacagaatcatcatgggcaagagccacgtgttcagattcaaccaccccgagcaggccagacaggagagagagagaaccccctgcgccgagacccccgccgagcccgtggactgggccttcgcccagagagagctgctggagaagcagggcatcgacatgaagcaggagatggagcagagactgcaggagctggaggaccagtacagaagagagagagaggaggccacctacctgctggagcagcagagactggactacgagagcaagctggaggccctgcagaagcagatggacagcagatactaccccgaggtgaacgaggaggaggaggagcccgaggacgaggtgcagtggaccgagagagagtgcgagctggccctgtgggccttcagaaagtggaagtggtaccagttcaccagcctgagagacctgctgtggggcaacgccatcttcctgaaggaggccaacgccatcagcgtggagctgaagaagaaggtgcagttccagttcgtgctgctgaccgacaccctgtacagccccctgccccccgacctgctgccccccgaggccgccaaggacagagagaccagacccttccccagaaccatcgtggccgtggaggtgcaggaccagaagaacggcgccacccactactggaccctggagaagctgagacagagactggacctgatgagagagatgtacgacagagccgccgaggtgcccagcagcgtgatcgaggactgcgacaacgtggtgaccggcggcgaccccttctacgacagattcccctggttcagactggtgggcagcagcgccatcagcggctgcaacagctaccccctgctgaacacctgcatgagcgagagaatggccgccctgacccccagccccaccttcagcagccccgacagcgacgccaccgagcccgccgaggagcagagcgtgggcgaggaggaggaggaggaggaggaggaggaggacgaggaggaggaggacctggaggacgacgtgttccccgagcacgccctgtgcgacggcagagaccccttctacgacagaccccccctgttcagcctggtgggcagagccttcgtgtacctgagcaacctgctgtaccccgtgcccctggtgcacagagtggccatcgtgagcgagaagggcgaggtgaagggcttcctgagagtggccgtgcaggccatcagcgccgacgaggaggcccccgactacggcagcggcgtgagacagagcggcaccgccaagatcagcttcgacgaccagcacttcgagaagttccagagcgagagctgccccgtggtgggcatgagcagaagcggcaccagccaggaggagctgagaatcgtggagggccagggccagggcgccgacgtgggccccagcgccgacgaggtgaacaacaacacctgcagcgccgtgccccccgagggcctgctgctggacagcagcgagaaggccgccctggacggccccctggacgccgccctggaccacctgagactgggcaacaccttcaccttcagagtgaccgtgctgcaggccagcagcatcagcgccgagtacgccgacatcttctgccagttcaacttcatccacagacacgacgaggccttcagcaccgagcccctgaagaacaccggcagaggcccccccctgggcttctaccacgtgcagaacatcgccgtggaggtgaccaagagcttcatcgagtacatcaagagccagcccatcgtgttcgaggtgttcggccactaccagcagcaccccttcccccccctgtgcaaggacgtgctgagccccctgagacccagcagaagacacttccccagagtgatgcccctgagcaagcccgtgcccgccaccaagctgagcaccctgaccagaccctgccccggcccctgccactgcaagtacgacctgctggtgtacttcgagatctgcgagctggaggccaacggcgactacatccccgccgtggtggaccacagaggcggcatgccctgcatgggcaccttcctgctgcaccagggcatccagagaagaatcaccgtgaccctgctgcacgagaccggcagccacatcagatggaaggaggtgagagagctggtggtgggcagaatcagaaacacccccgagaccgacgagagcctgatcgaccccaacatcctgagcctgaacatcctgagcagcggctacatccaccccgcccaggacgacagaaccttctaccagttcgaggccgcctgggacagcagcatgcacaacagcctgctgctgaacagagtgaccccctacagagagaagatctacatgaccctgagcgcctacatcgagatggagaactgcacccagcccgccgtggtgaccaaggacttctgcatggtgttctacagcagagacgccaagctgcccgccagcagaagcatcagaaacctgttcggcagcggcagcctgagagccagcgagagcaacagagtgaccggcgtgtacgagctgagcctgtgccacgtggccgacgccggcagccccggcatgcagagaagaagaagaagagtgctggacaccagcgtggcctacgtgagaggcgaggagaacctggccggctggagacccagaagcgacagcctgatcctggaccaccagtgggagctggagaagctgagcctgctgcaggaggtggagaagaccagacactacctgctgctgagagagaagctggagaccgcccagagacccgtgcccgaggccctgagccccgccttcagcgaggacagcgagagccacggcagcagcagcgccagcagccccctgagcgccgagggcagacccagccccctggaggcccccaacgagagacagagagagctggccgtgaagtgcctgagactgctgacccacaccttcaacagagagtacacccacagccacgtgtgcgtgagcgccagcgagagcaagctgagcgagatgagcgtgaccctgctgagagaccccagcatgagccccctgggcgtggccaccctgacccccagcagcacctgccccagcctggtggagggcagatacggcgccaccgacctgagaaccccccagccctgcagcagacccgccagccccgagcccgagctgctgcccgaggccgacagcaagaagctgcccagccccgccagagccaccgagaccgacaaggagccccagagactgctggtgcccgacatccaggagatcagagtgagccccatcgtgagcaagaagggctacctgcacttcctggagccccacaccagcggctgggccagaagattcgtggtggtgagaagaccctacgcctacatgtacaacagcgacaaggacaccgtggagagattcgtgctgaacctggccaccgcccaggtggagtacagcgaggaccagcaggccatgctgaagacccccaacaccttcgccgtgtgcaccgagcacagaggcatcctgctgcaggccgccagcgacaaggacatgcacgactggctgtacgccttcaaccccctgctggccggcaccatcagaagcaagctgagcagaagaagaagcgcccagatgagagtgtag

SEQ ID NO: 86227 - DNA, 5313 bp, Artificial Sequence
  Description of Artificial Sequence: Synthetic coding sequence
atgagcggcgccagcgtgaaggtggccgtgagagtgagacccttcaacagcagagagaccagcaaggagagcaagtgcatcatccagatgcagggcaacagcaccagcatcatcaaccccaagaaccccaaggaggcccccaagagcttcagcttcgactacagctactggagccacaccagccccgaggacccctgcttcgccagccagaacagagtgtacaacgacatcggcaaggagatgctgctgcacgccttcgagggctacaacgtgtgcatcttcgcctacggccagaccggcgccggcaagagctacaccatgatgggcaagcaggaggagagccaggccggcatcatcccccagctgtgcgaggagctgttcgagaagatcaacgacaactgcaacgaggagatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaccgacatcgccgacctgatggacgccggcaacaaggccagaaccgtggccgccaccaacatgaacgagaccagcagcagaagccacgccgtgttcaccatcgtgttcacccagaagaagcacgacaacgagaccaacctgagcaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgaggtgagcaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcaagtgcaacgccgtgatcaacgaggaccccaacgccaagctggtgagagagctgaaggaggaggtgaccagactgaaggacctgctgagagcccagggcctgggcgacatcatcgacaccagcatgggcagcctgaccagcagccccagcagctgcagcctgagcagccaggtgggcctgaccagcgtgaccagcatccaggagagaatcatgagcacccccggcggcgaggaggccatcgagagactgaaggagagcgagaagatcatcgccgagctgaacgagacctgggaggagaagctgagaaagaccgaggccatcagaatggagagagaggccctgctggccgagatgggcgtggccatcagagaggacggcggcaccctgggcgtgttcagccccaagaagaccccccacctggtgaacctgaacgaggaccccctgatgagcgagtgcctgctgtactacatcaaggacggcatcaccagagtgggccaggccgacgccgagagaagacaggacatcgtgctgagcggcgcccacatcaaggaggagcactgcatcttcagaagcgagagaagcaacagcggcgaggtgatcgtgaccctggagccctgcgagagaagcgagacctacgtgaacggcaagagagtgagccagcccgtgcagctgagaagcggcaacagaatcatcatgggcaagaaccacgtgttcagattcaaccaccccgagcaggccagagccgagagagagaagacccccagcgccgagacccccagcgagcccgtggactggaccttcgcccagagagagctgctggagaagcagggcatcgacatgaagcaggagatggagaagagactgcaggagatggagatcctgtacaagaaggagaaggaggaggccgacctgctgctggagcagcagagactggactacgagagcaagctgcaggccctgcagaagcaggtggagaccagaagcctggccgccgagaccaccgaggaggaggaggaggaggaggaggtgccctggacccagcacgagttcgagctggcccagtgggccttcagaaagtggaagagccaccagttcaccagcctgagagacctgctgtggggcaacgccgtgtacctgaaggaggccaacgccatcagcgtggagctgaagaagaaggtgcagttccagttcgtgctgctgaccgacaccctgtacagccccctgccccccgagctgctgcccaccgagatggagaagacccacgaggacagacccttccccagaaccgtggtggccgtggaggtgcaggacctgaagaacggcgccacccactactggagcctggagaagctgaagcagagactggacctgatgagagagatgtacgacagagccggcgagatggccagcagcgcccaggacgagagcgagaccaccgtgaccggcagcgaccccttctacgacagattccactggttcaagctggtgggcagcagccccatcttccacggctgcgtgaacgagagactggccgacagaacccccagccccaccttcagcaccgccgacagcgacatcaccgagctggccgacgagcagcaggacgagatggaggacttcgacgacgaggccttcgtggacgacgccggcagcgacgccggcaccgaggagggcagcgacctgttcagcgacggccacgaccccttctacgacagaagcccctggttcatcctggtgggcagagccttcgtgtacctgagcaacctgctgtaccccgtgcccctgatccacagagtggccatcgtgagcgagaagggcgaggtgagaggcttcctgagagtggccgtgcaggccatcgccgccgacgaggaggcccccgactacggcagcggcatcagacagagcggcaccgccaagatcagcttcgacaacgagtacttcaaccagagcgacttcagcagcgtggccatgaccagaagcggcctgagcctggaggagctgagaatcgtggagggccagggccagagcagcgaggtgatcaccccccccgaggagatcagcagaatcaacgacctggacctgaagagcagcaccctgctggacggcaagatggtgatggagggcttcagcgaggagatcggcaaccacctgaagctgggcagcgccttcaccttcagagtgaccgtgctgcaggccagcggcatcctgcccgagtacgccgacatcttctgccagttcaacttcctgcacagacacgacgaggccttcagcaccgagcccctgaagaacaacggcagaggcagccccctggccttctaccacgtgcagaacatcgccgtggagatcaccgagagcttcgtggactacatcaagaccaagcccatcgtgttcgaggtgttcggccactaccagcagcaccccctgcacctgcagggccaggagctgaacagccccccccagccctgcagaagattcttccccccccccatgcccctgagcaagcccgtgcccgccaccaagctgaacaccatgagcaagaccagcctgggccagagcatgagcaagtacgacctgctggtgtggttcgagatcagcgagctggagcccaccggcgagtacatccccgccgtggtggaccacaccgccggcctgccctgccagggcaccttcctgctgcaccagggcatccagagaagaatcaccgtgaccatcatccacgagaagggcagcgagctgcactggaaggacgtgagagagctggtggtgggcagaatcagaaacaagcccgaggtggacgaggccgccgtggacgccatcctgagcctgaacatcatcagcgccaagtacctgaagagcagccacaacagcagcagaaccttctacagattcgaggccgtgtgggacagcagcctgcacaacagcctgctgctgaacagagtgaccccctacggcgagaagatctacatgaccctgagcgcctacctggagctggaccactgcatccagcccgccgtgatcaccaaggacgtgtgcatggtgttctacagcagagacgccaagatcagcccccccagaagcctgagaagcctgttcggcagcggctacagcaagagccccgacagcaacagagtgaccggcatctacgagctgagcctgtgcaagatgagcgacaccggcagccccggcatgcagagaagaagaagaaagatcctggacaccagcgtggcctacgtgagaggcgaggagaacctggccggctggagacccagaggcgacagcctgatcctggagcaccagtgggagctggagaagctggagctgctgcacgaggtggagaagaccagacacttcctgctgctgagagagagactgggcgacagcatccccaagagcctgagcgacagcctgagccccagcctgagcagcggcaccctgagcaccagcaccagcatcagcagccagatcagcaccaccaccttcgagagcgccatcacccccagcgagagcagcggctacgacagcggcgacatcgagagcctggtggacagagagaaggagctggccaccaagtgcctgcagctgctgacccacaccttcaacagagagttcagccaggtgcacggcagcgtgagcgactgcaagctgagcgacatcagccccatcggcagagaccccagcgagagcagcttcagcagcgccaccctgacccccagcagcacctgccccagcctggtggacagcagaagcaacagcctggaccagaagacccccgaggccaacagcagagccagcagcccctgccccgagttcgagcagttccagatcgtgcccgccgtggagaccccctacctggccagagccggcaagaacgagttcctgaacctggtgcccgacatcgaggagatcagacccagcagcgtggtgagcaagaagggctacctgcacttcaaggagcccctgtacagcaactgggccaagcacttcgtggtggtgagaagaccctacgtgttcatctacaacagcgacaaggaccccgtggagagaggcatcatcaacctgagcaccgcccaggtggagtacagcgaggaccagcaggccatggtgaagacccccaacaccttcgccgtgtgcaccaagcacagaggcgtgctgctgcaggccctgaacgacaaggacatgaacgactggctgtacgccttcaaccccctgctggccggcaccatcagaagcaagctgagcagaagatgccccagccagagcaagtactag

SEQ ID NO: 86228 - DNA, 5472 bp, Artificial Sequence
  Description of Artificial Sequence: Synthetic coding sequence
atgagcggcgccagcgtgaaggtggccgtgagagtgagacccttcaacagcagagagaccagcaaggagagcaagtgcatcatccagatgcagggcaacagcaccagcatcatcaaccccaagaaccccaaggaggcccccaagagcttcagcttcgactacagctactggagccacaccagccccgaggacccctgcttcgccagccagaacagagtgtacaacgacatcggcaaggagatgctgctgcacgccttcgagggctacaacgtgtgcatcttcgcctacggccagaccggcgccggcaagagctacaccatgatgggcaagcaggaggagagccaggccggcatcatcccccagctgtgcgaggagctgttcgagaagatcaacgacaactgcaacgaggagatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaccgacatcgccgacctgatggacgccggcaacaaggccagaaccgtggccgccaccaacatgaacgagaccagcagcagaagccacgccgtgttcaccatcgtgttcacccagaagaagcacgacaacgagaccaacctgagcaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgaggtggacaccagcaagaagaagagcaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcaagtgcaacgccgtgatcaacgaggaccccaacgccaagctggtgagagagctgaaggaggaggtgaccagactgaaggacctgctgagagcccagggcctgggcgacatcatcgacatcgaccccctgatcgacgactacagcggcagcggcagcaagtacctgaaggacttccagaacaacaagcacagatacctgctggccagcgagaaccagagacccggccacttcagcaccgccagcatgggcagcctgaccagcagccccagcagctgcagcctgagcagccaggtgggcctgaccagcgtgaccagcatccaggagagaatcatgagcacccccggcggcgaggaggccatcgagagactgaaggagagcgagaagatcatcgccgagctgaacgagacctgggaggagaagctgagaaagaccgaggccatcagaatggagagagaggccctgctggccgagatgggcgtggccatcagagaggacggcggcaccctgggcgtgttcagccccaagaagaccccccacctggtgaacctgaacgaggaccccctgatgagcgagtgcctgctgtactacatcaaggacggcatcaccagagtgggccaggccgacgccgagagaagacaggacatcgtgctgagcggcgcccacatcaaggaggagcactgcatcttcagaagcgagagaagcaacagcggcgaggtgatcgtgaccctggagccctgcgagagaagcgagacctacgtgaacggcaagagagtgagccagcccgtgcagctgagaagcggcaacagaatcatcatgggcaagaaccacgtgttcagattcaaccaccccgagcaggccagagccgagagagagaagacccccagcgccgagacccccagcgagcccgtggactggaccttcgcccagagagagctgctggagaagcagggcatcgacatgaagcaggagatggagaagagactgcaggagatggagatcctgtacaagaaggagaaggaggaggccgacctgctgctggagcagcagagactggactacgagagcaagctgcaggccctgcagaagcaggtggagaccagaagcctggccgccgagaccaccgaggaggaggaggaggaggaggaggtgccctggacccagcacgagttcgagctggcccagtgggccttcagaaagtggaagagccaccagttcaccagcctgagagacctgctgtggggcaacgccgtgtacctgaaggaggccaacgccatcagcgtggagctgaagaagaaggtgcagttccagttcgtgctgctgaccgacaccctgtacagccccctgccccccgagctgctgcccaccgagatggagaagacccacgaggacagacccttccccagaaccgtggtggccgtggaggtgcaggacctgaagaacggcgccacccactactggagcctggagaagctgaagcagagactggacctgatgagagagatgtacgacagagccggcgagatggccagcagcgcccaggacgagagcgagaccaccgtgaccggcagcgaccccttctacgacagattccactggttcaagctggtgggcagcagccccatcttccacggctgcgtgaacgagagactggccgacagaacccccagccccaccttcagcaccgccgacagcgacatcaccgagctggccgacgagcagcaggacgagatggaggacttcgacgacgaggccttcgtggacgacgccggcagcgacgccggcaccgaggagggcagcgacctgttcagcgacggccacgaccccttctacgacagaagcccctggttcatcctggtgggcagagccttcgtgtacctgagcaacctgctgtaccccgtgcccctgatccacagagtggccatcgtgagcgagaagggcgaggtgagaggcttcctgagagtggccgtgcaggccatcgccgccgacgaggaggcccccgactacggcagcggcatcagacagagcggcaccgccaagatcagcttcgacaacgagtacttcaaccagagcgacttcagcagcgtggccatgaccagaagcggcctgagcctggaggagctgagaatcgtggagggccagggccagagcagcgaggtgatcaccccccccgaggagatcagcagaatcaacgacctggacctgaagagcagcaccctgctggacggcaagatggtgatggagggcttcagcgaggagatcggcaaccacctgaagctgggcagcgccttcaccttcagagtgaccgtgctgcaggccagcggcatcctgcccgagtacgccgacatcttctgccagttcaacttcctgcacagacacgacgaggccttcagcaccgagcccctgaagaacaacggcagaggcagccccctggccttctaccacgtgcagaacatcgccgtggagatcaccgagagcttcgtggactacatcaagaccaagcccatcgtgttcgaggtgttcggccactaccagcagcaccccctgcacctgcagggccaggagctgaacagccccccccagccctgcagaagattcttccccccccccatgcccctgagcaagcccgtgcccgccaccaagctgaacaccatgagcaagaccagcctgggccagagcatgagcaagtacgacctgctggtgtggttcgagatcagcgagctggagcccaccggcgagtacatccccgccgtggtggaccacaccgccggcctgccctgccagggcaccttcctgctgcaccagggcatccagagaagaatcaccgtgaccatcatccacgagaagggcagcgagctgcactggaaggacgtgagagagctggtggtgggcagaatcagaaacaagcccgaggtggacgaggccgccgtggacgccatcctgagcctgaacatcatcagcgccaagtacctgaagagcagccacaacagcagcagaaccttctacagattcgaggccgtgtgggacagcagcctgcacaacagcctgctgctgaacagagtgaccccctacggcgagaagatctacatgaccctgagcgcctacctggagctggaccactgcatccagcccgccgtgatcaccaaggacgtgtgcatggtgttctacagcagagacgccaagatcagcccccccagaagcctgagaagcctgttcggcagcggctacagcaagagccccgacagcaacagagtgaccggcatctacgagctgagcctgtgcaagatgagcgacaccggcagccccggcatgcagagaagaagaagaaagatcctggacaccagcgtggcctacgtgagaggcgaggagaacctggccggctggagacccagaggcgacagcctgatcctggagcaccagtgggagctggagaagctggagctgctgcacgaggtggagaagaccagacacttcctgctgctgagagagagactgggcgacagcatccccaagagcctgagcgacagcctgagccccagcctgagcagcggcaccctgagcaccagcaccagcatcagcagccagatcagcaccaccaccttcgagagcgccatcacccccagcgagagcagcggctacgacagcggcgacatcgagagcctggtggacagagagaaggagctggccaccaagtgcctgcagctgctgacccacaccttcaacagagagttcagccaggtgcacggcagcgtgagcgactgcaagctgagcgacatcagccccatcggcagagaccccagcgagagcagcttcagcagcgccaccctgacccccagcagcacctgccccagcctggtggacagcagaagcaacagcctggaccagaagacccccgaggccaacagcagagccagcagcccctgccccgagttcgagcagttccagatcgtgcccgccgtggagaccccctacctggccagagccggcaagaacgagttcctgaacctggtgcccgacatcgaggagatcagacccagcagcgtggtgagcaagaagggctacctgcacttcaaggagcccctgtacagcaactgggccaagcacttcgtggtggtgagaagaccctacgtgttcatctacaacagcgacaaggaccccgtggagagaggcatcatcaacctgagcaccgcccaggtggagtacagcgaggaccagcaggccatggtgaagacccccaacaccttcgccgtgtgcaccaagcacagaggcgtgctgctgcaggccctgaacgacaaggacatgaacgactggctgtacgccttcaaccccctgctggccggcaccatcagacccggccacctggccagcgagatcatcagagaggacaagagcgtgagcttcagctgccagtag

SEQ ID NO: 86229 - DNA, 5472 bp, Artificial Sequence
  Description of Artificial Sequence: Synthetic coding sequence
atgagcggcgccagcgtgaaggtggccgtgagagtgagacccttcaacagcagagagaccagcaaggagagcaagtgcatcatccagatgcagggcaacagcaccagcatcatcaaccccaagaaccccaaggaggcccccaagagcttcagcttcgactacagctactggagccacaccagccccgaggacccctgcttcgccagccagaacagagtgtacaacgacatcggcaaggagatgctgctgcacgccttcgagggctacaacgtgtgcatcttcgcctacggccagaccggcgccggcaagagctacaccatgatgggcaagcaggaggagagccaggccggcatcatcccccagctgtgcgaggagctgttcgagaagatcaacgacaactgcaacgaggagatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaccgacatcgccgacctgatggacgccggcaacaaggccagaaccgtggccgccaccaacatgaacgagaccagcagcagaagccacgccgtgttcaccatcgtgttcacccagaagaagcacgacaacgagaccaacctgagcaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgaggtggacaactgcaccagcaagagcaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcaagtgcaacgccgtgatcaacgaggaccccaacgccaagctggtgagagagctgaaggaggaggtgaccagactgaaggacctgctgagagcccagggcctgggcgacatcatcgacatcgaccccctgatcgacgactacagcggcagcggcagcaagtacctgaaggacttccagaacaacaagcacagatacctgctggccagcgagaaccagagacccggccacttcagcaccgccagcatgggcagcctgaccagcagccccagcagctgcagcctgagcagccaggtgggcctgaccagcgtgaccagcatccaggagagaatcatgagcacccccggcggcgaggaggccatcgagagactgaaggagagcgagaagatcatcgccgagctgaacgagacctgggaggagaagctgagaaagaccgaggccatcagaatggagagagaggccctgctggccgagatgggcgtggccatcagagaggacggcggcaccctgggcgtgttcagccccaagaagaccccccacctggtgaacctgaacgaggaccccctgatgagcgagtgcctgctgtactacatcaaggacggcatcaccagagtgggccaggccgacgccgagagaagacaggacatcgtgctgagcggcgcccacatcaaggaggagcactgcatcttcagaagcgagagaagcaacagcggcgaggtgatcgtgaccctggagccctgcgagagaagcgagacctacgtgaacggcaagagagtgagccagcccgtgcagctgagaagcggcaacagaatcatcatgggcaagaaccacgtgttcagattcaaccaccccgagcaggccagagccgagagagagaagacccccagcgccgagacccccagcgagcccgtggactggaccttcgcccagagagagctgctggagaagcagggcatcgacatgaagcaggagatggagaagagactgcaggagatggagatcctgtacaagaaggagaaggaggaggccgacctgctgctggagcagcagagactggactacgagagcaagctgcaggccctgcagaagcaggtggagaccagaagcctggccgccgagaccaccgaggaggaggaggaggaggaggaggtgccctggacccagcacgagttcgagctggcccagtgggccttcagaaagtggaagagccaccagttcaccagcctgagagacctgctgtggggcaacgccgtgtacctgaaggaggccaacgccatcagcgtggagctgaagaagaaggtgcagttccagttcgtgctgctgaccgacaccctgtacagccccctgccccccgagctgctgcccaccgagatggagaagacccacgaggacagacccttccccagaaccgtggtggccgtggaggtgcaggacctgaagaacggcgccacccactactggagcctggagaagctgaagcagagactggacctgatgagagagatgtacgacagagccggcgagatggccagcagcgcccaggacgagagcgagaccaccgtgaccggcagcgaccccttctacgacagattccactggttcaagctggtgggcagcagccccatcttccacggctgcgtgaacgagagactggccgacagaacccccagccccaccttcagcaccgccgacagcgacatcaccgagctggccgacgagcagcaggacgagatggaggacttcgacgacgaggccttcgtggacgacgccggcagcgacgccggcaccgaggagggcagcgacctgttcagcgacggccacgaccccttctacgacagaagcccctggttcatcctggtgggcagagccttcgtgtacctgagcaacctgctgtaccccgtgcccctgatccacagagtggccatcgtgagcgagaagggcgaggtgagaggcttcctgagagtggccgtgcaggccatcgccgccgacgaggaggcccccgactacggcagcggcatcagacagagcggcaccgccaagatcagcttcgacaacgagtacttcaaccagagcgacttcagcagcgtggccatgaccagaagcggcctgagcctggaggagctgagaatcgtggagggccagggccagagcagcgaggtgatcaccccccccgaggagatcagcagaatcaacgacctggacctgaagagcagcaccctgctggacggcaagatggtgatggagggcttcagcgaggagatcggcaaccacctgaagctgggcagcgccttcaccttcagagtgaccgtgctgcaggccagcggcatcctgcccgagtacgccgacatcttctgccagttcaacttcctgcacagacacgacgaggccttcagcaccgagcccctgaagaacaacggcagaggcagccccctggccttctaccacgtgcagaacatcgccgtggagatcaccgagagcttcgtggactacatcaagaccaagcccatcgtgttcgaggtgttcggccactaccagcagcaccccctgcacctgcagggccaggagctgaacagccccccccagccctgcagaagattcttccccccccccatgcccctgagcaagcccgtgcccgccaccaagctgaacaccatgagcaagaccagcctgggccagagcatgagcaagtacgacctgctggtgtggttcgagatcagcgagctggagcccaccggcgagtacatccccgccgtggtggaccacaccgccggcctgccctgccagggcaccttcctgctgcaccagggcatccagagaagaatcaccgtgaccatcatccacgagaagggcagcgagctgcactggaaggacgtgagagagctggtggtgggcagaatcagaaacaagcccgaggtggacgaggccgccgtggacgccatcctgagcctgaacatcatcagcgccaagtacctgaagagcagccacaacagcagcagaaccttctacagattcgaggccgtgtgggacagcagcctgcacaacagcctgctgctgaacagagtgaccccctacggcgagaagatctacatgaccctgagcgcctacctggagctggaccactgcatccagcccgccgtgatcaccaaggacgtgtgcatggtgttctacagcagagacgccaagatcagcccccccagaagcctgagaagcctgttcggcagcggctacagcaagagccccgacagcaacagagtgaccggcatctacgagctgagcctgtgcaagatgagcgacaccggcagccccggcatgcagagaagaagaagaaagatcctggacaccagcgtggcctacgtgagaggcgaggagaacctggccggctggagacccagaggcgacagcctgatcctggagcaccagtgggagctggagaagctggagctgctgcacgaggtggagaagaccagacacttcctgctgctgagagagagactgggcgacagcatccccaagagcctgagcgacagcctgagccccagcctgagcagcggcaccctgagcaccagcaccagcatcagcagccagatcagcaccaccaccttcgagagcgccatcacccccagcgagagcagcggctacgacagcggcgacatcgagagcctggtggacagagagaaggagctggccaccaagtgcctgcagctgctgacccacaccttcaacagagagttcagccaggtgcacggcagcgtgagcgactgcaagctgagcgacatcagccccatcggcagagaccccagcgagagcagcttcagcagcgccaccctgacccccagcagcacctgccccagcctggtggacagcagaagcaacagcctggaccagaagacccccgaggccaacagcagagccagcagcccctgccccgagttcgagcagttccagatcgtgcccgccgtggagaccccctacctggccagagccggcaagaacgagttcctgaacctggtgcccgacatcgaggagatcagacccagcagcgtggtgagcaagaagggctacctgcacttcaaggagcccctgtacagcaactgggccaagcacttcgtggtggtgagaagaccctacgtgttcatctacaacagcgacaaggaccccgtggagagaggcatcatcaacctgagcaccgcccaggtggagtacagcgaggaccagcaggccatggtgaagacccccaacaccttcgccgtgtgcaccaagcacagaggcgtgctgctgcaggccctgaacgacaaggacatgaacgactggctgtacgccttcaaccccctgctggccggcaccatcagacccggccacctggccagcgagatcatcagagaggacaagagcgtgagcttcagctgccagtag

SEQ ID NO: 86230 - DNA, 3462 bp, Artificial Sequence
  Description of Artificial Sequence: Synthetic coding sequence
atgagcggcgccagcgtgaaggtggccgtgagagtgagacccttcaacagcagagagaccagcaaggagagcaagtgcatcatccagatgcagggcaacagcaccagcatcatcaaccccaagaaccccaaggaggcccccaagagcttcagcttcgactacagctactggagccacaccagccccgaggacccctgcttcgccagccagaacagagtgtacaacgacatcggcaaggagatgctgctgcacgccttcgagggctacaacgtgtgcatcttcgcctacggccagaccggcgccggcaagagctacaccatgatgggcaagcaggaggagagccaggccggcatcatcccccagctgtgcgaggagctgttcgagaagatcaacgacaactgcaacgaggagatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaccgacatcgccgacctgatggacgccggcaacaaggccagaaccgtggccgccaccaacatgaacgagaccagcagcagaagccacgccgtgttcaccatcgtgttcacccagaagaagcacgacaacgagaccaacctgagcaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgaggtgagcaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcaagtgcaacgccgtgatcaacgaggaccccaacgccaagctggtgagagagctgaaggaggaggtgaccagactgaaggacctgctgagagcccagggcctgggcgacatcatcgacaccagcatgggcagcctgaccagcagccccagcagctgcagcctgagcagccaggtgggcctgaccagcgtgaccagcatccaggagagaatcatgagcacccccggcggcgaggaggccatcgagagactgaaggagagcgagaagatcatcgccgagctgaacgagacctgggaggagaagctgagaaagaccgaggccatcagaatggagagagaggccctgctggccgagatgggcgtggccatcagagaggacggcggcaccctgggcgtgttcagccccaagaagaccccccacctggtgaacctgaacgaggaccccctgatgagcgagtgcctgctgtactacatcaaggacggcatcaccagagtgggccaggccgacgccgagagaagacaggacatcgtgctgagcggcgcccacatcaaggaggagcactgcatcttcagaagcgagagaagcaacagcggcgaggtgatcgtgaccctggagccctgcgagagaagcgagacctacgtgaacggcaagagagtgagccagcccgtgcagctgagaagcggcaacagaatcatcatgggcaagaaccacgtgttcagattcaaccaccccgagcaggccagagccgagagagagaagacccccagcgccgagacccccagcgagcccgtggactggaccttcgcccagagagagctgctggagaagcagggcatcgacatgaagcaggagatggagaagagactgcaggagatggagatcctgtacaagaaggagaaggaggaggccgacctgctgctggagcagcagagactggacgccgacagcgacagcggcgacgacagcgacaagagaagctgcgaggagagctggaagctgatcaccagcctgagagagaagctgccccccagcaagctgcagaccatcgtgaagaagtgcggcctgcccagcagcggcaagaagagagagcccatcaagatgtaccagatcccccagagaagaagactgagcaaggacagcaagtgggtgaccatcagcgacctgaagatccaggccgtgaaggagatctgctacgaggtggccctgaacgacttcagacacagcagacaggagatcgaggccctggccatcgtgaagatgaaggagctgtgcgccatgtacggcaagaaggaccccaacgagagagacagctggagagccgtggccagagacgtgtgggacaccgtgggcgtgggcgacgagaagatcgaggacgtgatggccaccggcaagggcagcaccgacgtggacgacctgaaggtgcacatcgacaagctggaggacatcctgcaggaggtgaagaagcagaacaacatgaaggacgaggagatcaaggtgctgagaaacaagatgctgaagatggagaaggtgctgcccctgatcggcagccaggagcagaagagccccggcagccacaaggccaaggagcccgtgggcgccggcgtgagcagcaccagcgagaacaacgtgagcaagggcgacaacggcgagctggccaaggaggagagagtgagccagctgatgaacggcgaccccgccttcagaagaggcagactgagatggatgagacaggagcagatcagattcaagaacctgcagcagcaggagatcaccaagcagctgagaagacagaacgtgccccacagattcatcccccccgagaacagaaagcccagattccccttcaagagcaaccccaagcacagaaacagctggagccccggcacccacatcatcatcaccgaggacgaggtgatcgagctgagaatccccaaggacgacgaggccagaaagggcaacaaggaggagagccaggagaagggcggcaagggcgccttcaaggacccccagttcccctggggcagccagggcatgagaagccaggaccacatccaggtgagcaagcagcacatcaacaaccagcagcagcccccccagctgagatggagaagcaacagcctgaacaacggccagcccaagagcaccagatgccaggccagcgccagcgccgagagcctgaacagccacagcggccaccccaccgccgacgtgcagaccttccaggccaagagacacatccaccagcacagacagagctactgcaactacaacaccggcggccagctggagggcaacgccgccaccagctaccagaagcagaccgacaagcccagccactgcagccagttcgtgaccccccccagaatgagaagacagttcagcgcccccaacctgaaggccggcagagagaccaccgtgtag

SEQ ID NO: 86231 - DNA, 5451 bp, Artificial Sequence
  Description of Artificial Sequence: Synthetic coding sequence
atgagcggcgccagcgtgaaggtggccgtgagagtgagacccttcaacagcagagagaccagcaaggagagcaagtgcatcatccagatgcagggcaacagcaccagcatcatcaaccccaagaaccccaaggaggcccccaagagcttcagcttcgactacagctactggagccacaccagccccgaggacccctgcttcgccagccagaacagagtgtacaacgacatcggcaaggagatgctgctgcacgccttcgagggctacaacgtgtgcatcttcgcctacggccagaccggcgccggcaagagctacaccatgatgggcaagcaggaggagagccaggccggcatcatcccccagctgtgcgaggagctgttcgagaagatcaacgacaactgcaacgaggagatgagctacagcgtggaggtgagctacatggagatctactgcgagagagtgagagacctgctgaaccccaagaacaagggcaacctgagagtgagagagcaccccctgctgggcccctacgtggaggacctgagcaagctggccgtgaccagctacaccgacatcgccgacctgatggacgccggcaacaaggccagaaccgtggccgccaccaacatgaacgagaccagcagcagaagccacgccgtgttcaccatcgtgttcacccagaagaagcacgacaacgagaccaacctgagcaccgagaaggtgagcaagatcagcctggtggacctggccggcagcgagagagccgacagcaccggcgccaagggcaccagactgaaggagggcgccaacatcaacaagagcctgaccaccctgggcaaggtgatcagcgccctggccgaggtggacaactgcaccagcaagagcaagaagaagaagaagaccgacttcatcccctacagagacagcgtgctgacctggctgctgagagagaacctgggcggcaacagcagaaccgccatggtggccgccctgagccccgccgacatcaactacgacgagaccctgagcaccctgagatacgccgacagagccaagcagatcaagtgcaacgccgtgatcaacgaggaccccaacgccaagctggtgagagagctgaaggaggaggtgaccagactgaaggacctgctgagagcccagggcctgggcgacatcatcgacatcgaccccctgatcgacgactacagcggcagcggcagcaagtacctgaaggacttccagaacaacaagcacagatacctgctggccagcgagaaccagagacccggccacttcagcaccgccagcatgggcagcctgaccagcagccccagcagctgcagcctgagcagccaggtgggcctgaccagcgtgaccagcatccaggagagaatcatgagcacccccggcggcgaggaggccatcgagagactgaaggagagcgagaagatcatcgccgagctgaacgagacctgggaggagaagctgagaaagaccgaggccatcagaatggagagagaggccctgctggccgagatgggcgtggccatcagagaggacggcggcaccctgggcgtgttcagccccaagaagaccccccacctggtgaacctgaacgaggaccccctgatgagcgagtgcctgctgtactacatcaaggacggcatcaccagagtgggccaggccgacgccgagagaagacaggacatcgtgctgagcggcgcccacatcaaggaggagcactgcatcttcagaagcgagagaagcaacagcggcgaggtgatcgtgaccctggagccctgcgagagaagcgagacctacgtgaacggcaagagagtgagccagcccgtgcagctgagaagcggcaacagaatcatcatgggcaagaaccacgtgttcagattcaaccaccccgagcaggccagagccgagagagagaagacccccagcgccgagacccccagcgagcccgtggactggaccttcgcccagagagagctgctggagaagcagggcatcgacatgaagcaggagatggagaagagactgcaggagatggagatcctgtacaagaaggagaaggaggaggccgacctgctgctggagcagcagagactggactacgagagcaagctgcaggccctgcagaagcaggtggagaccagaagcctggccgccgagaccaccgaggaggaggaggaggaggaggaggtgccctggacccagcacgagttcgagctggcccagtgggccttcagaaagtggaagagccaccagttcaccagcctgagagacctgctgtggggcaacgccgtgtacctgaaggaggccaacgccatcagcgtggagctgaagaagaaggtgcagttccagttcgtgctgctgaccgacaccctgtacagccccctgccccccgagctgctgcccaccgagatggagaagacccacgaggacagacccttccccagaaccgtggtggccgtggaggtgcaggacctgaagaacggcgccacccactactggagcctggagaagctgaagcagagactggacctgatgagagagatgtacgacagagccggcgagatggccagcagcgcccaggacgagagcgagaccaccgtgaccggcagcgaccccttctacgacagattccactggttcaagctggtgggcagcagccccatcttccacggctgcgtgaacgagagactggccgacagaacccccagccccaccttcagcaccgccgacagcgacatcaccgagctggccgacgagcagcaggacgagatggaggacttcgacgacgaggccttcgtggacgacgccggcagcgacgccggcaccgaggagggcagcgacctgttcagcgacggccacgaccccttctacgacagaagcccctggttcatcctggtgggcagagccttcgtgtacctgagcaacctgctgtaccccgtgcccctgatccacagagtggccatcgtgagcgagaagggcgaggtgagaggcttcctgagagtggccgtgcaggccatcgccgccgacgaggaggcccccgactacggcagcggcatcagacagagcggcaccgccaagatcagcttcgacaacgagtacttcaaccagagcgacttcagcagcgtggccatgaccagaagcggcctgagcctggaggagctgagaatcgtggagggccagggccagagcagcgaggtgatcaccccccccgaggagatcagcagaatcaacgacctggacctgaagagcagcaccctgctggacggcaagatggtgatggagggcttcagcgaggagatcggcaaccacctgaagctgggcagcgccttcaccttcagagtgaccgtgctgcaggccagcggcatcctgcccgagtacgccgacatcttctgccagttcaacttcctgcacagacacgacgaggccttcagcaccgagcccctgaagaacaacggcagaggcagccccctggccttctaccacgtgcagaacatcgccgtggagatcaccgagagcttcgtggactacatcaagaccaagcccatcgtgttcgaggtgttcggccactaccagcagcaccccctgcacctgcagggccaggagctgaacagccccccccagccctgcagaagattcttccccccccccatgcccctgagcaagcccgtgcccgccaccaagctgaacaccatgagcaagaccagcctgggccagagcatgagcaagtacgacctgctggtgtggttcgagatcagcgagctggagcccaccggcgagtacatccccgccgtggtggaccacaccgccggcctgccctgccagggcaccttcctgctgcaccagggcatccagagaagaatcaccgtgaccatcatccacgagaagggcagcgagctgcactggaaggacgtgagagagctggtggtgggcagaatcagaaacaagcccgaggtggacgaggccgccgtggacgccatcctgagcctgaacatcatcagcgccaagtacctgaagagcagccacaacagcagcagaaccttctacagattcgaggccgtgtgggacagcagcctgcacaacagcctgctgctgaacagagtgaccccctacggcgagaagatctacatgaccctgagcgcctacctggagctggaccactgcatccagcccgccgtgatcaccaaggacgtgtgcatggtgttctacagcagagacgccaagatcagcccccccagaagcctgagaagcctgttcggcagcggctacagcaagagccccgacagcaacagagtgaccggcatctacgagctgagcctgtgcaagatgagcgacaccggcagccccggcatgcagagaagaagaagaaagatcctggacaccagcgtggcctacgtgagaggcgaggagaacctggccggctggagacccagaggcgacagcctgatcctggagcaccagtgggagctggagaagctggagctgctgcacgaggtggagaagaccagacacttcctgctgctgagagagagactgggcgacagcatccccaagagcctgagcgacagcctgagccccagcctgagcagcggcaccctgagcaccagcaccagcatcagcagccagatcagcaccaccaccttcgagagcgccatcacccccagcgagagcagcggctacgacagcggcgacatcgagagcctggtggacagagagaaggagctggccaccaagtgcctgcagctgctgacccacaccttcaacagagagttcagccaggtgcacggcagcgtgagcgactgcaagctgagcgacatcagccccatcggcagagaccccagcgagagcagcttcagcagcgccaccctgacccccagcagcacctgccccagcctggtggacagcagaagcaacagcctggaccagaagacccccgaggccaacagcagagccagcagcccctgccccgagttcgagcagttccagatcgtgcccgccgtggagaccccctacctggccagagccggcaagaacgagttcctgaacctggtgcccgacatcgaggagatcagacccagcagcgtggtgagcaagaagggctacctgcacttcaaggagcccctgtacagcaactgggccaagcacttcgtggtggtgagaagaccctacgtgttcatctacaacagcgacaaggaccccgtggagagaggcatcatcaacctgagcaccgcccaggtggagtacagcgaggaccagcaggccatggtgaagacccccaacaccttcgccgtgtgcaccaagcacagaggcgtgctgctgcaggccctgaacgacaaggacatgaacgactggctgtacgccttcaaccccctgctggccggcaccatcagaagcaagctgagcagaagatgccccagccagagcaagtactag

SEQ ID NO: 86232 - DNA, 3462 bp, Artificial Sequence; identical to SEQ ID NO: 86230
  Description of Artificial Sequence: Synthetic coding sequence

SEQ ID NO: 86233 - DNA, 2673 bp, Artificial Sequence
  Description of Artificial Sequence: Synthetic coding sequence
atgagccagggcatcctgagcccccccgccggcctgctgagcgacgacgacgtggtggtgagccccatgttcgagagcaccgccgccgacctgggcagcgtggtgagaaagaacctgctgagcgactgcagcgtggtgagcaccagcctggaggacaagcagcaggtgcccagcgaggacagcatggagaaggtgaaggtgtacctgagagtgagacccctgctgcccagcgagctggagagacaggaggaccagggctgcgtgagaatcgagaacgtggagaccctggtgctgcaggcccccaaggacagcttcgccctgaagagcaacgagagaggcatcggccaggccacccacagattcaccttcagccagatcttcggccccgaggtgggccaggccagcttcttcaacctgaccgtgaaggagatggtgaaggacgtgctgaagggccagaactggctgatctacacctacggcgtgaccaacagcggcaagacccacaccatccagggcaccatcaaggacggcggcatcctgcccagaagcctggccctgatcttcaacagcctgcagggccagctgcaccccacccccgacctgaagcccctgctgagcaacgaggtgatctggctggacagcaagcagatcagacaggaggagatgaagaagctgagcctgctgaacggcggcctgcaggaggaggagctgagcaccagcctgaagagaagcgtgtacatcgagagcagaatcggcaccagcaccagcttcgacagcggcatcgccggcctgagcagcatcagccagtgcaccagcagcagccagctggacgagaccagccacagatgggcccagcccgacaccgcccccctgcccgtgcccgccaacatcagattcagcatctggatcagcttcttcgagatctacaacgagctgctgtacgacctgctggagccccccagccagcagagaaagagacagaccctgagactgtgcgaggaccagaacggcaacccctacgtgaaggacctgaactggatccacgtgcaggacgccgaggaggcctggaagctgctgaaggtgggcagaaagaaccagagcttcgccagcacccacctgaaccagaacagcagcagaagccacagcatcttcagcatcagaatcctgcacctgcagggcgagggcgacatcgtgcccaagatcagcgagctgagcctgtgcgacctggccggcagcgagagatgcaaggaccagaagagcggcgagagactgaaggaggccggcaacatcaacaccagcctgcacaccctgggcagatgcatcgccgccctgagacagaaccagcagaacagaagcaagcagaacctggtgcccttcagagacagcaagctgaccagagtgttccagggcttcttcaccggcagaggcagaagctgcatgatcgtgaacgtgaacccctgcgccagcacctacgacgagaccctgcacgtggccaagttcagcgccatcgccagccagctggtgcacgccccccccatgcagctgggcttccccagcctgcacagcttcatcaaggagcacagcctgcaggtgagccccagcctggagaagggcgccaaggccgacaccggcctggacgacgacatcgagaacgaggccgacatcagcatgtacggcaaggaggagctgctgcaggtggtggaggccatgaagaccctgctgctgaaggagagacaggagaagctgcagctggagatgcacctgagagacgagatctgcaacgagatggtggagcagatgcagcagagagagcagtggtgcagcgagcacctggacacccagaaggagctgctggaggagatgtacgaggagaagctgaacatcctgaaggagagcctgaccagcttctaccaggaggagatccaggagagagacgagaagatcgaggagctggaggccctgctgcaggaggccagacagcagagcgtggcccaccagcagagcggcagcgagctggccctgagaagaagccagagactggccgccagcgccagcacccagcagctgcaggaggtgaaggccaagctgcagcagtgcaaggccgagctgaacagcaccaccgaggagctgcacaagtaccagaagatgctggagcccccccccagcgccaagcccttcaccatcgacgtggacaagaagctggaggagggccagaagaacatcagactgctgagaaccgagctgcagaagctgggcgagagcctgcagagcgccgagagagcctgctgccacagcaccggcgccggcaagctgagacaggccctgaccacctgcgacgacatcctgatcaagcaggaccagaccctggccgagctgcagaacaacatggtgctggtgaagctggacctgagaaagaaggccgcctgcatcgccgagcagtaccacaccgtgctgaagctgcagggccaggtgagcgccaagaagagactgggcaccaaccaggagaaccagcagcccaaccagcagccccccggcaagaagcccttcctgagaaacctgctgcccagaacccccacctgccagagcagcaccgactgcagcccctacgccagaatcctgagaagcagaagaagccccctgctgaagagcggccccttcggcaagaagtactag

SEQ ID NO: 86234 - DNA, 678 bp, Artificial Sequence
  Description of Artificial Sequence: Synthetic coding sequence
atgagccagggcatcctgagcccccccgccggcctgctgagcgacgacgacgtggtggtgagccccatgttcgagagcaccgccgccgacctgggcagcgtggtgagaaagaacctgctgagcgactgcagcgtggtgagcaccagcctggaggacaagcagcaggtgcccagcgaggacagcatggagaaggtgaaggtgtacctgagagtgagacccctgctgcccagcgagctggagagacaggaggaccagggctgcgtgagaatcgagaacgtggagaccctggtgctgcaggcccccaaggacagcttcgccctgaagagcaacgagagaggcatcggccaggccacccacagattcaccttcagccagatcttcggccccgaggtgggccaggccagcttcttcaacctgaccgtgaaggagatggtgaaggacgtgctgaagggccagaactggctgatctacacctacggcgtgaccaacagcggcaagacccacaccatccagggcaccatcaaggacggcggcatcctgcccagaagcctggccctgatcttcaacagcctgcagggccagctgcaccccacccccgacctgaagcccctgctgagcaacgaggtgatctggctggacagcaagcagatcagacaggaggagatgaagaagctgtag

SEQ ID NO: 86235 - DNA, 2619 bp, Artificial Sequence
  Description of Artificial Sequence: Synthetic coding sequence
atgagccagggcatcctgagcccccccgccggcctgctgagcgacgacgacgtggtggtgagccccatgttcgagagcaccgccgccgacctgggcagcgtggtgagaaagaacctgctgagcgactgcagcgtggtgagcaccagcctggaggacaagcagcaggtgcccagcgaggacagcatggagaaggaggaccagggctgcgtgagaatcgagaacgtggagaccctggtgctgcaggcccccaaggacagcttcgccctgaagagcaacgagagaggcatcggccaggccacccacagattcaccttcagccagatcttcggccccgaggtgggccaggccagcttcttcaacctgaccgtgaaggagatggtgaaggacgtgctgaagggccagaactggctgatctacacctacggcgtgaccaacagcggcaagacccacaccatccagggcaccatcaaggacggcggcatcctgcccagaagcctggccctgatcttcaacagcctgcagggccagctgcaccccacccccgacctgaagcccctgctgagcaacgaggtgatctggctggacagcaagcagatcagacaggaggagatgaagaagctgagcctgctgaacggcggcctgcaggaggaggagctgagcaccagcctgaagagaagcgtgtacatcgagagcagaatcggcaccagcaccagcttcgacagcggcatcgccggcctgagcagcatcagccagtgcaccagcagcagccagctggacgagaccagccacagatgggcccagcccgacaccgcccccctgcccgtgcccgccaacatcagattcagcatctggatcagcttcttcgagatctacaacgagctgctgtacgacctgctggagccccccagccagcagagaaagagacagaccctgagactgtgcgaggaccagaacggcaacccctacgtgaaggacctgaactggatccacgtgcaggacgccgaggaggcctggaagctgctgaaggtgggcagaaagaaccagagcttcgccagcacccacctgaaccagaacagcagcagaagccacagcatcttcagcatcagaatcctgcacctgcagggcgagggcgacatcgtgcccaagatcagcgagctgagcctgtgcgacctggccggcagcgagagatgcaaggaccagaagagcggcgagagactgaaggaggccggcaacatcaacaccagcctgcacaccctgggcagatgcatcgccgccctgagacagaaccagcagaacagaagcaagcagaacctggtgcccttcagagacagcaagctgaccagagtgttccagggcttcttcaccggcagaggcagaagctgcatgatcgtgaacgtgaacccctgcgccagcacctacgacgagaccctgcacgtggccaagttcagcgccatcgccagccagctggtgcacgccccccccatgcagctgggcttccccagcctgcacagcttcatcaaggagcacagcctgcaggtgagccccagcctggagaagggcgccaaggccgacaccggcctggacgacgacatcgagaacgaggccgacatcagcatgtacggcaaggaggagctgctgcaggtggtggaggccatgaagaccctgctgctgaaggagagacaggagaagctgcagctggagatgcacctgagagacgagatctgcaacgagatggtggagcagatgcagcagagagagcagtggtgcagcgagcacctggacacccagaaggagctgctggaggagatgtacgaggagaagctgaacatcctgaaggagagcctgaccagcttctaccaggaggagatccaggagagagacgagaagatcgaggagctggaggccctgctgcaggaggccagacagcagagcgtggcccaccagcagagcggcagcgagctggccctgagaagaagccagagactggccgccagcgccagcacccagcagctgcaggaggtgaaggccaagctgcagcagtgcaaggccgagctgaacagcaccaccgaggagctgcacaagtaccagaagatgctggagcccccccccagcgccaagcccttcaccatcgacgtggacaagaagctggaggagggccagaagaacatcagactgctgagaaccgagctgcagaagctgggcgagagcctgcagagcgccgagagagcctgctgccacagcaccggcgccggcaagctgagacaggccctgaccacctgcgacgacatcctgatcaagcaggaccagaccctggccgagctgcagaacaacatggtgctggtgaagctggacctgagaaagaaggccgcctgcatcgccgagcagtaccacaccgtgctgaagctgcagggccaggtgagcgccaagaagagactgggcaccaaccaggagaaccagcagcccaaccagcagccccccggcaagaagcccttcctgagaaacctgctgcccagaacccccacctgccagagcagcaccgactgcagcccctacgccagaatcctgagaagcagaagaagccccctgctgaagagcggccccttcggcaagaagtactag

SEQ ID NO: 86236 - DNA, 480 bp, Artificial Sequence
  Description of Artificial Sequence: Synthetic coding sequence
atgagccagggcatcctgagcccccccgccggcctgctgagcgacgacgacgtggtggtgagccccatgttcgagagcaccgccgccgacctgggcagcgtggtgagaaagaacctgctgagcgactgcagcgtggtgagcaccagcctggaggacaagcagcaggtgcccagcgaggacagcatggagaaggtgaaggtgtacctgagagtgagacccctgctgcccagcgagctggagagacaggaggaccagggctgcgtgagaatcgagaacgtggagaccctggtgctgcaggcccccaaggacagcttcgccctgaagagcaacgagagaggcatcggccaggccacccacagattcaccttcagccagatcttcggccccgaggtgggccaggccagcttcttcaacctgaccgtgaaggagatggtgaaggacgtgctgaagggccagaactggctgatctacacctactag

SEQ ID NO: 86237 - DNA, 4884 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagactgcagaagctggaggagagcaacagagaggagagaagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagaccaccagctgagactgctggaggcccagaagagaaaccaggaggtggtgctgagaagaaagaccgaggaggtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggacttcaagcacttcttcgtggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcagagcgacgagagcgacagcagcctgagcgaggtgcacagaggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86238 - DNA, 5025 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagactgcagaagctggaggagagcaacagagaggagagaagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagaccaccagctgagactgctggaggcccagaagagaaaccaggaggtggtgctgagaagaaagaccgaggaggtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggacctggacagcgtgcccctggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcacagcgacagcggcaccagcgaggccagcctgagcccccccagcagcccccccagcagacccagaaacgagctgaacgtgttcaacagactgaccgtgagccagggcaacaccagcgtgcagcaggacaagagcgacgagagcgacagcagcctgagcgaggtgcacagaagcagcagaagaggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86239 - DNA, 4986 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagaccaccagctgagactgctggaggcccagaagagaaaccaggaggtggtgctgagaagaaagaccgaggaggtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggacctggacagcgtgcccctggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcacagcgacagcggcaccagcgaggccagcctgagcccccccagcagcccccccagcagacccagaaacgagctgaacgtgttcaacagactgaccgtgagccagggcaacaccagcgtgcagcaggacaagagcgacgagagcgacagcagcctgagcgaggtgcacagaagcagcagaagaggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86240 - DNA, 5028 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagactgcagaagctggaggagagcaacagagaggagagaagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagaccaccagctgagactgctggaggcccagaagagaaaccaggaggtggtgctgagaagaaagaccgaggaggtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggacttcaagcacttcttcgtggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcacagcgacagcggcaccagcgaggccagcctgagcccccccagcagcccccccagcagacccagaaacgagctgaacgtgttcaacagactgaccgtgagccagggcaacaccagcgtgcagcaggacaagagcgacgagagcgacagcagcctgagcgaggtgcacagaaacagcaacctgagaggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86241 - DNA, 4866 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagacgtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggacctggacagcgtgcccctggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcacagcgacagcggcaccagcgaggccagcctgagcccccccagcagcccccccagcagacccagaaacgagctgaacgtgttcaacagactgaccgtgagccagggcaacaccagcgtgcagcaggacaagggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86242 - DNA, 4914 bp, Artificial Sequence
  Description of Artificial Sequence: Synthetic coding sequence
atgctgggcgcccccgacgagagcagcgtgagagtggccgtgagaatcagaccccagctggccaaggagaagatcgagggctgccacatctgcaccagcgtgacccccggcgagccccaggtgttcctgggcaaggacaaggccttcaccttcgactacgtgttcgacatcgacagccagcaggagcagatctacatccagtgcatcgagaagctgatcgagggctgcttcgagggctacaacgccaccgtgttcgcctacggccagaccggcgccggcaagacctacaccatgggcaccggcttcgacgtgaacatcgtggaggaggagctgggcatcatcagcagagccgtgaagcacctgttcaagagcatcgaggagaagaagcacatcgccatcaagaacggcctgcccgcccccgacttcaaggtgaacgcccagttcctggagctgtacaacgaggaggtgctggacctgttcgacaccaccagagacatcgacgccaagagcaagaagagcaacatcagaatccacgaggacagcaccggcggcatctacaccgtgggcgtgaccaccagaaccgtgaacaccgagagcgagatgatgcagtgcctgaagctgggcgccctgagcagaaccaccgccagcacccagatgaacgtgcagagcagcagaagccacgccatcttcaccatccacgtgtgccagaccagagtgtgcccccagatcgacgccgacaacgccaccgacaacaagatcatcagcgagagcgcccagatgaacgagttcgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgacaagagcaagagagccacccacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtgatggtgaaccaggacagagccagccagcagatcaacgccctgagaagcgagatcaccagactgcagatggagctgatggagtacaagaccggcaagagaatcatcgacgaggagggcgtggagagcatcaacgacatgttccacgagaacgccatgctgcagaccgagaacaacaacctgagagtgagaatcaaggccatgcaggagaccgtggacgccctgagaagcagaatcacccagctggtgagcgaccaggccaaccacgtgctggccagagccggcgagggcaacgaggagatcagcaacatgatccacagctacatcaaggagatcgaggacctgagagccaagctgctggagagcgaggccgtgaacgagaacctgagaaagaacctgaccagagccaccgccagagccccctacttcagcggcagcagcaccttcagccccaccatcctgagcagcgacaaggagaccatcgagatcatcgacctggccaagaaggacctggagaagctgaagagaaaggagaagagaaagaagaagagcgtggccggcaaggaggacaacaccgacaccgaccaggagaagaaggaggagaagggcgtgagcgagagagagaacaacgagctggaggtggaggagagccaggaggtgagcgaccacgaggacgaggaggaggaggaggaggaggaggaggacgacatcgacggcggcgagagcagcgacgagagcgacagcgagagcgacgagaaggccaactaccaggccgacctggccaacatcacctgcgagatcgccatcaagcagaagctgatcgacgagctggagaacagccagaagagactgcagaccctgaagaagcagtacgaggagaagctgatgatgctgcagcacaagatcagagacacccagctggagagagaccaggtgctgcagaacctgggcagcgtggagagctacagcgaggagaaggccaagaaggtgagaagcgagtacgagaagaagctgcaggccatgaacaaggagctgcagagactgcaggccgcccagaaggagcacgccagactgctgaagaaccagagccagtacgagaagcagctgaagaagctgcagcaggacgtgatggagatgaagaagaccaaggtgagactgatgaagcagatgaaggaggagcaggagaaggccagactgaccgagagcagaagaaacagagagatcgcccagctgaagaaggaccagagaaagagagaccaccagctgagactgctggaggcccagaagagaaaccaggaggtggtgctgagaagaaagaccgaggaggtgaccgccctgagaagacaggtgagacccatgagcgacaaggtggccggcaaggtgaccagaaagctgagcagcagcgacgcccccgcccaggacaccggcagcagcgccgccgccgtggagaccgacgccagcagaaccggcgcccagcagaagatgagaatccccgtggccagagtgcaggccctgcccacccccgccaccaacggcaacagaaagaagtaccagagaaagggcctgaccggcagagtgttcatcagcaagaccgccagaatgaagtggcagctgctggagagaagagtgaccgacatcatcatgcagaagatgaccatcagcaacatggaggccgacatgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcacagcgacagcggcaccagcgaggccagcctgagcccccccagcagcccccccagcagacccagaaacgagctgaacgtgttcaacagactgaccgtgagccagggcaacaccagcgtgcagcaggacaagggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86243 - DNA, 1986 bp, Artificial Sequence
  Description of Artificial Sequence: Synthetic coding sequence
atgaacagactgctgaagcagagagaggagctgaccaagagaagagagaagctgagcaagagaagagagaagatcgtgaaggagaacggcgagggcgacaagaacgtggccaacatcaacgaggagatggagagcctgaccgccaacatcgactacatcaacgacagcatcagcgactgccaggccaacatcatgcagatggaggaggccaaggaggagggcgagaccctggacgtgaccgccgtgatcaacgcctgcaccctgaccgaggccagatacctgctggaccacttcctgagcatgggcatcaacaagggcctgcaggccgcccagaaggaggcccagatcaaggtgctggagggcagactgaagcagaccgagatcaccagcgccacccagaaccagctgctgttccacatgctgaaggagaaggccgagctgaaccccgagctggacgccctgctgggccacgccctgcaggagaacgtggaggacagcaccgacgaggacgcccccctgaacagccccggcagcgagggcagcaccctgagcagcgacctgatgaagctgtgcggcgaggtgaagcccaagaacaaggccagaagaagaaccaccacccagatggagctgctgtacgccgacagcagcgagctggccagcgacaccagcaccggcgacgccagcctgcccggccccctgacccccgtggccgagggccaggagatcggcatgaacaccgagaccagcggcaccagcgccagagagaaggagctgagccccccccccggcctgcccagcaagatcggcagcatcagcagacagagcagcctgagcgagaagaagatccccgagcccagccccgtgaccagaagaaaggcctacgagaaggccgagaagagcaaggccaaggagcagaagcagggcatcatcaaccccttccccgccagcaagggcatcagagccttccccctgcagtgcatccacatcgccgagggccacaccaaggccgtgctgtgcgtggacagcaccgacgacctgctgttcaccggcagcaaggacagaacctgcaaggtgtggaacctggtgaccggccaggagatcatgagcctgggcggccaccccaacaacgtggtgagcgtgaagtactgcaactacaccagcctggtgttcaccgtgagcaccagctacatcaaggtgtgggacatcagagacagcgccaagtgcatcagaaccctgaccagcagcggccaggtgaccctgggcgacgcctgcagcgccagcaccagcagaaccgtggccatccccagcggcgagaaccagatcaaccagatcgccctgaaccccaccggcaccttcctgtacgccgccagcggcaacgccgtgagaatgtgggacctgaagagattccagagcaccggcaagctgaccggccacctgggccccgtgatgtgcctgaccgtggaccagatcagcagcggccaggacctgatcatcaccggcagcaaggaccactacatcaagatgttcgacgtgaccgagggcgccctgggcaccgtgagccccacccacaacttcgagcccccccactacgacggcatcgaggccctgaccatccagggcgacaacctgttcagcggcagcagagacaacggcatcaagaagtgggacctgacccagaaggacctgctgcagcaggtgcccaacgcccacaaggactgggtgtgcgccctgggcgtggtgcccgaccaccccgtgctgctgagcggctgcagaggcggcatcctgaaggtgtggaacatggacaccttcatgcccgtgggcgagatgaagggccacgacagccccatcaacgccatctgcgtgaacagcacccacatcttcaccgccgccgacgacagaaccgtgagaatctggaaggccagaaacctgcaggacggccagatcagcgacaccggcgacctgggcgaggacatcgccagcaactag

SEQ ID NO: 86244 - DNA, 4875 bp, Artificial Sequence
  Description of Artificial Sequence: Synthetic coding sequence
atggccggccagggcgactgctgcgtgaaggtggccgtgagaatcagaccccagctgagcaaggagaagatcgagggctgccacatctgcaccagcgtgacccccggcgagccccaggtgctgctgggcaaggacaaggccttcacctacgacttcgtgttcgacctggacacctggcaggagcagatctacagcacctgcgtgagcaagctgatcgagggctgcttcgagggctacaacgccaccgtgctggcctacggccagaccggcgccggcaagacctacaccatgggcaccggcttcgacatggccaccagcgaggaggagcagggcatcatccccagagccatcgcccacctgttcggcggcatcgccgagagaaagagaagagcccaggagcagggcgtggccggccccgagttcaaggtgagcgcccagttcctggagctgtacaacgaggagatcctggacctgttcgacagcaccagagaccccgacaccagacacagaagaagcaacatcaagatccacgaggacgccaacggcggcatctacaccaccggcgtgaccagcagactgatccacagccaggaggagctgatccagtgcctgaagcagggcgccctgagcagaaccaccgccagcacccagatgaacgtgcagagcagcagaagccacgccatcttcaccatccacctgtgccagatgagaatgtgcacccagcccgacctggtgaacgaggccgtgaccggcctgcccgacggcaccccccccagcagcgagtacgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgaccagagcaagaaggtggtgcacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtggtggtgaaccaggacaagaccagccagcagatcagcgccctgagagccgagatcgccagactgcagatggagctgatggagtacaaggccggcaagagagtgatcggcgaggacggcgccgagggctacagcgacctgttcagagagaacgccatgctgcagaaggagaacggcgccctgagactgagagtgaaggccatgcaggaggccatcgacgccatcaacaacagagtgacccagctgatgagccaggaggccaacctgctgctggccaaggccggcgacggcaacgaggccatcggcgccctgatccagaactacatcagagagatcgaggagctgagaaccaagctgctggagagcgaggccatgaacgagagcctgagaagaagcctgagcagagccagcgccagaagcccctacagcctgggcgccagccccgccgcccccgccttcggcggcagccccgccagcagcatggaggacgccagcgaggtgatcagaagagccaagcaggacctggagagactgaagaagaaggaggtgagacagagaagaaagagccccgagaaggaggccttcaagaagagagccaagctgcagcaggagaacagcgaggagaccgacgagaacgaggccgaggaggaggaggaggagagagacgagagcggctgcgaggaggaggagggcagagaggacgaggacgaggacagcggcagcgaggagagcctggtggacagcgacagcgaccccgaggagaaggaggtgaacttccaggccgacctggccgacctgacctgcgagatcgagatcaagcagaagctgatcgacgagctggagaacagccagagaagactgcagaccctgaagcaccagtacgaggagaagctgatcctgctgcagaacaagatcagagacacccagctggagagagacagagtgctgcagaacctgagcaccatggagtgctacaccgaggagaaggccaacaagatcaaggccgactacgagaagagactgagagagatgaacagagacctgcagaagctgcaggccgcccagaaggagcacgccagactgctgaagaaccagagcagatacgagagagagctgaagaagctgcaggccgaggtggccgagatgaagaaggccaaggtggccctgatgaagcagatgagagaggagcagcagagaagaagactggtggagaccaagagaaacagagagatcgcccagctgaagaaggagcagagaagacaggagttccagatcagagccctggagagccagaagagacagcaggagatggtgctgagaagaaagacccaggaggtgagcgccctgagaagactggccaagcccatgagcgagagagtggccggcagagccggcctgaagccccccatgctggacagcggcgccgaggtgagcgccagcaccaccagcagcgaggccgagagcggcgccagaagcgtgagcagcatcgtgagacagtggaacagaaagatcaaccacttcctgggcgaccaccccgcccccaccgtgaacggcaccagacccgccagaaagaagttccagaagaagggcgccagccagagcttcagcaaggccgccagactgaagtggcagagcctggagagaagaatcatcgacatcgtgatgcagagaatgaccatcgtgaacctggaggccgacatggagagactgatcaagaagagagaggagctgttcctgctgcaggaggccctgagaagaaagagagagagactgcaggccgagagccccgaggaggagaagggcctgcaggagctggccgaggagatcgaggtgctggccgccaacatcgactacatcaacgacggcatcaccgactgccaggccaccatcgtgcagctggaggagaccaaggaggagctggacagcaccgacaccagcgtggtgatcagcagctgcagcctggccgaggccagactgctgctggacaacttcctgaaggccagcatcgacaagggcctgcaggtggcccagaaggaggcccagatcagactgctggagggcagactgagacagaccgacatggccggcagcagccagaaccacctgctgctggacgccctgagagagaaggccgaggcccaccccgagctgcaggccctgatctacaacgtgcagcaggagaacggctacgccagcaccgacgaggagatcagcgagttcagcgagggcagcttcagccagagcttcaccatgaagggcagcaccagccacgacgacttcaagttcaagagcgagcccaagctgagcgcccagatgaaggccgtgagcgccgagtgcctgggcccccccctggacatcagcaccaagaacatcaccaagagcctggccagcctggtggagatcaaggaggacggcgtgggcttcagcgtgagagacccctactacagagacagagtgagcagaaccgtgagcctgcccaccagaggcagcaccttccccagacagagcagagccaccgagaccagccccctgaccagaagaaagagctacgacagaggccagcccatcagaagcaccgacgtgggcttcaccccccccagcagcccccccaccagacccagaaacgacagaaacgtgttcagcagactgaccagcaaccagagccagggcagcgccctggacaagggcatcatcagccccgtgggcggcgccaagggcgccagaaccgcccccctgcagtgcgtgagcatggccgagggccacaccaagcccatcctgtgcctggacgccaccgacgagctgctgttcaccggcagcaaggacagaagctgcaagatgtggaacctggtgaccggccaggagatcgccgccctgaagggccaccccaacaacgtggtgagcatcaagtactgcagccacagcggcctggtgttcagcgtgagcaccagctacatcaaggtgtgggacatcagagacagcgccaagtgcatcagaaccctgaccagcagcggccaggtgatcagcggcgacgcctgcgccgccaccagcaccagagccatcaccagcgcccagggcgagcaccagatcaaccagatcgccctgagccccagcggcaccatgctgtacgccgccagcggcaacgccgtgagaatctgggagctgagcagattccagcccgtgggcaagctgaccggccacatcggccccgtgatgtgcctgaccgtgacccagaccgccagccagcacgacctggtggtgaccggcagcaaggaccactacgtgaagatgttcgagctgggcgagtgcgtgaccggcaccatcggccccacccacaacttcgagcccccccactacgacggcatcgagtgcctggccatccagggcgacatcctgttcagcggcagcagagacaacggcatcaagaagtgggacctggaccagcaggagctgatccagcagatccccaacgcccacaaggactgggtgtgcgccctggccttcatccccggcagacccatgctgctgagcgcctgcagagccggcgtgatcaaggtgtggaacgtggacaacttcacccccatcggcgagatcaagggccacgacagccccatcaacgccatctgcaccaacgccaagcacatcttcaccgccagcagcgactgcagagtgaagctgtggaactacgtgcccggcctgaccccctgcctgcccagaagagtgctggccatcaagggcagagccaccaccctgccctag

SEQ ID NO: 86245 - DNA, 4833 bp, Artificial Sequence
  Description of Artificial Sequence: Synthetic coding sequence
atggccggccagggcgactgctgcgtgaaggtggccgtgagaatcagaccccagctgagcaaggagaagatcgagggctgccacatctgcaccagcgtgacccccggcgagccccaggtgctgctgggcaaggacaaggccttcacctacgacttcgtgttcgacctggacacctggcaggagcagatctacagcacctgcgtgagcaagctgatcgagggctgcttcgagggctacaacgccaccgtgctggcctacggccagaccggcgccggcaagacctacaccatgggcaccggcttcgacatggccaccagcgaggaggagcagggcatcatccccagagccatcgcccacctgttcggcggcatcgccgagagaaagagaagagcccaggagcagggcgtggccggccccgagttcaaggtgagcgcccagttcctggagctgtacaacgaggagatcctggacctgttcgacagcaccagagaccccgacaccagacacagaagaagcaacatcaagatccacgaggacgccaacggcggcatctacaccaccggcgtgaccagcagactgatccacagccaggaggagctgatccagtgcctgaagcagggcgccctgagcagaaccaccgccagcacccagatgaacgtgcagagcagcagaagccacgccatcttcaccatccacctgtgccagatgagaatgtgcacccagcccgacctggtgaacgaggccgtgaccggcctgcccgacggcaccccccccagcagcgagtacgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgaccagagcaagaaggtggtgcacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtggtggtgaaccaggacaagaccagccagcagatcagcgccctgagagccgagatcgccagactgcagatggagctgatggagtacaaggccggcaagagagtgatcggcgaggacggcgccgagggctacagcgacctgttcagagagaacgccatgctgcagaaggagaacggcgccctgagactgagagtgaaggccatgcaggaggccatcgacgccatcaacaacagagtgacccagctgatgagccaggaggccaacctgctgctggccaaggccggcgacggcaacgaggccatcggcgccctgatccagaactacatcagagagatcgaggagctgagaaccaagctgctggagagcgaggccatgaacgagagcctgagaagaagcctgagcagagccagcgccagaagcccctacagcctgggcgccagccccgccgcccccgccttcggcggcagccccgccagcagcatggaggacgccagcgaggtgatcagaagagccaagcaggacctggagagactgaagaagaaggaggtgagacagagaagaaagagccccgagaaggaggccttcaagaagagagccaagctgcagcaggagaacagcgaggagaccgacgagaacgaggccgaggaggaggaggaggagagagacgagagcggctgcgaggaggaggagggcagagaggacgaggacgaggacagcggcagcgaggagagcctggtggacagcgacagcgaccccgaggagaaggaggtgaacttccaggccgacctggccgacctgacctgcgagatcgagatcaagcagaagctgatcgacgagctggagaacagccagagaagactgcagaccctgaagcaccagtacgaggagaagctgatcctgctgcagaacaagatcagagacacccagctggagagagacagagtgctgcagaacctgagcaccatggagtgctacaccgaggagaaggccaacaagatcaaggccgactacgagaagagactgagagagatgaacagagacctgcagaagctgcaggccgcccagaaggagcacgccagactgctgaagaaccagagcagatacgagagagagctgaagaagctgcaggccgaggtggccgagatgaagaaggccaaggtggccctgatgaagcagatgagagaggagcagcagagaagaagactggtggagaccaagagaaacagagagatcgcccagctgaagaaggagcagagaagacaggagttccagatcagagccctggagagccagaagagacagcaggagatggtgctgagaagaaagacccaggaggtgagcgccctgagaagactggccaagcccatgagcgagagagtggccggcagagccggcctgaagccccccatgctggacagcggcgccgaggtgagcgccagcaccaccagcagcgaggccgagagcggcgccagaagcgtgagcagcatcgtgagacagtggaacagaaagatcaaccacttcctgggcgaccaccccgcccccaccgtgaacggcaccagacccgccagaaagaagttccagaagaagggcgccagccagagcttcagcaaggccgccagactgaagtggcagagcctggagagaagaatcatcgacatcgtgatgcagagaatgaccatcgtgaacctggaggccgacatggagagactgatcaagaagagagaggagctgttcctgctgcaggaggccctgagaagaaagagagagagactgcaggccgagagccccgaggaggagaagggcctgcaggagctggccgaggagatcgaggtgctggccgccaacatcgactacatcaacgacggcatcaccgactgccaggccaccatcgtgcagctggaggagaccaaggaggagctggacagcaccgacaccagcgtggtgatcagcagctgcagcctggccgaggccagactgctgctggacaacttcctgaaggccagcatcgacaagggcctgcaggtggcccagaaggaggcccagatcagactgctggagggcagactgagacagaccgacatggccggcagcagccagaaccacctgctgctggacgccctgagagagaaggccgaggcccaccccgagctgcaggccctgatctacaacgtgcagcaggagaacggctacgccagcaccgacgaggagatcagcgagttcagcgagggcagcttcagccagagcttcaccatgaagggcagcaccagccacgacgacttcaagttcaagagcgagcccaagctgagcgcccagatgaaggccgtgagcgccgagtgcctgggcccccccctggacatcagcaccaagaacatcaccaagagcctggccagcctggtggagatcaaggaggacggcgtgggcttcagcgtgagagacccctactacagagacagagtgagcagaaccgtgagcctgcccaccagaggcagcaccttccccagacagagcagagccaccgagaccagccccctgaccagaagaaagagctacgacagaggccagcccatcagaagcaccgacgtgggcttcaccccccccagcagcccccccaccagacccagaaacgacagaaacgtgttcagcagactgaccagcaaccagagccagggcagcgccctggacaagggcatcatcagccccgtgggcggcgccaagggcgccagaaccgcccccctgcagtgcgtgagcatggccgagggccacaccaagcccatcctgtgcctggacgccaccgacgagctgctgttcaccggcagcaaggacagaagctgcaagatgtggaacctggtgaccggccaggagatcgccgccctgaagggccaccccaacaacgtggtgagcatcaagtactgcagccacagcggcctggtgttcagcgtgagcaccagctacatcaaggtgtgggacatcagagacagcgccaagtgcatcagaaccctgaccagcagcggccaggtgatcagcggcgacgcctgcgccgccaccagcaccagagccatcaccagcgcccagggcgagcaccagatcaaccagatcgccctgagccccagcggcaccatgctgtacgccgccagcggcaacgccgtgagaatctgggagctgagcagattccagcccgtgggcaagctgaccggccacatcggccccgtgatgtgcctgaccgtgacccagaccgccagccagcacgacctggtggtgaccggcagcaaggaccactacgtgaagatgttcgagctgggcgagtgcgtgaccggcaccatcggccccacccacaacttcgagcccccccactacgacggcatcgagtgcctggccatccagggcgacatcctgttcagcggcagcagagacaacggcatcaagaagtgggacctggaccagcaggagctgatccagcagatccccaacgcccacaaggactgggtgtgcgccctggccttcatccccggcagacccatgctgctgagcgcctgcagagccggcgtgatcaaggtgtggaacgtggacaacttcacccccatcggcgagatcaagggccacgacagccccatcaacgccatctgcaccaacgccaagcacatcttcaccgccagcagcgacctgaccgtgaagttctggagcgtgagaagactgccccacagcggccccccctag

SEQ ID NO: 86246 - DNA, 4914 bp, Artificial Sequence
  Description of Artificial Sequence: Synthetic coding sequence
atggccggccagggcgactgctgcgtgaaggtggccgtgagaatcagaccccagctgagcaaggagaagatcgagggctgccacatctgcaccagcgtgacccccggcgagccccaggtgctgctgggcaaggacaaggccttcacctacgacttcgtgttcgacctggacacctggcaggagcagatctacagcacctgcgtgagcaagctgatcgagggctgcttcgagggctacaacgccaccgtgctggcctacggccagaccggcgccggcaagacctacaccatgggcaccggcttcgacatggccaccagcgaggaggagcagggcatcatccccagagccatcgcccacctgttcggcggcatcgccgagagaaagagaagagcccaggagcagggcgtggccggccccgagttcaaggtgagcgcccagttcctggagctgtacaacgaggagatcctggacctgttcgacagcaccagagaccccgacaccagacacagaagaagcaacatcaagatccacgaggacgccaacggcggcatctacaccaccggcgtgaccagcagactgatccacagccaggaggagctgatccagtgcctgaagcagggcgccctgagcagaaccaccgccagcacccagatgaacgtgcagagcagcagaagccacgccatcttcaccatccacctgtgccagatgagaatgtgcacccagcccgacctggtgaacgaggccgtgaccggcctgcccgacggcaccccccccagcagcgagtacgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgaccagagcaagaaggtggtgcacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtggtggtgaaccaggacaagaccagccagcagatcagcgccctgagagccgagatcgccagactgcagatggagctgatggagtacaaggccggcaagagagtgatcggcgaggacggcgccgagggctacagcgacctgttcagagagaacgccatgctgcagaaggagaacggcgccctgagactgagagtgaaggccatgcaggaggccatcgacgccatcaacaacagagtgacccagctgatgagccaggaggccaacctgctgctggccaaggccggcgacggcaacgaggccatcggcgccctgatccagaactacatcagagagatcgaggagctgagaaccaagctgctggagagcgaggccatgaacgagagcctgagaagaagcctgagcagagccagcgccagaagcccctacagcctgggcgccagccccgccgcccccgccttcggcggcagccccgccagcagcatggaggacgccagcgaggtgatcagaagagccaagcaggacctggagagactgaagaagaaggaggtgagacagagaagaaagagccccgagaaggaggccttcaagaagagagccaagctgcagcaggagaacagcgaggagaccgacgagaacgaggccgaggaggaggaggaggagagagacgagagcggctgcgaggaggaggagggcagagaggacgaggacgaggacagcggcagcgaggagagcctggtggacagcgacagcgaccccgaggagaaggaggtgaacttccaggccgacctggccgacctgacctgcgagatcgagatcaagcagaagctgatcgacgagctggagaacagccagagaagactgcagaccctgaagcaccagtacgaggagaagctgatcctgctgcagaacaagatcagagacacccagctggagagagacagagtgctgcagaacctgagcaccatggagtgctacaccgaggagaaggccaacaagatcaaggccgactacgagaagagactgagagagatgaacagagacctgcagaagctgcaggccgcccagaaggagcacgccagactgctgaagaaccagagcagatacgagagagagctgaagaagctgcaggccgaggtggccgagatgaagaaggccaaggtggccctgatgaagcagatgagagaggagcagcagagaagaagactggtggagaccaagagaaacagagagatcgcccagctgaagaaggagcagagaagacaggagttccagatcagagccctggagagccagaagagacagcaggagatggtgctgagaagaaagacccaggaggtgagcgccctgagaagactggccaagcccatgagcgagagagtggccggcagagccggcctgaagccccccatgctggacagcggcgccgaggtgagcgccagcaccaccagcagcgaggccgagagcggcgccagaagcgtgagcagcatcgtgagacagtggaacagaaagatcaaccacttcctgggcgaccaccccgcccccaccgtgaacggcaccagacccgccagaaagaagttccagaagaagggcgccagccagagcttcagcaaggccgccagactgaagtggcagagcctggagagaagaatcatcgacatcgtgatgcagagaatgaccatcgtgaacctggaggccgacatggagagactgatcaagaagagagaggagctgttcctgctgcaggaggccctgagaagaaagagagagagactgcaggccgagagccccgaggaggagaagggcctgcaggagctggccgaggagatcgaggtgctggccgccaacatcgactacatcaacgacggcatcaccgactgccaggccaccatcgtgcagctggaggagaccaaggaggagctggacagcaccgacaccagcgtggtgatcagcagctgcagcctggccgaggccagactgctgctggacaacttcctgaaggccagcatcgacaagggcctgcaggtggcccagaaggaggcccagatcagactgctggagggcagactgagacagaccgacatggccggcagcagccagaaccacctgctgctggacgccctgagagagaaggccgaggcccaccccgagctgcaggccctgatctacaacgtgcagcaggagaacggctacgccagcaccgacgaggagatcagcgagttcagcgagggcagcttcagccagagcttcaccatgaagggcagcaccagccacgacgacttcaagttcaagagcgagcccaagctgagcgcccagatgaaggccgtgagcgccgagtgcctgggcccccccctggacatcagcaccaagaacatcaccaagagcctggccagcctggtggagatcaaggaggacggcgtgggcttcagcgtgagagacccctactacagagacagagtgagcagaaccgtgagcctgcccaccagaggcagcaccttccccagacagagcagagccaccgagaccagccccctgaccagaagaaagagctacgacagaggccagcccatcagaagcaccgacgtgggcttcaccccccccagcagcccccccaccagacccagaaacgacagaaacgtgttcagcagactgaccagcaaccagagccagggcagcgccctggacaagagcgacgacagcgacagcagcctgagcgaggtgctgagaggcatcatcagccccgtgggcggcgccaagggcgccagaaccgcccccctgcagtgcgtgagcatggccgagggccacaccaagcccatcctgtgcctggacgccaccgacgagctgctgttcaccggcagcaaggacagaagctgcaagatgtggaacctggtgaccggccaggagatcgccgccctgaagggccaccccaacaacgtggtgagcatcaagtactgcagccacagcggcctggtgttcagcgtgagcaccagctacatcaaggtgtgggacatcagagacagcgccaagtgcatcagaaccctgaccagcagcggccaggtgatcagcggcgacgcctgcgccgccaccagcaccagagccatcaccagcgcccagggcgagcaccagatcaaccagatcgccctgagccccagcggcaccatgctgtacgccgccagcggcaacgccgtgagaatctgggagctgagcagattccagcccgtgggcaagctgaccggccacatcggccccgtgatgtgcctgaccgtgacccagaccgccagccagcacgacctggtggtgaccggcagcaaggaccactacgtgaagatgttcgagctgggcgagtgcgtgaccggcaccatcggccccacccacaacttcgagcccccccactacgacggcatcgagtgcctggccatccagggcgacatcctgttcagcggcagcagagacaacggcatcaagaagtgggacctggaccagcaggagctgatccagcagatccccaacgcccacaaggactgggtgtgcgccctggccttcatccccggcagacccatgctgctgagcgcctgcagagccggcgtgatcaaggtgtggaacgtggacaacttcacccccatcggcgagatcaagggccacgacagccccatcaacgccatctgcaccaacgccaagcacatcttcaccgccagcagcgactgcagagtgaagctgtggaactacgtgcccggcctgaccccctgcctgcccagaagagtgctggccatcaagggcagagccaccaccctgccctag

SEQ ID NO: 86247 - DNA, 4872 bp, Artificial Sequence
  Description of Artificial Sequence: Synthetic coding sequence
atggccggccagggcgactgctgcgtgaaggtggccgtgagaatcagaccccagctgagcaaggagaagatcgagggctgccacatctgcaccagcgtgacccccggcgagccccaggtgctgctgggcaaggacaaggccttcacctacgacttcgtgttcgacctggacacctggcaggagcagatctacagcacctgcgtgagcaagctgatcgagggctgcttcgagggctacaacgccaccgtgctggcctacggccagaccggcgccggcaagacctacaccatgggcaccggcttcgacatggccaccagcgaggaggagcagggcatcatccccagagccatcgcccacctgttcggcggcatcgccgagagaaagagaagagcccaggagcagggcgtggccggccccgagttcaaggtgagcgcccagttcctggagctgtacaacgaggagatcctggacctgttcgacagcaccagagaccccgacaccagacacagaagaagcaacatcaagatccacgaggacgccaacggcggcatctacaccaccggcgtgaccagcagactgatccacagccaggaggagctgatccagtgcctgaagcagggcgccctgagcagaaccaccgccagcacccagatgaacgtgcagagcagcagaagccacgccatcttcaccatccacctgtgccagatgagaatgtgcacccagcccgacctggtgaacgaggccgtgaccggcctgcccgacggcaccccccccagcagcgagtacgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgaccagagcaagaaggtggtgcacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtggtggtgaaccaggacaagaccagccagcagatcagcgccctgagagccgagatcgccagactgcagatggagctgatggagtacaaggccggcaagagagtgatcggcgaggacggcgccgagggctacagcgacctgttcagagagaacgccatgctgcagaaggagaacggcgccctgagactgagagtgaaggccatgcaggaggccatcgacgccatcaacaacagagtgacccagctgatgagccaggaggccaacctgctgctggccaaggccggcgacggcaacgaggccatcggcgccctgatccagaactacatcagagagatcgaggagctgagaaccaagctgctggagagcgaggccatgaacgagagcctgagaagaagcctgagcagagccagcgccagaagcccctacagcctgggcgccagccccgccgcccccgccttcggcggcagccccgccagcagcatggaggacgccagcgaggtgatcagaagagccaagcaggacctggagagactgaagaagaaggaggtgagacagagaagaaagagccccgagaaggaggccttcaagaagagagccaagctgcagcaggagaacagcgaggagaccgacgagaacgaggccgaggaggaggaggaggagagagacgagagcggctgcgaggaggaggagggcagagaggacgaggacgaggacagcggcagcgaggagagcctggtggacagcgacagcgaccccgaggagaaggaggtgaacttccaggccgacctggccgacctgacctgcgagatcgagatcaagcagaagctgatcgacgagctggagaacagccagagaagactgcagaccctgaagcaccagtacgaggagaagctgatcctgctgcagaacaagatcagagacacccagctggagagagacagagtgctgcagaacctgagcaccatggagtgctacaccgaggagaaggccaacaagatcaaggccgactacgagaagagactgagagagatgaacagagacctgcagaagctgcaggccgcccagaaggagcacgccagactgctgaagaaccagagcagatacgagagagagctgaagaagctgcaggccgaggtggccgagatgaagaaggccaaggtggccctgatgaagcagatgagagaggagcagcagagaagaagactggtggagaccaagagaaacagagagatcgcccagctgaagaaggagcagagaagacaggagttccagatcagagccctggagagccagaagagacagcaggagatggtgctgagaagaaagacccaggaggtgagcgccctgagaagactggccaagcccatgagcgagagagtggccggcagagccggcctgaagccccccatgctggacagcggcgccgaggtgagcgccagcaccaccagcagcgaggccgagagcggcgccagaagcgtgagcagcatcgtgagacagtggaacagaaagatcaaccacttcctgggcgaccaccccgcccccaccgtgaacggcaccagacccgccagaaagaagttccagaagaagggcgccagccagagcttcagcaaggccgccagactgaagtggcagagcctggagagaagaatcatcgacatcgtgatgcagagaatgaccatcgtgaacctggaggccgacatggagagactgatcaagaagagagaggagctgttcctgctgcaggaggccctgagaagaaagagagagagactgcaggccgagagccccgaggaggagaagggcctgcaggagctggccgaggagatcgaggtgctggccgccaacatcgactacatcaacgacggcatcaccgactgccaggccaccatcgtgcagctggaggagaccaaggaggagctggacagcaccgacaccagcgtggtgatcagcagctgcagcctggccgaggccagactgctgctggacaacttcctgaaggccagcatcgacaagggcctgcaggtggcccagaaggaggcccagatcagactgctggagggcagactgagacagaccgacatggccggcagcagccagaaccacctgctgctggacgccctgagagagaaggccgaggcccaccccgagctgcaggccctgatctacaacgtgcagcaggagaacggctacgccagcaccgacgaggagatcagcgagttcagcgagggcagcttcagccagagcttcaccatgaagggcagcaccagccacgacgacttcaagttcaagagcgagcccaagctgagcgcccagatgaaggccgtgagcgccgagtgcctgggcccccccctggacatcagcaccaagaacatcaccaagagcctggccagcctggtggagatcaaggaggacggcgtgggcttcagcgtgagagacccctactacagagacagagtgagcagaaccgtgagcctgcccaccagaggcagcaccttccccagacagagcagagccaccgagaccagccccctgaccagaagaaagagctacgacagaggccagcccatcagaagcaccgacgtgggcttcaccccccccagcagcccccccaccagacccagaaacgacagaaacgtgttcagcagactgaccagcaaccagagccagggcagcgccctggacaagagcgacgacagcgacagcagcctgagcgaggtgctgagaggcatcatcagccccgtgggcggcgccaagggcgccagaaccgcccccctgcagtgcgtgagcatggccgagggccacaccaagcccatcctgtgcctggacgccaccgacgagctgctgttcaccggcagcaaggacagaagctgcaagatgtggaacctggtgaccggccaggagatcgccgccctgaagggccaccccaacaacgtggtgagcatcaagtactgcagccacagcggcctggtgttcagcgtgagcaccagctacatcaaggtgtgggacatcagagacagcgccaagtgcatcagaaccctgaccagcagcggccaggtgatcagcggcgacgcctgcgccgccaccagcaccagagccatcaccagcgcccagggcgagcaccagatcaaccagatcgccctgagccccagcggcaccatgctgtacgccgccagcggcaacgccgtgagaatctgggagctgagcagattccagcccgtgggcaagctgaccggccacatcggccccgtgatgtgcctgaccgtgacccagaccgccagccagcacgacctggtggtgaccggcagcaaggaccactacgtgaagatgttcgagctgggcgagtgcgtgaccggcaccatcggccccacccacaacttcgagcccccccactacgacggcatcgagtgcctggccatccagggcgacatcctgttcagcggcagcagagacaacggcatcaagaagtgggacctggaccagcaggagctgatccagcagatccccaacgcccacaaggactgggtgtgcgccctggccttcatccccggcagacccatgctgctgagcgcctgcagagccggcgtgatcaaggtgtggaacgtggacaacttcacccccatcggcgagatcaagggccacgacagccccatcaacgccatctgcaccaacgccaagcacatcttcaccgccagcagcgacctgaccgtgaagttctggagcgtgagaagactgccccacagcggccccccctag

SEQ ID NO: 86248 - DNA, 5007 bp, Artificial Sequence
  Description of Artificial Sequence: Synthetic coding sequence
atggccggccagggcgactgctgcgtgaaggtggccgtgagaatcagaccccagctgagcaaggagaagatcgagggctgccacatctgcaccagcgtgacccccggcgagccccaggtgctgctgggcaaggacaaggccttcacctacgacttcgtgttcgacctggacacctggcaggagcagatctacagcacctgcgtgagcaagctgatcgagggctgcttcgagggctacaacgccaccgtgctggcctacggccagaccggcgccggcaagacctacaccatgggcaccggcttcgacatggccaccagcgaggaggagcagggcatcatccccagagccatcgcccacctgttcggcggcatcgccgagagaaagagaagagcccaggagcagggcgtggccggccccgagttcaaggtgagcgcccagttcctggagctgtacaacgaggagatcctggacctgttcgacagcaccagagaccccgacaccagacacagaagaagcaacatcaagatccacgaggacgccaacggcggcatctacaccaccggcgtgaccagcagactgatccacagccaggaggagctgatccagtgcctgaagcagggcgccctgagcagaaccaccgccagcacccagatgaacgtgcagagcagcagaagccacgccatcttcaccatccacctgtgccagatgagaatgtgcacccagcccgacctggtgaacgaggccgtgaccggcctgcccgacggcaccccccccagcagcgagtacgagaccctgaccgccaagttccacttcgtggacctggccggcagcgagagactgaagagaaccggcgccaccggcgagagagccaaggagggcatcagcatcaactgcggcctgctggccctgggcaacgtgatcagcgccctgggcgaccagagcaagaaggtggtgcacgtgccctacagagacagcaagctgaccagactgctgcaggacagcctgggcggcaacagccagaccatcatgatcgcctgcgtgagccccagcgacagagacttcatggagaccctgaacaccctgaagtacgccaacagagccagaaacatcaagaacaaggtggtggtgaaccaggacaagaccagccagcagatcagcgccctgagagccgagatcgccagactgcagatggagctgatggagtacaaggccggcaagagagtgatcggcgaggacggcgccgagggctacagcgacctgttcagagagaacgccatgctgcagaaggagaacggcgccctgagactgagagtgaaggccatgcaggaggccatcgacgccatcaacaacagagtgacccagctgatgagccaggaggccaacctgctgctggccaaggccggcgacggcaacgaggccatcggcgccctgatccagaactacatcagagagatcgaggagctgagaaccaagctgctggagagcgaggccatgaacgagagcctgagaagaagcctgagcagagccagcgccagaagcccctacagcctgggcgccagccccgccgcccccgccttcggcggcagccccgccagcagcatggaggacgccagcgaggtgatcagaagagccaagcaggacctggagagactgaagaagaaggaggtgagacagagaagaaagagccccgagaaggaggccttcaagaagagagccaagctgcagcaggagaacagcgaggagaccgacgagaacgaggccgaggaggaggaggaggagagagacgagagcggctgcgaggaggaggagggcagagaggacgaggacgaggacagcggcagcgaggagagcctggtggacagcgacagcgaccccgaggagaaggaggtgaacttccaggccgacctggccgacctgacctgcgagatcgagatcaagcagaagctgatcgacgagctggagaacagccagagaagactgcagaccctgaagcaccagtacgaggagaagctgatcctgctgcagaacaagatcagagacacccagctggagagagacagagtgctgcagaacctgagcaccatggagtgctacaccgaggagaaggccaacaagatcaaggccgactacgagaagagactgagagagatgaacagagacctgcagaagctgcaggccgcccagaaggagcacgccagactgctgaagaaccagagcagatacgagagagagctgaagaagctgcaggccgaggtggccgagatgaagaaggccaaggtggccctgatgaagcagatgagagaggagcagcagagaagaagactggtggagaccaagagaaacagagagatcgcccagctgaagaaggagcagagaagacaggagttccagatcagagccctggagagccagaagagacagcaggagatggtgctgagaagaaagacccaggaggtgagcgccctgagaagactggccaagcccatgagcgagagagtggccggcagagccggcctgaagccccccatgctggacagcggcgccgaggtgagcgccagcaccaccagcagcgaggccgagagcggcgccagaagcgtgagcagcatcgtgagacagtggaacagaaagatcaaccacttcctgggcgaccaccccgcccccaccgtgaacggcaccagacccgccagaaagaagttccagaagaagggcgccagccagagcttcagcaaggccgccagactgaagtggcagagcctggagagaagaatcatcgacatcgtgatgcagagaatgaccatcgtgaacctggaggccgacatggagagactgatcaagaagagagaggagctgttcctgctgcaggaggccctgagaagaaagagagagagactgcaggccgagagccccgaggaggagaagggcctgcaggagctggccgaggagatcgaggtgctggccgccaacatcgactacatcaacgacggcatcaccgactgccaggccaccatcgtgcagctggaggagaccaaggaggagctggacagcaccgacaccagcgtggtgatcagcagctgcagcctggccgaggccagactgctgctggacaacttcctgaaggccagcatcgacaagggcctgcaggtggcccagaaggaggcccagatcagactgctggagggcagactgagacagaccgacatggccggcagcagccagaaccacctgctgctggacgccctgagagagaaggccgaggcccaccccgagctgcaggccctgatctacaacgtgcagcaggagaacggctacgccagcaccgacgaggagatcagcgagttcagcgagggcagcttcagccagagcttcaccatgaagggcagcaccagccacgacgacttcaagttcaagagcgagcccaagctgagcgcccagatgaaggccgtgagcgccgagtgcctgggcccccccctggacatcagcaccaagaacatcaccaagagcctggccagcctggtggagatcaaggaggacggcgtgggcttcagcgtgagagacccctactacagagacagagtgagcagaaccgtgagcctgcccaccagaggcagcaccttccccagacagagcagagccaccgagaccagccccctgaccagaagaaagagctacgacagaggccagcccatcagaagcaccgacgtgggcttcaccccccccagcagcccccccaccagacccagaaacgacagaaacgtgttcagcagactgaccagcaaccagagccagggcagcgccctggacaagagcgacgacagcgacagcagcctgagcgaggtgctgagaggcatcatcagccccgtgggcggcgccaagggcgccagaaccgcccccctgcagtgcgtgagcatggccgagggccacaccaagcccatcctgtgcctggacgccaccgacgagctgctgttcaccggcagcaaggacagaagctgcaagatgtggaacctggtgaccggccaggagatcgccgccctgaagggccaccccaacaacgtggtgagcatcaagtactgcagccacagcggcctggtgttcagcgtgagcaccagctacatcaaggtgtgggacatcagagacagcgccaagtgcatcagaaccctgaccagcagcggccaggtgatcagcggcgacgcctgcgccgccaccagcaccagagccatcaccagcgcccagggcgagcaccagatcaaccagatcgccctgagccccagcggcaccatgctgtacgccgccagcggcaacgccgtgagaatctgggagctgagcagattccagcccgtgggcaagctgaccggccacatcggccccgtgatgtgcctgaccgtgacccagaccgccagccagcacgacctggtggtgaccggcagcaaggaccactacgtgaagatgttcgagctgggcgagtgcgtgaccggcaccatcggccccacccacaacttcgagcccccccactacgacggcatcgagtgcctggccatccagggcgacatcctgttcagcggcagcagagacaacggcatcaagaagtgggacctggaccagcaggagctgatccagcagatccccaacgcccacaaggactgggtgtgcgccctggccttcatccccggcagacccatgctgctgagcgcctgcagagccggcgtgatcaaggtgtggaacgtggacaacttcacccccatcggcgagatcaagggccacgacagccccatcaacgccatctgcaccaacgccaagcacatcttcaccgccagcagcgactgcagagtgaagctgtggaactacgtgcccggcctgaccccctgcctgcccagaagagtgctggccatcaagggcagagccaccacctgccccgaccccccccagctgagcctgagccccctgagcttcttccccagcttcctgttccccctgttcccccacttcgacctgagctgcttcctgacctag

SEQ ID NO: 86249 - DNA, 1998 bp, Artificial Sequence
  Description of Artificial Sequence: Synthetic coding sequence
atggccgccggcggcagcacccagcagagaagaagagagatggccgccgccagcgccgccgccatcagcggcgccggcagatgcagactgagcaagatcggcgccaccagaagacccccccccgccagagtgagagtggccgtgagactgagacccttcgtggacggcaccgccggcgccagcgaccccccctgcgtgagaggcatggacagctgcagcctggagatcgccaactggagaaaccaccaggagaccctgaagtaccagttcgacgccttctacggcgagagaagcacccagcaggacatctacgccggcagcgtgcagcccatcctgagacacctgctggagggccagaacgccagcgtgctggcctacggccccaccggcgccggcaagacccacaccatgctgggcagccccgagcagcccggcgtgatccccagagccctgatggacctgctgcagctgaccagagaggagggcgccgagggcagaccctgggccctgagcgtgaccatgagctacctggagatctaccaggagaaggtgctggacctgctggaccccgccagcggcgacctggtgatcagagaggactgcagaggcaacatcctgatccccggcctgagccagaagcccatcagcagcttcgccgacttcgagagacacttcctgcccgccagcagaaacagaaccgtgggcgccaccagactgaaccagagaagcagcagaagccacgccgtgctgctggtgaaggtggaccagagagagagactggcccccttcagacagagagagggcaagctgtacctgatcgacctggccggcagcgaggacaacagaagaaccggcaacaagggcctgagactgaaggagagcggcgccatcaacaccagcctgttcgtgctgggcaaggtggtggacgccctgaaccagggcctgcccagagtgccctacagagacagcaagctgaccagactgctgcaggacagcctgggcggcagcgcccacagcatcctgatcgccaacatcgcccccgagagaagattctacctggacaccgtgagcgccctgaacttcgccgccagaagcaaggaggtgatcaacagacccttcaccaacgagagcctgcagccccacgccctgggccccgtgaagctgagccagaaggagctgctgggcccccccgaggccaagagagccagaggccccgaggaggaggagatcggcagccccgagcccatggccgcccccgccagcgccagccagaagctgagccccctgcagaagctgagcagcatggaccccgccatgctggagagactgctgagcctggacagactgctggccagccagggcagccagggcgcccccctgctgagcacccccaagagagagagaatggtgctgatgaagaccgtggaggagaaggacctggagatcgagagactgaagaccaagcagaaggagctggaggccaagatgctggcccagaaggccgaggagaaggagaaccactgccccaccatgctgagacccctgagccacagaaccgtgaccggcgccaagcccctgaagaaggccgtggtgatgcccctgcagctgatccaggagcaggccgccagccccaacgccgagatccacatcctgaagaacaagggcagaaagagaaagctggagagcctggacgccctggagcccgaggagaaggccgaggactgctgggagctgcagatcagccccgagctgctggcccacggcagacagaagatcctggacctgctgaacgagggcagcgccagagacctgagaagcctgcagagaatcggccccaagaaggcccagctgatcgtgggctggagagagctgcacggccccttcagccaggtggaggacctggagagagtggagggcatcaccggcaagcagatggagagcttcctgaaggccaacatcctgggcctggccgccggccagagatgcggcgccagctag

SEQ ID NO: 86250 - DNA, 219 bp, Artificial Sequence
  Description of Artificial Sequence: Synthetic coding sequence
atgctggcccagaaggccgaggagaaggagaaccactgccccaccatgctgagacccctgagccacagaaccgtgaccggcgccaagcccctgaagaaggccgtggtgatgcccctgcagctgatccaggagcaggccgccagccccaacgccgagatccacatcctgaagaacaagggcagaaagagaaagggcgccaacatcaccaccggctactag

SEQ ID NO: 86251 - DNA, 1794 bp, Artificial Sequence
  Description of Artificial Sequence: Synthetic coding sequence
atggacagctgcagcctggagatcgccaactggagaaaccaccaggagaccctgaagtaccagttcgacgccttctacggcgagagaagcacccagcaggacatctacgccggcagcgtgcagcccatcctgagacacctgctggagggccagaacgccagcgtgctggcctacggccccaccggcgccggcaagacccacaccatgctgggcagccccgagcagcccggcgtgatccccagagccctgatggacctgctgcagctgaccagagaggagggcgccgagggcagaccctgggccctgagcgtgaccatgagctacctggagatctaccaggagaaggtgctggacctgctggaccccgccagcggcgacctggtgatcagagaggactgcagaggcaacatcctgatccccggcctgagccagaagcccatcagcagcttcgccgacttcgagagacacttcctgcccgccagcagaaacagaaccgtgggcgccaccagactgaaccagagaagcagcagaagccacgccgtgctgctggtgaaggtggaccagagagagagactggcccccttcagacagagagagggcaagctgtacctgatcgacctggccggcagcgaggacaacagaagaaccggcaacaagggcctgagactgaaggagagcggcgccatcaacaccagcctgttcgtgctgggcaaggtggtggacgccctgaaccagggcctgcccagagtgccctacagagacagcaagctgaccagactgctgcaggacagcctgggcggcagcgcccacagcatcctgatcgccaacatcgcccccgagagaagattctacctggacaccgtgagcgccctgaacttcgccgccagaagcaaggaggtgatcaacagacccttcaccaacgagagcctgcagccccacgccctgggccccgtgaagctgagccagaaggagctgctgggcccccccgaggccaagagagccagaggccccgaggaggaggagatcggcagccccgagcccatggccgcccccgccagcgccagccagaagctgagccccctgcagaagctgagcagcatggaccccgccatgctggagagactgctgagcctggacagactgctggccagccagggcagccagggcgcccccctgctgagcacccccaagagagagagaatggtgctgatgaagaccgtggaggagaaggacctggagatcgagagactgaagaccaagcagaaggagctggaggccaagatgctggcccagaaggccgaggagaaggagaaccactgccccaccatgctgagacccctgagccacagaaccgtgaccggcgccaagcccctgaagaaggccgtggtgatgcccctgcagctgatccaggagcaggccgccagccccaacgccgagatccacatcctgaagaacaagggcagaaagagaaagctggagagcctggacgccctggagcccgaggagaaggccgaggactgctgggagctgcagatcagccccgagctgctggcccacggcagacagaagatcctggacctgctgaacgagggcagcgccagagacctgagaagcctgcagagaatcggccccaagaaggcccagctgatcgtgggctggagagagctgcacggccccttcagccaggtggaggacctggagagagtggagggcatcaccggcaagcagatggagagcttcctgaaggccaacatcctgggcctggccgccggccagagatgcggcgccagctag

SEQ ID NO: 86252 - DNA, 1794 bp, Artificial Sequence; identical to SEQ ID NO: 86251
  Description of Artificial Sequence: Synthetic coding sequence

SEQ ID NO: 86253 - DNA, 2883 bp, Artificial Sequence
  Description of Artificial Sequence: Synthetic coding sequence
atgaagagcgccagagccaagacccccagaaagcccaccgtgaagaagggcagccagaccaacctgaaggaccccgtgggcgtgtactgcagagtgagacccctgggcttccccgaccaggagtgctgcatcgaggtgatcaacaacaccaccgtgcagctgcacacccccgagggctacagactgaacagaaacggcgactacaaggagacccagtacagcttcaagcaggtgttcggcacccacaccacccagaaggagctgttcgacgtggtggccaaccccctggtgaacgacctgatccacggcaagaacggcctgctgttcacctacggcgtgaccggcagcggcaagacccacaccatgaccggcagccccggcgagggcggcctgctgcccagatgcctggacatgatcttcaacagcatcggcagcttccaggccaagagatacgtgttcaagagcaacgacagaaacagcatggacatccagtgcgaggtggacgccctgctggagagacagaagagagaggccatgcccaaccccaagaccagcagcagcaagagacaggtggaccccgagttcgccgacatgatcaccgtgcaggagttctgcaaggccgaggaggtggacgaggacagcgtgtacggcgtgttcgtgagctacatcgagatctacaacaactacatctacgacctgctggaggaggtgcccttcgaccccatcaagcccaagcccccccagagcaagctgctgagagaggacaagaaccacaacatgtacgtggccggctgcaccgaggtggaggtgaagagcaccgaggaggccttcgaggtgttctggagaggccagaagaagagaagaatcgccaacacccacctgaacagagagagcagcagaagccacagcgtgttcaacatcaagctggtgcaggcccccctggacgccgacggcgacaacgtgctgcaggagaaggagcagatcaccatcagccagctgagcctggtggacctggccggcagcgagagaaccaacagaaccagagccgagggcaacagactgagagaggccggcaacatcaaccagagcctgatgaccctgagaacctgcatggacgtgctgagagagaaccagatgtacggcaccaacaagatggtgccctacagagacagcaagctgacccacctgttcaagaactacttcgacggcgagggcaaggtgagaatgatcgtgtgcgtgaaccccaaggccgaggactacgaggagaacctgcaggtgatgagattcgccgaggtgacccaggaggtggaggtggccagacccgtggacaaggccatctgcggcctgacccccggcagaagatacagaaaccagcccagaggccccgtgggcaacgagcccctggtgaccgacgtggtgctgcagagcttcccccccctgcccagctgcgagatcctggacatcaacgacgagcagaccctgcccagactgatcgaggccctggagaagagacacaacctgagacagatgatgatcgacgagttcaacaagcagagcaacgccttcaaggccctgctgcaggagttcgacaacgccgtgctgagcaaggagaaccacatgcagggcaagctgaacgagaaggagaagatgatcagcggccagaagctggagatcgagagactggagaagaagaacaagaccctggagtacaagatcgagatcctggagaagaccaccaccatctacgaggaggacaagagaaacctgcagcaggagctggagacccagaaccagaagctgcagagacagttcagcgacaagagaagactggaggccagactgcagggcatggtgaccgagaccaccatgaagtgggagaaggagtgcgagagaagagtggccgccaagcagctggagatgcagaacaagctgtgggtgaaggacgagaagctgaagcagctgaaggccatcgtgaccgagcccaagaccgagaagcccgagagacccagcagagagagagacagagagaaggtgacccagagaagcgtgagccccagccccgtgcccctgagcagcaactacatcgcccagatcagcaacggccagcagctgatgagccagccccagctgcacagaagaagcaacagctgcagcagcatcagcgtggccagctgcatcagcgagtgggagcagaagatccccacctacaacacccccctgaaggtgaccagcatcgccagaagaagacagcaggagcccggccagagcaagacctgcatcgtgagcgacagaagaagaggcatgtactggaccgagggcagagaggtggtgcccaccttcagaaacgagatcgagatcgaggaggaccactgcggcagactgctgttccagcccgaccagaacgccccccccatcagactgagacacagaagaagcagaagcgccggcgacagatgggtggaccacaagcccgccagcaacatgcagaccgagaccgtgatgcagccccacgtgccccacgccatcaccgtgagcgtggccaacgagaaggccctggccaagtgcgagaagtacatgctgacccaccaggagctggccagcgacggcgagatcgagaccaagctgatcaagggcgacatctacaagaccagaggcggcggccagagcgtgcagttcaccgacatcgagaccctgaagcaggagagccccaacggcagcagaaagagaagaagcagcaccgtggcccccgcccagcccgacggcgccgagagcgagtggaccgacgtggagaccagatgcagcgtggccgtggagatgagagccggcagccagctgggccccggctaccagcaccacgcccagcccaagagaaagaagccctag

SEQ ID NO: 86254 - DNA, 2022 bp, Artificial Sequence
  Description of Artificial Sequence: Synthetic coding sequence
atgatcaccgtgcaggagttctgcaaggccgaggaggtggacgaggacagcgtgtacggcgtgttcgtgagctacatcgagatctacaacaactacatctacgacctgctggaggaggtgcccttcgaccccatcaagcccaagtggaacagctgcagcacccccatgagaaacaccgacttcgtgcccccccagagcaagctgctgagagaggacaagaaccacaacatgtacgtggccggctgcaccgaggtggaggtgaagagcaccgaggaggccttcgaggtgttctggagaggccagaagaagagaagaatcgccaacacccacctgaacagagagagcagcagaagccacagcgtgttcaacatcaagctggtgcaggcccccctggacgccgacggcgacaacgtgctgcaggagaaggagcagatcaccatcagccagctgagcctggtggacctggccggcagcgagagaaccaacagaaccagagccgagggcaacagactgagagaggccggcaacatcaaccagagcctgatgaccctgagaacctgcatggacgtgctgagagagaaccagatgtacggcaccaacaagatggtgccctacagagacagcaagctgacccacctgttcaagaactacttcgacggcgagggcaaggtgagaatgatcgtgtgcgtgaaccccaaggccgaggactacgaggagaacctgcaggtgatgagattcgccgaggtgacccaggaggtggaggtggccagacccgtggacaaggccatctgcggcctgacccccggcagaagatacagaaaccagcccagaggccccgtgggcaacgagcccctggtgaccgacgtggtgctgcagagcttcccccccctgcccagctgcgagatcctggacatcaacgacgagcagaccctgcccagactgatcgaggccctggagaagagacacaacctgagacagatgatgatcgacgagttcaacaagcagagcaacgccttcaaggccctgctgcaggagttcgacaacgccgtgctgagcaaggagaaccacatgcagggcaagctgaacgagaaggagaagatgatcagcggccagaagctggagatcgagagactggagaagaagaacaagaccctggagtacaagatcgagatcctggagaagaccaccaccatctacgaggaggacaagagaaacctgcagcaggagctggagacccagaaccagaagctgcagagacagttcagcgacaagagaagactggaggccagactgcagggcatggtgaccgagaccaccatgaagtgggagaaggagtgcgagagaagagtggccgccaagcagctggagatgcagaacaagctgtgggtgaaggacgagaagctgaagcagctgaaggccatcgtgaccgagcccaagaccgagaagcccgagagacccagcagagagagagacagagagaaggtgacccagagaagcgtgagccccagccccgtgcccctgctgttccagcccgaccagaacgccccccccatcagactgagacacagaagaagcagaagcgccggcgacagatgggtggaccacaagcccgccagcaacatgcagaccgagaccgtgatgcagccccacgtgccccacgccatcaccgtgagcgtggccaacgagaaggccctggccaagtgcgagaagtacatgctgacccaccaggagctggccagcgacggcgagatcgagaccaagctgatcaagggcgacatctacaagaccagaggcggcggccagagcgtgcagttcaccgacatcgagaccctgaagcaggagagccccaacggcagcagaaagagaagaagcagcaccgtggcccccgcccagcccgacggcgccgagagcgagtggaccgacgtggagaccagatgcagcgtggccgtggagatgagagccggcagccagctgggccccggctaccagcaccacgcccagcccaagagaaagaagccctag

SEQ ID NO: 86255 - DNA, 2022 bp, Artificial Sequence; identical to SEQ ID NO: 86254
  Description of Artificial Sequence: Synthetic coding sequence

SEQ ID NO: 86256 - DNA, 2571 bp, Artificial Sequence
  Description of Artificial Sequence: Synthetic coding sequence
atgaagagcgccagagccaagacccccagaaagcccaccgtgaagaagggcagccagaccaacctgaaggaccccgtgggcgtgtactgcagagtgagacccctgggcttccccgaccaggagtgctgcatcgaggtgatcaacaacaccaccgtgcagctgcacacccccgagggctacagactgaacagaaacggcgactacaaggagacccagtacagcttcaagcaggtgttcggcacccacaccacccagaaggagctgttcgacgtggtggccaaccccctggtgaacgacctgatccacggcaagaacggcctgctgttcacctacggcgtgaccggcagcggcaagacccacaccatgaccggcagccccggcgagggcggcctgctgcccagatgcctggacatgatcttcaacagcatcggcagcttccaggccaagagatacgtgttcaagagcaacgacagaaacagcatggacatccagtgcgaggtggacgccctgctggagagacagaagagagaggccatgcccaaccccaagaccagcagcagcaagagacaggtggaccccgagttcgccgacatgatcaccgtgcaggagttctgcaaggccgaggaggtggacgaggacagcgtgtacggcgtgttcgtgagctacatcgagatctacaacaactacatctacgacctgctggaggaggtgcccttcgaccccatcaagcccaagcccccccagagcaagctgctgagagaggacaagaaccacaacatgtacgtggccggctgcaccgaggtggaggtgaagagcaccgaggaggccttcgaggtgttctggagaggccagaagaagagaagaatcgccaacacccacctgaacagagagagcagcagaagccacagcgtgttcaacatcaagctggtgcaggcccccctggacgccgacggcgacaacgtgctgcaggagaaggagcagatcaccatcagccagctgagcctggtggacctggccggcagcgagagaaccaacagaaccagagccgagggcaacagactgagagaggccggcaacatcaaccagagcctgatgaccctgagaacctgcatggacgtgctgagagagaaccagatgtacggcaccaacaagatggtgccctacagagacagcaagctgacccacctgttcaagaactacttcgacggcgagggcaaggtgagaatgatcgtgtgcgtgaaccccaaggccgaggactacgaggagaacctgcaggtgatgagattcgccgaggtgacccaggaggtggaggtggccagacccgtggacaaggccatctgcggcctgacccccggcagaagatacagaaaccagcccagaggccccgtgggcaacgagcccctggtgaccgacgtggtgctgcagagcttcccccccctgcccagctgcgagatcctggacatcaacgacgagcagaccctgcccagactgatcgaggccctggagaagagacacaacctgagacagatgatgatcgacgagttcaacaagcagagcaacgccttcaaggccctgctgcaggagttcgacaacgccgtgctgagcaaggagaaccacatgcagggcaagctgaacgagaaggagaagatgatcagcggccagaagctggagatcgagagactggagaagaagaacaagaccctggagtacaagatcgagatcctggagaagaccaccaccatctacgaggaggacaagagaaacctgcagcaggagctggagacccagaaccagaagctgcagagacagttcagcgacaagagaagactggaggccagactgcagggcatggtgaccgagaccaccatgaagtgggagaaggagtgcgagagaagagtggccgccaagcagctggagatgcagaacaagctgtgggtgaaggacgagaagctgaagcagctgaaggccatcgtgaccgagcccaagaccgagaagcccgagagacccagcagagagagagacagagagaaggtgacccagagaagcgtgagccccagccccgtgcccctgctgttccagcccgaccagaacgccccccccatcagactgagacacagaagaagcagaagcgccggcgacagatgggtggaccacaagcccgccagcaacatgcagaccgagaccgtgatgcagccccacgtgccccacgccatcaccgtgagcgtggccaacgagaaggccctggccaagtgcgagaagtacatgctgacccaccaggagctggccagcgacggcgagatcgagaccaagctgatcaagggcgacatctacaagaccagaggcggcggccagagcgtgcagttcaccgacatcgagaccctgaagcaggagagccccaacggcagcagaaagagaagaagcagcaccgtggcccccgcccagcccgacggcgccgagagcgagtggaccgacgtggagaccagatgcagcgtggccgtggagatgagagccggcagccagctgggccccggctaccagcaccacgcccagcccaagagaaagaagccctag

SEQ ID NO: 86257 - DNA, 2520 bp, Artificial Sequence
  Description of Artificial Sequence: Synthetic coding sequence
atgaccggcagccccggcgagggcggcctgctgcccagatgcctggacatgatcttcaacagcatcggcagcttccaggccaagagatacgtgttcaagagcaacgacagaaacagcatggacatccagtgcgaggtggacgccctgctggagagacagaagagagaggccatgcccaaccccaagaccagcagcagcaagagacaggtggaccccgagttcgccgacatgatcaccgtgcaggagttctgcaaggccgaggaggtggacgaggacagcgtgtacggcgtgttcgtgagctacatcgagatctacaacaactacatctacgacctgctggaggaggtgcccttcgaccccatcaagcccaagcccccccagagcaagctgctgagagaggacaagaaccacaacatgtacgtggccggctgcaccgaggtggaggtgaagagcaccgaggaggccttcgaggtgttctggagaggccagaagaagagaagaatcgccaacacccacctgaacagagagagcagcagaagccacagcgtgttcaacatcaagctggtgcaggcccccctggacgccgacggcgacaacgtgctgcaggagaaggagcagatcaccatcagccagctgagcctggtggacctggccggcagcgagagaaccaacagaaccagagccgagggcaacagactgagagaggccggcaacatcaaccagagcctgatgaccctgagaacctgcatggacgtgctgagagagaaccagatgtacggcaccaacaagatggtgccctacagagacagcaagctgacccacctgttcaagaactacttcgacggcgagggcaaggtgagaatgatcgtgtgcgtgaaccccaaggccgaggactacgaggagaacctgcaggtgatgagattcgccgaggtgacccaggaggtggaggtggccagacccgtggacaaggccatctgcggcctgacccccggcagaagatacagaaaccagcccagaggccccgtgggcaacgagcccctggtgaccgacgtggtgctgcagagcttcccccccctgcccagctgcgagatcctggacatcaacgacgagcagaccctgcccagactgatcgaggccctggagaagagacacaacctgagacagatgatgatcgacgagttcaacaagcagagcaacgccttcaaggccctgctgcaggagttcgacaacgccgtgctgagcaaggagaaccacatgcagggcaagctgaacgagaaggagaagatgatcagcggccagaagctggagatcgagagactggagaagaagaacaagaccctggagtacaagatcgagatcctggagaagaccaccaccatctacgaggaggacaagagaaacctgcagcaggagctggagacccagaaccagaagctgcagagacagttcagcgacaagagaagactggaggccagactgcagggcatggtgaccgagaccaccatgaagtgggagaaggagtgcgagagaagagtggccgccaagcagctggagatgcagaacaagctgtgggtgaaggacgagaagctgaagcagctgaaggccatcgtgaccgagcccaagaccgagaagcccgagagacccagcagagagagagacagagagaaggtgacccagagaagcgtgagccccagccccgtgcccctgagcagcaactacatcgcccagatcagcaacggccagcagctgatgagccagccccagctgcacagaagaagcaacagctgcagcagcatcagcgtggccagctgcatcagcgagtgggagcagaagatccccacctacaacacccccctgaaggtgaccagcatcgccagaagaagacagcaggagcccggccagagcaagacctgcatcgtgagcgacagaagaagaggcatgtactggaccgagggcagagaggtggtgcccaccttcagaaacgagatcgagatcgaggaggaccactgcggcagactgctgttccagcccgaccagaacgccccccccatcagactgagacacagaagaagcagaagcgccggcgacagatgggtggaccacaagcccgccagcaacatgcagaccgagaccgtgatgcagccccacgtgccccacgccatcaccgtgagcgtggccaacgagaaggccctggccaagtgcgagaagtacatgctgacccaccaggagctggccagcgacggcgagatcgagaccaagctgatcaagggcgacatctacaagaccagaggcggcggccagagcgtgcagttcaccgacatcgagaccctgaagcaggagagccccaacggcagcagaaagagaagaagcagcaccgtggcccccgcccagcccgacggcgccgagagcgagtggaccgacgtggagaccagatgcagcgtggccgtggagatgagagccggcagccagctgggccccggctaccagcaccacgcccagcccaagagaaagaagccctag

SEQ ID NO: 86258 - DNA, 3705 bp, Artificial Sequence
  Description of Artificial Sequence: Synthetic coding sequence
atggccagctggctgtacgagtgcctgtgcgaggccgagctggcccagtactacagccacttcaccgccctgggcctgcagaagatcgacgagctggccaagatcaccatgaaggactacagcaagctgggcgtgcacgacatgaacgacagaaagagactgttccagctgatcaagatcatcaagatcatgcaggaggaggacaaggccgtgagcatccccgagagacacctgcagaccagcagcctgagaatcaagagccaggagctgagaagcggccccagaagacagctgaacttcgacagccccgccgacaacaaggacagaaacgccagcaacgacggcttcgagatgtgcagcctgagcgacttcagcgccaacgagcagaagagcacctacctgaaggtgctggagcacatgctgcccgacgacagccagtaccacaccaagaccggcatcctgaacgccaccgccggcgacagctacgtgcagaccgagatcagcaccagcctgttcagccccaactacctgagcgccatcctgggcgactgcgacatccccatcatccagagaatcagccacgtgagcggctacaactacggcatcccccacagctgcatcagacagaacaccagcgagaagcagaacccctggaccgagatggagaagatcagagtgtgcgtgagaaagagacccctgggcatgagagaggtgagaagaggcgagatcaacatcatcaccgtggaggacaaggagaccctgctggtgcacgagaagaaggaggccgtggacctgacccagtacatcctgcaggtgatcctgaagggcagcaaggagagaagcaccggcgccaccggcgtgaacgccgacagcagcagaagccacgccgtgatccagatccagatcaaggacagcgccaagagaaccttcggcagaatcagcttcatcgacctggccggcagcgagagagccgccgacgccagagacagcgacagacagaccaagatggagggcgccgagatcaaccagagcctgctggccctgaaggagtgcatcagagccctggaccaggagcacacccacacccccttcagacagagcaagctgacccaggtgctgaaggacagcttcatcggcaacgccaagacctgcatgatcgccaacatcagccccagccacgtggccaccgagcacaccctgaacaccctgagatacgccgacagagtgaaggagctgaagaagggcatcaagtgctgcaccagcgtgaccagcagaaacagaaccagcggcaacagcagccccaagagaatccagagcagccccggcgccctgagcgaggacaagtgcagccccaagaaggtgaagctgggcttccagcagagcctgaccgtggccgcccccggcagcaccagaggcaaggtgcaccccctgaccagccacccccccaacatccccttcaccagcgcccccaaggtgagcggcaagagaggcggcagcagaggcagccccagccaggagtgggtgatccacgccagccccgtgaagggcaccgtgagaagcggccacgtggccaagaagaagcccgaggagagcgcccccctgtgcagcgagaagaacagaatgggcaacaagaccgtgctgggctgggagagcagagccagcggccccggcgagggcctggtgagaggcaagctgagcaccaagtgcaagaaggtgcagaccgtgcagcccgtgcagaagcagctggtgagcagagtggagctgagcttcggcaacgcccaccacagagccgagtacagccaggacagccagagaggcacccccgccagacccgccagcgaggcctggaccaacatccccccccaccagaaggagagagaggagcacctgagattctaccaccagcagttccagcagccccccctgctgcagcagaagctgaagtaccagcccctgaagagaagcctgagacagtacagaccccccgagggccagctgaccaacgagaccccccccctgttccacagctacagcgagaaccacgacggcgcccaggtggaggagctggacgacagcgacttcagcgaggacagcttcagccacatcagcagccagagagccaccaagcagagaaacaccctggagaacagcgaggacagcttcttcctgcaccagacctggggccagggccccgagaagcaggtggccgagagacagcagagcctgttcagcagccccagaaccggcgacaagaaggacctgaccaagagctgggtggacagcagagaccccatcaaccacagaagagccgccctggaccacagctgcagccccagcaagggccccgtggactggagcagagagaacagcaccagcagcggccccagccccagagacagcctggccgagaagccctactgcagccaggtggacttcatctacagacaggagagaggcggcggcagcagcttcgacctgagaaaggacgccagccagagcgaggtgagcggcgagaacgagggcaacctgcccagccccgaggaggacggcttcaccatcagcctgagccacgtggccgtgcccggcagccccgaccagagagacaccgtgaccacccccctgagagaggtgagcgccgacggccccatccaggtgaccagcaccgtgaagaacggccacgccgtgcccggcgaggaccccagaggccagctgggcacccacgccgagtacgccagcggcctgatgagccccctgaccatgagcctgctggagaaccccgacaacgagggcagcccccccagcgagcagctggtgcaggacggcgccacccacagcctggtggccgagagcaccggcggccccgtggtgagccacaccgtgcccagcggcgaccaggaggccgccctgcccgtgagcagcgccaccagacacctgtggctgagcagcagcccccccgacaacaagcccggcggcgacctgcccgccctgagccccagccccatcagacagcaccccgccgacaagctgcccagcagagaggccgacctgggcgaggcctgccagagcagagagaccgtgctgttcagccacgagcacatgggcagcgagcagtacgacgccgacgccgaggagaccggcctggacggcagctggggcttccccggcaagcccttcaccaccatccacatgggcgtgccccacagcggccccaccctgacccccagaaccggcagcagcgacgtggccgaccagctgtgggcccaggagagaaagcaccccaccagactgggctggcaggagttcggcctgagcaccgaccccatcaagctgccctgcaacagcgagaacgtgacctggctgaagcccagacccatcagcagatgcctggccagacccagcagccccctggtgcccagctgcagccccaagaccgccggcaccctgagacagcccaccctggagcaggcccagcaggtggtgatcagagcccaccaggagcagctggacgagatggccgagctgggcttcaaggaggagaccctgatgagccagctggccagcaacgacttcgaggacttcgtgacccagctggacgagatcatggtgctgaagagcaagtgcatccagagcctgagaagccagctgcagctgtacctgacctgccacggccccaccgccgcccccgagggcaccgtgcccagctag

SEQ ID NO: 86259 - DNA, 4107 bp, Artificial Sequence
  Description of Artificial Sequence: Synthetic coding sequence
atggccagctggctgtacgagtgcctgtgcgaggccgagctggcccagtactacagccacttcaccgccctgggcctgcagaagatcgacgagctggccaagatcaccatgaaggactacagcaagctgggcgtgcacgacatgaacgacagaaagagactgttccagctgatcaagatcatcaagatcatgcaggaggaggacaaggccgtgagcatccccgagagacacctgcagaccagcagcctgagaatcaagagccaggagctgagaagcggccccagaagacagctgaacttcgacagccccgccgacaacaaggacagaaacgccagcaacgacggcttcgagatgtgcagcctgagcgacttcagcgccaacgagcagaagagcacctacctgaaggtgctggagcacatgctgcccgacgacagccagtaccacaccaagaccggcatcctgaacgccaccgccggcgacagctacgtgcagaccgagatcagcaccagcctgttcagccccaactacctgagcgccatcctgggcgactgcgacatccccatcatccagagaatcagccacgtgagcggctacaactacggcatcccccacagctgcatcagacagaacaccagcgagaagcagaacccctggaccgagatggagaagatcagagtgtgcgtgagaaagagacccctgggcatgagagaggtgagaagaggcgagatcaacatcatcaccgtggaggacaaggagaccctgctggtgcacgagaagaaggaggccgtggacctgacccagtacatcctgcagcacgtgttctacttcgacgaggtgttcggcgaggcctgcaccaaccaggacgtgtacatgaagaccacccaccccctgatccagcacatcttcaacggcggcaacgccacctgcttcgcctacggccagaccggcgccggcaagacctacaccatgatcggcacccacgagaaccccggcctgtacgccctggccgccaaggacatcttcagacagctggaggtgagccagcccagaaagcacctgttcgtgtggatcagcttctacgagatctactgcggccagctgtacgacctgctgaacagaagaaagagactgttcgccagagaggacagcaagcacatggtgcagatcgtgggcctgcaggagctgcaggtggacagcgtggagctgctgctggaggtgatcctgaagggcagcaaggagagaagcaccggcgccaccggcgtgaacgccgacagcagcagaagccacgccgtgatccagatccagatcaaggacagcgccaagagaaccttcggcagaatcagcttcatcgacctggccggcagcgagagagccgccgacgccagagacagcgacagacagaccaagatggagggcgccgagatcaaccagagcctgctggccctgaaggagtgcatcagagccctggaccaggagcacacccacacccccttcagacagagcaagctgacccaggtgctgaaggacagcttcatcggcaacgccaagacctgcatgatcgccaacatcagccccagccacgtggccaccgagcacaccctgaacaccctgagatacgccgacagagtgaaggagctgaagaagggcatcaagtgctgcaccagcgtgaccagcagaaacagaaccagcggcaacagcagccccaagagaatccagagcagccccggcgccctgagcgaggacaagtgcagccccaagaaggtgaagctgggcttccagcagagcctgaccgtggccgcccccggcagcaccagaggcaaggtgcaccccctgaccagccacccccccaacatccccttcaccagcgcccccaaggtgagcggcaagagaggcggcagcagaggcagccccagccaggagtgggtgatccacgccagccccgtgaagggcaccgtgagaagcggccacgtggccaagaagaagcccgaggagagcgcccccctgtgcagcgagaagaacagaatgggcaacaagaccgtgctgggctgggagagcagagccagcggccccggcgagggcctggtgagaggcaagctgagcaccaagtgcaagaaggtgcagaccgtgcagcccgtgcagaagcagctggtgagcagagtggagctgagcttcggcaacgcccaccacagagccgagtacagccaggacagccagagaggcacccccgccagacccgccagcgaggcctggaccaacatccccccccaccagaaggagagagaggagcacctgagattctaccaccagcagttccagcagccccccctgctgcagcagaagctgaagtaccagcccctgaagagaagcctgagacagtacagaccccccgagggccagctgaccaacgagaccccccccctgttccacagctacagcgagaaccacgacggcgcccaggtggaggagctggacgacagcgacttcagcgaggacagcttcagccacatcagcagccagagagccaccaagcagagaaacaccctggagaacagcgaggacagcttcttcctgcaccagacctggggccagggccccgagaagcaggtggccgagagacagcagagcctgttcagcagccccagaaccggcgacaagaaggacctgaccaagagctgggtggacagcagagaccccatcaaccacagaagagccgccctggaccacagctgcagccccagcaagggccccgtggactggagcagagagaacagcaccagcagcggccccagccccagagacagcctggccgagaagccctactgcagccaggtggacttcatctacagacaggagagaggcggcggcagcagcttcgacctgagaaaggacgccagccagagcgaggtgagcggcgagaacgagggcaacctgcccagccccgaggaggacggcttcaccatcagcctgagccacgtggccgtgcccggcagccccgaccagagagacaccgtgaccacccccctgagagaggtgagcgccgacggccccatccaggtgaccagcaccgtgaagaacggccacgccgtgcccggcgaggaccccagaggccagctgggcacccacgccgagtacgccagcggcctgatgagccccctgaccatgagcctgctggagaaccccgacaacgagggcagcccccccagcgagcagctggtgcaggacggcgccacccacagcctggtggccgagagcaccggcggccccgtggtgagccacaccgtgcccagcggcgaccaggaggccgccctgcccgtgagcagcgccaccagacacctgtggctgagcagcagcccccccgacaacaagcccggcggcgacctgcccgccctgagccccagccccatcagacagcaccccgccgacaagctgcccagcagagaggccgacctgggcgaggcctgccagagcagagagaccgtgctgttcagccacgagcacatgggcagcgagcagtacgacgccgacgccgaggagaccggcctggacggcagctggggcttccccggcaagcccttcaccaccatccacatgggcgtgccccacagcggccccaccctgacccccagaaccggcagcagcgacgtggccgaccagctgtgggcccaggagagaaagcaccccaccagactgggctggcaggagttcggcctgagcaccgaccccatcaagctgccctgcaacagcgagaacgtgacctggctgaagcccagacccatcagcagatgcctggccagacccagcagccccctggtgcccagctgcagccccaagaccgccggcaccctgagacagcccaccctggagcaggcccagcaggtggtgatcagagcccaccaggagcagctggacgagatggccgagctgggcttcaaggaggagaccctgatgagccagctggccagcaacgacttcgaggacttcgtgacccagctggacgagatcatggtgctgaagagcaagtgcatccagagcctgagaagccagctgcagctgtacctgacctgccacggccccaccgccgcccccgagggcaccgtgcccagctag

SEQ ID NO: 86260 - DNA, 4107 bp, Artificial Sequence; identical to SEQ ID NO: 86259
  Description of Artificial Sequence: Synthetic coding sequence

SEQ ID NO: 86261 - DNA, 3477 bp, Artificial Sequence
  Description of Artificial Sequence: Synthetic coding sequence
atggccagctggctgtacgagtgcctgtgcgaggccgagctggcccagtactacagccacttcaccgccctgggcctgcagaagatcgacgagctggccaagatcaccatgaaggactacagcaagctgggcgtgcacgacatgaacgacagaaagagactgttccagctgatcaagatcatcaagatcatgcaggaggaggacaaggccgtgagcatccccgagagacacctgcagaccagcagcctgagaatcaagagccaggagctgagaagcggccccagaagacagctgaacttcgacagccccgccgacaacaaggacagaaacgccagcaacgacggcttcgagatgtgcagcctgagcgacttcagcgccaacgagcagaagagcacctacctgaaggtgctggagcacatgctgcccgacgacagccagtaccacaccaagaccggcatcctgaacgccaccgccggcgacagctacgtgcagaccgagatcagcaccagcctgttcagccccaactacctgagcgccatcctgggcgactgcgacatccccatcatccagagaatcagccacgtgagcggctacaactacggcatcccccacagctgcatcagacagaacaccagcgagaagcagaacccctggaccgagatggagaagatcagagtgtgcgtgagaaagagacccctgggcatgagagaggtgagaagaggcgagatcaacatcatcaccgtggaggacaaggagaccctgctggtgcacgagaagaaggaggccgtggacctgacccagtacatcctgcagcacgtgttctacttcgacgaggtgttcggcgaggcctgcaccaaccaggacgtgtacatgaagaccacccaccccctgatccagcacatcttcaacggcggcaacgccacctgcttcgcctacggccagaccggcgccggcaagacctacaccatgatcggcacccacgagaaccccggcctgtacgccctggccgccaaggacatcttcagacagctggaggtgagccagcccagaaagcacctgttcgtgtggatcagcttctacgagatctactgcggccagctgtacgacctgctgaacagaagaaagagactgttcgccagagaggacagcaagcacatggtgcagatcgtgggcctgcaggagctgcaggtggacagcgtggagctgctgctggaggtgatcctgaagggcagcaaggagagaagcaccggcgccaccggcgtgaacgccgacagcagcagaagccacgccgtgatccagatccagatcaaggacagcgccaagagaaccttcggcagaatcagcttcatcgacctggccggcagcgagagagccgccgacgccagagacagcgacagacagaccaagatggagggcgccgagatcaaccagagcctgctggccctgaaggagtgcatcagagccctggaccaggagcacacccacacccccttcagacagagcaagctgacccaggtgctgaaggacagcttcatcggcaacgccaagacctgcatgatcgccaacatcagccccagccacgtggccaccgagcacaccctgaacaccctgagatacgccgacagagtgaaggagctgaagaagggcatcaagtgctgcaccagcgtgaccagcagaaacagaaccagcggcaacagcagccccaagagaatccagagcagccccggcgccctgagcgaggacaagtgcagccccaagaaggtgaagctgggcttccagcagagcctgaccgtggccgcccccggcagcaccagaggcaaggtgcaccccctgaccagccacccccccaacatccccttcaccagcgcccccaaggtgagcggcaagagaggcggcagcagaggcagccccagccaggagtgggtgatccacgccagccccgtgaagggcaccgtgagaagcggccacgtggccaagaagaagcccgaggagagcgcccccctgtgcagcgagaagaacagaatgggcaacaagaccgtgctgggctgggagagcagagccagcggccccggcgagggcctggtgagaggcaagctgagcaccaagtgcaagaaggtgcagaccgtgcagcccgtgcagaagcagctggtgagcagagtggagctgagcttcggcaacgcccaccacagagccgagtacagccaggacagccagagaggcacccccgccagacccgccagcgaggcctggaccaacatccccccccaccagaaggagagagaggagcacctgagattctaccaccagcagttccagcagccccccctgctgcagcagaagctgaagtaccagcccctgaagagaagcctgagacagtacagaccccccgagggccagctgaccaacgagaccccccccctgttccacagctacagcgagaaccacgacggcgcccaggtggaggagctggacgacagcgacttcagcgaggacagcttcagccacatcagcagccagagagccaccaagcagagaaacaccctggagaacagcgaggacagcttcttcctgcaccagacctggggccagggccccgagaagcaggtggccgagagacagcagagcctgttcagcagccccagaaccggcgacaagaaggacctgaccaagagctgggtggacagcagagaccccatcaaccacagaagagccgccctggaccacagctgcagccccagcaagggccccgtggactggagcagagagaacagcaccagcagcggccccagccccagagacagcctggccgagaagccctactgcagccaggtggacttcatctacagacaggagagaggcggcggcagcagcttcgacctgagaaaggacgccagccagagcgaggtgagcggcgagaacgagggcaacctgcccagccccgaggaggacggcttcaccatcagcctgagccacgtggccgtgcccggcagccccgaccagagagacaccgtgaccacccccctgagagaggtgagcgccgacggccccatccaggtgaccagcaccgtgaagaacggccacgccgtgcccggcgaggaccccagaggccagctgggcacccacgccgagtacgccagcggcctgatgagccccctgaccatgagcctgctggagaaccccgacaacgagggcagcccccccagcgagcagctggtgcaggacggcgccacccacagcctggtggccgagagcaccggcggccccgtggtgagccacaccgtgcccagcggcgaccaggaggccgccctgcccgtgagcagcgccaccagacacctgtggctgagcagcagcccccccgacaacaagcccggcggcgacctgcccgccctgggccccggcgagaagaccagctacaaggcctggctggccggcgtgtggttcgtgcacagaccccaccaggtggccctgcagcagtag

SEQ ID NO: 86262 - DNA, 999 bp, Artificial Sequence
  Description of Artificial Sequence: Synthetic coding sequence
atgacctggaccagcggccagctgcagagagagaagcaggccagacccggcagcggcgccgtgctggccttccccgacgacaaggacctgagagtgtacggccccgccgagagccagagcgccgtgttcggcgacgtgtgccccctgctgaccagcctgctggacggctacaacgtgtgcgtgatggcctacggccagaccggcagcggcaagagctacaccatgctgggcagacacagcgacgacggccccgtgctgcccctggacccccagagcgacctgggcatcatccccagagtggccgaggagctgttcagactgatcctggagaacaccagcagaagccccaaggtggaggtgagcatcgtggaggtgtacaacaacgacatcttcgacctgctggccaaggacagcatcgccgccgtgagcggcgtgaagagagaggtggtgaccgccaaggacggcagaaccgaggtggccctgctggccagcgaggccgtgggcagcgccagcaagctgatggagctggtgcacggcggcctgcagctgagagccaagcaccccaccctggtgcacgccgacagcagcagaagccacctgatcatcaccgtgaccctgaccaccgccagctgcagcgacagcaccgccgaccaggcctgcagcgccaccctgcccagagagcagaccgaggccggcagagccggcagaagcagaagagccagccagggcgccctggccccccagctggtgcccggcaaccccgccggccacgccgagcaggtgcaggccagactgcagctggtggacagcgccggcagcgagtgcgtgggcggcgacgccaagctgctggtgatcctgtgcatcagccccagccagagacacctggcccagaccctgcagggcctgggcttcggcatcagagccagacaggtgcagagaggccccgccagaaagaagccccccagcagccagaccgagggcaagagaagacccgactag

SEQ ID NO: 86263 - DNA, 1155 bp, Artificial Sequence
  Description of Artificial Sequence: Synthetic coding sequence
atgacctggaccagcggccagctgcagagagagaagcaggccagacccggcagcggcgccgtgctggccttccccgacgacaaggacctgagagtgtacggccccgccgagagccagagcgccgtgttcggcgacgtgtgccccctgctgaccagcctgctggacggctacaacgtgtgcgtgatggcctacggccagaccggcagcggcaagagctacaccatgctgggcagacacagcgacgacggccccgtgctgcccctggacccccagagcgacctgggcatcatccccagagtggccgaggagctgttcagactgatcctggagaacaccagcagaagccccaaggtggaggtgagcatcgtggaggtgtacaacaacgacatcttcgacctgctggccaaggacagcatcgccgccgtgagcggcgtgaagagagaggtggtgaccgccaaggacggcagaaccgaggtggccctgctggccagcgaggccgtgggcagcgccagcaagctgatggagctggtgcacggcggcctgcagctgagagccaagcaccccaccctggtgcacgccgacagcagcagaagccacctgatcatcaccgtgaccctgaccaccgccagctgcagcgacagcaccgccgaccaggcctgcagcgccaccctgcccagagagcagaccgaggccggcagagccggcagaagcagaagagccagccagggcgccctggccccccagctggtgcccggcaaccccgccggccacgccgagcaggtgcaggccagactgcagctggtggacagcgccggcagcgagtgcgtgggcgtgagcggcgtgaccggcctggccctgagagagatggcctgcatcagcagaagcctggccgccctggccggcgtgctgggcgccctgctggagcacagaggccacgccccctacagaaacagcagactgacccacctgctgcaggactgcctgggcggcgacgccaagctgctggtgatcctgtgcatcagccccagccagagacacctggcccagaccctgcagggcctgggcttcggcatcagagccagacaggtgcagagaggccccgccagaaagaagccccccagcagccagaccgagggcaagagaagacccgactag

SEQ ID NO: 86264 - DNA, 1155 bp, Artificial Sequence; identical to SEQ ID NO: 86263
  Description of Artificial Sequence: Synthetic coding sequence

SEQ ID NO: 86265 - DNA, 5649 bp, Artificial Sequence
  Description of Artificial Sequence: Synthetic coding sequence
atggtgggcagaggcgtgcccctgtgcgccgcccagcccgccgtggccgagggcggccccgccagagagcccccccccctgctggaggtgagccccagaaagagactgcccgccggccccgaccaggacccctgcggcagcagacccgcccccgagggcgccggcgccggccccgagcagggccacagcgccggcggcggcggctggtgcagacactgccacaccaagctggtggagctgaagagacaggcctggaagctggtgagcggccccggcaccaccctgagagacccctgcctgagcgccctgctgctggacaagctgcccgcccccggcgccctgcccgcctgcagacccgaggccgagagaagatgcgacgtgtgcgccacccacctgcagcagctgaccagagaggccatgcacctgctgcaggcccccgccagccacgaggacctggacgccccccacggcggccccagcctggccccccccagcaccaccaccagcagcagagacacccccggccccgccggccccgccggcagacagcccggcagagccggccccgacagaaccaagggcctggcctggagccccggccccagcgtgcaggtgagcgtggcccccgccggcctgggcggcgccctgagcaccgtgaccatccaggcccagcagtgcctggagggcatgtggagcgtgagcagagtgaacagcttcctgccccccgcctgcctggccgaggccgccgtggccgccgtggccgtggccgacaccgtgagagagtgcccccccgtggccggccccgacggcctgagcaaggcctggggcagaggcggcgtgtgcaccagcgccctggtgacccccacccccggcagcgtgggcggcagcaccggccccagcgccgccgccagcttcttcatcagagccatgcagaagctgagcctggccagcaagagaaagaagccccaccccccccccccccccgccaccagaggcaccagcacctaccccaccgacttcagcggcgtgctgcagctgtggcccccccccgcccccccctgcctgctgagagccgccagcaagaccaaggacaaccccggcagcatcggcaaggtgaaggtgatgctgagaatctggcccgcccagggcgcccagagaagcgccgaggccatgagcttcctgaaggtggaccccagaaagaagcaggtgatcctgtacgaccccgccgccggcccccccggcagcgccggccccagaagagccgccaccgccgccgtgcccaagatgttcgccttcgacgccgtgttcccccaggacagcgagcaggccgaggtgtgcagcggcaccgtggccgacgtgctgcagagcgtggtgagcggcgccgacggctgcatcttcagcttcggccacatgagcctgggcaagagctacaccatgatcggcaaggacagcagcccccagagcctgggcatcgtgccctgcgccatcagctggctgttcagactgatcgaggagagaagagagagaaccggcaccagattcagcgtgagagtgagcgccgtggaggtgtgcggcagagaccagagcctgagagacctgctggccgaggtggcccccggcagcctgcaggacacccagagccccggcgtgtacctgagagaggaccccgtgtgcggcgcccagctgcagaaccagagcgagctgagagcccccaccgccgagaaggccgccttctacctggacgccgccctggccgccagaagcaccagcagagccggctgcggcgaggacgccagaagaagcagccacatgctgttcaccctgcacgtgtaccagtacagaatggagaagtgcggcagaggcggcatgagcggcggcagaagcagactgcacctgatcgacctgggcagctgcgaggccgccgccggcagagccggcgaggccgccggcggccccctgtgcctgagcctgagcgccctgggcagcgtgatcctggccctggtgaacggcgccaagcacgtgccctacagagaccacagactgaccatgctgctgagagagagcctggccaccgccggctgcagaaccaccatgatcgcccacgtgagcgacgcccccgcccagcacgccgagaccctgagcaccgtgcagctggccgccagaatccacagactgagaagaaagaaggccaagtacgccagcagcagcagcggcggcgagagcagctgcgaggagggcagagccagaagacccccccacctgagacccttccaccccagaaccgtggccctggaccccgacagaacccccccctgcctgcccggcgaccccgactacagcagcagcagcgagcagagctgcgacaccgtgatctacgtgggccccggcggcgccgccctgagcgacagagagctgaccgacaacgagggcccccccgacttcgtgcccatcatccccgccctgagcagacacagacccagcaagggccccagagacgccgaccacttcagatgcagcaccttcgccgagctgcaggagagactggagtgcatggacggcaacgagggccccagcggcggccccggcggcaccgacggcgcccaggccagccccgccagaggcggcagaaagcccagcccccccgaggccgccagccccagaaaggccgtgggcacccccatggccgccagcacccccagaggcagcagcggccccgacacccaccagggcacccccgagccctgcaaggccatcgtgtggggcgaccagagagaggacagcagcgcctggcccgagctgctggtgcccgagaaggccgccgtgagcggcggcagaagacccctgcccagccccgcccccccccccccccagctgctggaggcctgcagagcccccgaggagcccggcggcggcggcaccgacggcgtggccagaaccccccccgtgggcatgagcggccaggtggccggcagccccatgctgcccggcgccacctgccccagactggccgccggcagcagatgccccgagagaggcctgctgaccaccaccgtgaccctgcagagacccgtggagctgaacggcgaggacgagctggtgttcaccgtggtggaggagctgagcctgggcgccctggccggcgccggcagacccaccagcctggccagcttcgacagcgactgcagcctgagagccctggccagcggcagcagacccgtgagcatcatcagcagcatcaacgacgagttcgacgcctacaccagccaggcccccgagggcggccccctggagggcgccgcctgggccggcagcagccacggcagcagcatcagcagctggctgagcgaggtgagcgtgtgcaccgccgacagcagagaccccaccccccagcccagattcagccccgacagcctggccggcctggaccccggcggcccccccgccctggacggcagcctgggcgacggcagcagcggcttcctgggccccgacagacccgacagccccggccccacctggggcccctgccccggcgaggtggccgccgtggcccccagcagacccggcagagagccccaggccggccccagcagatgggccagcgccgcccagaccatccacagcagcctgcccagaaagcccagaaccgccagcgccaccaccagagtgggctgcgccagactgggccagagcccccccggcagaggcggcctgttcgaggacccctggctgctgagagtgggcgagtgcgacacccaggccgccagcgccggcagagcccccagccccaccctgggcagccccagactgcccgaggcccaggtgatgctggcctgcgcccagagagtggtggacggctgcgaggtggccgccagagccgccagaagacccgaggccgtggccagaatcccccccctgagaagaggcgccaccaccctgggcgtgaccacccccgccgtgagctggggcgacgcccccaccgaggtggtggcctgcagcggcagcctgaaggccagccccaccagcaagaagggcctggcccccaaggccggcttcctgcccagacccagcggcgccgccccccccgccccccccaccagaaagagcagcctggagcagagaagcagccccgccagcgcccccccccacgccgtgaaccccgccagagtgggcgccgccgccgtgctgagaggcgaggaggagcccagacccagcagcagagccgaccacagcgtgcccagagccaccagcagcctgaaggccagagccagcaaggtggaggccgcccacagactggccggccacgccagcctggagagatacgagggcctggcccacagcagcagcaagggcagagaggcccccggcagaccccccagagccgtgcccaagctgggcgtgccccccagcagccccacccacggccccgcccccgcctgcagaagcggcgccgccaaggccgtgggcgcccccaagccccccgtgggcggcggcaagggcagaggcctggtggccggcggcagcagagccctgggccccagcgtgaagctgagcaccgccagcgtgaccggcagaagccccggcggccccgtggccggccccagagccgcccccagagccggccccagcgtgggcgccaaggccggcagaggcaccgtgatgggcaccaagcaggccctgagagccgcccacagcagagtgcacgagctgagcgccagcggcgcccccggcagaggcggcagcagctggggcagcgccgacagcgacagcggccacgacagcggcgtgaacgtgggcgaggagagaccccccaccggccccgccctgcccagcccctacagcaaggtgaccgcccccagaagaccccagagatacagcagcggccacggcagcgacaacagcagcgtgctgagcggcgagctgccccccgccatgggcagaaccgccctgttccaccacagcggcggcagcagcggctacgagagcctgagaagagacagcgaggccaccggcagcgccagcagcgcccccgacagcatgagcgagagcggcgccgccagccccggcgccagaaccagaagcctgaagagccccaagaagagagccaccggcctgcagagaagaagactgatccccgcccccctgcccgacaccaccgccctgggcagaaagcccagcctgcccggccagtgggtggacctgcccccccccctggccggcagcctgaaggagcccttcgagatcaaggtgtacgagatcgacgacgtggagagactgcagagacccagacccacccccagagaggcccccacccagggcctggcctgcgtgagcaccagactgagactggccgagagaagacagcagagactgagagaggtgcaggccaagcacaagcacctgtgcgaggagctggccgagacccagggcagactgatgctggagcccggcagatggctggagcagttcgaggtggaccccgagctggagcccgagagcgccgagtacctggccgccctggagagagccaccgccgccctggagcagtgcgtgaacctgtgcaaggcccacgtgatgatggtgacctgcttcgacatcagcgtggccgccagcgccgccatccccggcccccaggaggtggacgtgtag

SEQ ID NO: 86266 - DNA, 5184 bp, Artificial Sequence
  Description of Artificial Sequence: Synthetic coding sequence
atgatgatggactggaaggccgtggccgcccagaagctgaacctgagcagcaagaagaagaagcacagacccagcaccagcagcgccgccgagccccccctgttcgccaccagcttcagcggcatcctgcagaccagccccccccccgcccccccctgcctgctgagagccgtgaacaaggtgaaggacacccccggcctgggcaaggtgaaggtgatgctgagaatctgcagcaccctggccagagacaccagcgagagcagcagcttcctgaaggtggaccccagaaagaagcagatcaccctgtacgaccccctgacctgcggcggccagaacgccttccagaagagaggcaaccaggtgccccccaagatgttcgccttcgacgccgtgttcccccaggacgccagccaggccgaggtgtgcgccggcaccgtggccgaggtgatccagagcgtggtgaacggcgccgacggctgcgtgttctgcttcggccacgccaagctgggcaagagctacaccatgatcggcaaggacgacagcatgcagaacctgggcatcatcccctgcgccatcagctggctgttcaagctgatcaacgagagaaaggagaagaccggcgccagattcagcgtgagagtgagcgccgtggaggtgtggggcaaggaggagaacctgagagacctgctgagcgaggtggccaccggcagcctgcaggacggccagagccccggcgtgtacctgtgcgaggaccccatctgcggcacccagctgcagaaccagagcgagctgagagcccccaccgccgagaaggccgccttcttcctggacgccgccatcgccagcagaagaagccaccagcaggactgcgacgaggacgaccacagaaacagccacgtgttcttcaccctgcacatctaccagtacagaatggagaagagcggcaagggcggcatgagcggcggcagaagcagactgcacctgatcgacctgggcagctgcgtgaaggccctgagcaagaacagagagggcggcagcggcctgtgcctgagcctgagcgccctgggcaacgtgatcctggccctggtgaacggcagcaagcacatcccctacaaggagagcaagctggccatgctgctgagagagagcctgggcaacatgaactgcagaaccaccatgatcgcccacatcagcgccgccgtgggcagctacgccgagaccctgagcaccatccagatcgccagcagagtgctgagaatgaagaagaagaagaccaagtacaccagcagcagcagcggcggcgagagcagctgcgaggagggcagaatgagaagacccacccagctgagacccttccacaccagagccaccgtggaccccgacttccccatcgcccacctgagcagcgaccccgactacagcagcagcagcgagcagagctgcgacaccgtgatctacatcggccccaacggcaccgccctgagcgacaaggagctgaccgacaacgagggcccccccgacttcgtgcccatcgtgcccgccctgcagaagaccagaggcgacagcagacccgccgaggccggcgaggccgccgccggcaagagcgagagagactgcctgaagtgcaacaccttcgccgagctgcaggagagactggactgcatcgacggcagcgaggagcccagcagcttccccttcgaggagctgcccgcccagttcggccccgagcaggccagcagaggccccagactgagccaggccgccggcgccagccccctgagcgagagcgacaaggaggacaacggcagcgagggccagctgaccaacagagagggccccgagctgcccgccagcaagatgcagagaagccacagccccgtgcccgccgccgcccccgcccacagccccagccccgccagccccagaagcgtgcccggcagcagcagccagcacagcgccagccccctggtgcagagccccagcctgcagagcagcagagagagcctgaacagctgcggcttcgtggagggcaagcccagacccatgggcagccccagactgggcatcgccagcctgagcaagaccagcgagtacaagccccccagcagccccagccagagatgcaaggtgtacacccagaagggcgtgctgcccagccccgcccccctgccccccagcagcaaggacagcggcgtggccagcagagagagcctgctgcagcccgaggtgagaaccccccccgtgggcatgagcccccaggtgctgaagaagagcatgagcgccggcagcgagggcttccccgagacccccgtggacgacgagcagcaggccgccacccccagcgagagcaagaaggagatcctgagcaccaccatggtgaccgtgcagcagcccctggagctgaacggcgaggacgagctggtgttcaccctggtggaggagctgaccatcagcggcgtgctggacagcggcagacccaccagcatcatcagcttcaacagcgactgcagcgccagagccctggccagcggcagcagacccgtgagcatcatcagcagcatcagcgaggacctggagtgctacagcagcaccgcccccgtgagcgaggtgagcatcacccagttcctgcccctgcccaagatgagcctggacgagaaggcccaggacgccggcagcagaagaagcagcatcagcagctggctgagcgagatgagcgccggcagcgagggcgagcagagctgccacagcttcatcgcccagacctgcttcggccacggcgaggccatggccgagcccgtggccagcgagttcgtgagcagcctgcagaacaccgccgtggtgtgcagagagaagcccaaggccagccccgacaacctgctgatcctgagcgagatgggcgacgacagcttcaacaaggccgcccccatcaagggctgcaagatcagcaccgtgagcaaggccatggtgaccatcagcaacaccgccaacctgagcagctgcgagggctacatccccatgaagaccaacatcaccgtgtacccctgcatcgccatgagccccagaaacatccaggagcccgaggcccccaccgccacccccaaggccggccccaccctggcccagagcagagagagcaaggagaacagcgccaagaaggagatgaagttcgaggacccctggctgaagagagaggaggaggtgaagaaggagaccgcccaccccaacgaggagggcatgatgagatgcgagaccgccaccggccccagcaacgccgagaccagagccgagcaggagcaggacggcaagcccagccccggcgacagactgagcagcagcagcggcgaggtgagcgccagccccgtgaccgacaacttcagaagagtggtggacggctgcgagatggccctgcccggcctggccacccagagccccgtgcaccccaacaagagcgtgaagagcagcagcctgcccagagccttccagaaggccagcagacaggaggagcccgacagcctgagctactactgcgccgccgagaccaacggcgtgggcgccgccagcggcaccccccccagcaaggccaccctggagggcaaggtggccagccccaagcactgcgtgctggccagacccaagggcaccccccccctgccccccgtgagaaagagcagcctggaccagaagaacagagccagcccccagcacagcgccagcggcagcggcaccagcagccccctgaaccagcccgccgccttccccgccggcctgcccgacgagcccagcggcaagaccaaggacgccagcagcagcagcaagctgttcagcgccaagctggagcagctggccagcagaagcaacagcctgggcagagccaccgtgagccactacgagtgcctgagcctggagagagccgagagcctgagcagcgtgagcagcagactgcacgccggcaaggacggcaccatgcccagagccggcagaagcctgggcagaagcgccggcaccagcccccccagcagcggcgccagccccaaggccggccagagcaagatcagcgccgtgagcagactgctgctggccagccccagagccagaggccccagcgccagcaccaccaagaccctgagcttcagcaccaagagcctgccccaggccgtgggccagggcagcagcagcccccccggcggcaagcacaccccctggagcacccagagcctgagcagaaacagaagcagcggcctggccagcaagctgcccctgagagccgtgagcggcagaatcagcgagctgctgcagggcggcgccggcgccagaggcctgcagctgagagccggccccgaggccgaggccagaggcggcgccctggccgaggacgagcccgccgccgcccacctgctgcccagcccctacagcaagatcaccccccccagaagaccccacagatgcagcagcggccacggcagcgacaacagcagcgtgctgagcggcgagctgccccccgccatgggcaagaccgccctgttctaccacagcggcggcagcagcggctacgagagcgtgatgagagacagcgaggccaccggcagcgccagcagcgcccaggacagcaccagcgagaacagcagcagcgtgggcggcagatgcagaagcctgaagacccccaagaagagaagcaaccccggcagccagagaagaagactgatccccgccctgagcctggacaccagcagccccgtgagaaagccccccaacagcaccggcgtgagatgggtggacggccccctgagaagcagccccagaggcctgggcgagcccttcgagatcaaggtgtacgagatcgacgacgtggagagactgcagagaagaagaggcggcgccagcaaggaggccatgtgcttcaacgccaagctgaagatcctggagcacagacagcagagaatcgccgaggtgagagccaagtacgagtggctgatgaaggagctggaggccaccaagcagtacctgatgctggaccccaacaagtggctgagcgagttcgacctggagcaggtgtgggagctggacagcctggagtacctggaggccctggagtgcgtgaccgagagactggagagcagagtgaacttctgcaaggcccacctgatgatgatcacctgcttcgacatcaccagcagaagaagatag

SEQ ID NO: 86267 - DNA, 6327 bp, Artificial Sequence
  Description of Artificial Sequence: Synthetic coding sequence
atgaacagcgtggccggcaacaaggagagactggccgtgagcaccagaggcaagaagtacggcgtgaacgaggtgtgcagccccaccaagcccgccgcccccttcagccccgagagctggtacagaaaggcctacgaggagagcagagccggcagcagacccacccccgagggcgccggcagcgccctgggcagcagcggcacccccagccccggcagcggcaccagcagccccagcagcttcaccggcagccccggccccgccagccccggcatcggcaccagcagccccggcagcctgggcggcagccccggcttcggcaccggcagccccggcagcggcagcggcggcggcagcagccccggcagcgacagaggcgtgtggtgcgagaactgcaacgccagactggtggagctgaagagacaggccctgagactgctgctgcccggccccttccccggcaaggaccccgccttcagcgccgtgatccacgacaagctgcaggtgcccaacaccatcagaaaggcctggaacgacagagacaacagatgcgacatctgcgccacccacctgaaccagctgaagcaggaggccatccagatggtgctgaccctggagcaggccgccggcagcgagcactacgacgccagcccctgcagccccccccccctgagcaacatccccaccctggtgggcagcagacacgtgggcggcctgcagcagcccagagactgggccttcgtgcccgccccctgcgccaccagcaactacaccggcttcgccaacaagcacggcagcaagcccagcagcctgggcgtgagcaacggcgccgagaagaagagcggcagccccacccaccaggccaaggtgagcctgcagatggccaccagccccagcaacggcaacatcctgaacagcgtggccatccaggcccaccagtacctggacggcacctggagcctgagcagaaccaacggcgtgaccctgtacccctaccagatcagccagctgatgaccgagagcagcagagagggcctgaccgaggccgtgctgaacagatacaacgccgacaagcccagcgcctgcagcgtgcccgccagccagggcagctgcgtggccagcgagaccagcaccggcaccagcgtggccgccagcttcttcgccagagccgcccagaagctgaacctgagcagcaagaagaagaagcacagacccagcaccagcagcgccgccgagccccccctgttcgccaccagcttcagcggcatcctgcagaccagccccccccccgcccccccctgcctgctgagagccgtgaacaaggtgaaggacacccccggcctgggcaaggtgaaggtgatgctgagaatctgcagcaccctggccagagacaccagcgagagcagcagcttcctgaaggtggaccccagaaagaagcagatcaccctgtacgaccccctgacctgcggcggccagaacgccttccagaagagaggcaaccaggtgccccccaagatgttcgccttcgacgccgtgttcccccaggacgccagccaggccgaggtgtgcgccggcaccgtggccgaggtgatccagagcgtggtgaacggcgccgacggctgcgtgttctgcttcggccacgccaagctgggcaagagctacaccatgatcggcaaggacgacagcatgcagaacctgggcatcatcccctgcgccatcagctggctgttcaagctgatcaacgagagaaaggagaagaccggcgccagattcagcgtgagagtgagcgccgtggaggtgtggggcaaggaggagaacctgagagacctgctgagcgaggtggccaccggcagcctgcaggacggccagagccccggcgtgtacctgtgcgaggaccccatctgcggcacccagctgcagaaccagagcgagctgagagcccccaccgccgagaaggccgccttcttcctggacgccgccatcgccagcagaagaagccaccagcaggactgcgacgaggacgaccacagaaacagccacgtgttcttcaccctgcacatctaccagtacagaatggagaagagcggcaagggcggcatgagcggcggcagaagcagactgcacctgatcgacctgggcagctgcgtgaaggccctgagcaagaacagagagggcggcagcggcctgtgcctgagcctgagcgccctgggcaacgtgatcctggccctggtgaacggcagcaagcacatcccctacaaggagagcaagctggccatgctgctgagagagagcctgggcaacatgaactgcagaaccaccatgatcgcccacatcagcgccgccgtgggcagctacgccgagaccctgagcaccatccagatcgccagcagagtgctgagaatgaagaagaagaagaccaagtacaccagcagcagcagcggcggcgagagcagctgcgaggagggcagaatgagaagacccacccagctgagacccttccacaccagagccaccgtggaccccgacttccccatcgcccacctgagcagcgaccccgactacagcagcagcagcgagcagagctgcgacaccgtgatctacatcggccccaacggcaccgccctgagcgacaaggagctgaccgacaacgagggcccccccgacttcgtgcccatcgtgcccgccctgcagaagaccagaggcgacagcagacccgccgaggccggcgaggccgccgccggcaagagcgagagagactgcctgaagtgcaacaccttcgccgagctgcaggagagactggactgcatcgacggcagcgaggagcccagcagcttccccttcgaggagctgcccgcccagttcggccccgagcaggccagcagaggccccagactgagccaggccgccggcgccagccccctgagcgagagcgacaaggaggacaacggcagcgagggccagctgaccaacagagagggccccgagctgcccgccagcaagatgcagagaagccacagccccgtgcccgccgccgcccccgcccacagccccagccccgccagccccagaagcgtgcccggcagcagcagccagcacagcgccagccccctggtgcagagccccagcctgcagagcagcagagagagcctgaacagctgcggcttcgtggagggcaagcccagacccatgggcagccccagactgggcatcgccagcctgagcaagaccagcgagtacaagccccccagcagccccagccagagatgcaaggtgtacacccagaagggcgtgctgcccagccccgcccccctgccccccagcagcaaggacagcggcgtggccagcagagagagcctgctgcagcccgaggtgagaaccccccccgtgggcatgagcccccaggtgctgaagaagagcatgagcgccggcagcgagggcttccccgagacccccgtggacgacgagcagcaggccgccacccccagcgagagcaagaaggagatcctgagcaccaccatggtgaccgtgcagcagcccctggagctgaacggcgaggacgagctggtgttcaccctggtggaggagctgaccatcagcggcgtgctggacagcggcagacccaccagcatcatcagcttcaacagcgactgcagcgccagagccctggccagcggcagcagacccgtgagcatcatcagcagcatcagcgaggacctggagtgctacagcagcaccgcccccgtgagcgaggtgagcatcacccagttcctgcccctgcccaagatgagcctggacgagaaggcccaggacgccggcagcagaagaagcagcatcagcagctggctgagcgagatgagcgccggcagcgagggcgagcagagctgccacagcttcatcgcccagacctgcttcggccacggcgaggccatggccgagcccgtggccagcgagttcgtgagcagcctgcagaacaccgccgtggtgtgcagagagaagcccaaggccagccccgacaacctgctgatcctgagcgagatgggcgacgacagcttcaacaaggccgcccccatcaagggctgcaagatcagcaccgtgagcaaggccatggtgaccatcagcaacaccgccaacctgagcagctgcgagggctacatccccatgaagaccaacatcaccgtgtacccctgcatcgccatgagccccagaaacatccaggagcccgaggcccccaccgccacccccaaggccggccccaccctggcccagagcagagagagcaaggagaacagcgccaagaaggagatgaagttcgaggacccctggctgaagagagaggaggaggtgaagaaggagaccgcccaccccaacgaggagggcatgatgagatgcgagaccgccaccggccccagcaacgccgagaccagagccgagcaggagcaggacggcaagcccagccccggcgacagactgagcagcagcagcggcgaggtgagcgccagccccgtgaccgacaacttcagaagagtggtggacggctgcgagatggccctgcccggcctggccacccagagccccgtgcaccccaacaagagcgtgaagagcagcagcctgcccagagccttccagaaggccagcagacaggaggagcccgacagcctgagctactactgcgccgccgagaccaacggcgtgggcgccgccagcggcaccccccccagcaaggccaccctggagggcaaggtggccagccccaagcactgcgtgctggccagacccaagggcaccccccccctgccccccgtgagaaagagcagcctggaccagaagaacagagccagcccccagcacagcgccagcggcagcggcaccagcagccccctgaaccagcccgccgccttccccgccggcctgcccgacgagcccagcggcaagaccaaggacgccagcagcagcagcaagctgttcagcgccaagctggagcagctggccagcagaagcaacagcctgggcagagccaccgtgagccactacgagtgcctgagcctggagagagccgagagcctgagcagcgtgagcagcagactgcacgccggcaaggacggcaccatgcccagagccggcagaagcctgggcagaagcgccggcaccagcccccccagcagcggcgccagccccaaggccggccagagcaagatcagcgccgtgagcagactgctgctggccagccccagagccagaggccccagcgccagcaccaccaagaccctgagcttcagcaccaagagcctgccccaggccgtgggccagggcagcagcagcccccccggcggcaagcacaccccctggagcacccagagcctgagcagaaacagaagcagcggcctggccagcaagctgcccctgagagccgtgagcggcagaatcagcgagctgctgcagggcggcgccggcgccagaggcctgcagctgagagccggccccgaggccgaggccagaggcggcgccctggccgaggacgagcccgccgccgcccacctgctgcccagcccctacagcaagatcaccccccccagaagaccccacagatgcagcagcggccacggcagcgacaacagcagcgtgctgagcggcgagctgccccccgccatgggcaagaccgccctgttctaccacagcggcggcagcagcggctacgagagcgtgatgagagacagcgaggccaccggcagcgccagcagcgcccaggacagcaccagcgagaacagcagcagcgtgggcggcagatgcagaagcctgaagacccccaagaagagaagcaaccccggcagccagagaagaagactgatccccgccctgagcctggacaccagcagccccgtgagaaagccccccaacagcaccggcgtgagatgggtggacggccccctgagaagcagccccagaggcctgggcgagcccttcgagatcaaggtgtacgagatcgacgacgtggagagactgcagagaagaagaggcggcgccagcaaggaggccatgtgcttcaacgccaagctgaagatcctggagcacagacagcagagaatcgccgaggtgagagccaagtacgagtggctgatgaaggagctggaggccaccaagcagtacctgatgctggaccccaacaagtggctgagcgagttcgacctggagcaggtgtgggagctggacagcctggagtacctggaggccctggagtgcgtgaccgagagactggagagcagagtgaacttctgcaaggcccacctgatgatgatcacctgcttcgacatcaccagcagaagaagatag

SEQ ID NO: 86268 - DNA, 5175 bp, Artificial Sequence
  Description of Artificial Sequence: Synthetic coding sequence
gactggaagaccaaggccgcccagaagctgaacctgagcagcaagaagaagaagcacagacccagcaccagcagcgccgccgagccccccctgttcgccaccagcttcagcggcatcctgcagaccagccccccccccgcccccccctgcctgctgagagccgtgaacaaggtgaaggacacccccggcctgggcaaggtgaaggtgatgctgagaatctgcagcaccctggccagagacaccagcgagagcagcagcttcctgaaggtggaccccagaaagaagcagatcaccctgtacgaccccctgacctgcggcggccagaacgccttccagaagagaggcaaccaggtgccccccaagatgttcgccttcgacgccgtgttcccccaggacgccagccaggccgaggtgtgcgccggcaccgtggccgaggtgatccagagcgtggtgaacggcgccgacggctgcgtgttctgcttcggccacgccaagctgggcaagagctacaccatgatcggcaaggacgacagcatgcagaacctgggcatcatcccctgcgccatcagctggctgttcaagctgatcaacgagagaaaggagaagaccggcgccagattcagcgtgagagtgagcgccgtggaggtgtggggcaaggaggagaacctgagagacctgctgagcgaggtggccaccggcagcctgcaggacggccagagccccggcgtgtacctgtgcgaggaccccatctgcggcacccagctgcagaaccagagcgagctgagagcccccaccgccgagaaggccgccttcttcctggacgccgccatcgccagcagaagaagccaccagcaggactgcgacgaggacgaccacagaaacagccacgtgttcttcaccctgcacatctaccagtacagaatggagaagagcggcaagggcggcatgagcggcggcagaagcagactgcacctgatcgacctgggcagctgcgtgaaggccctgagcaagaacagagagggcggcagcggcctgtgcctgagcctgagcgccctgggcaacgtgatcctggccctggtgaacggcagcaagcacatcccctacaaggagagcaagctggccatgctgctgagagagagcctgggcaacatgaactgcagaaccaccatgatcgcccacatcagcgccgccgtgggcagctacgccgagaccctgagcaccatccagatcgccagcagagtgctgagaatgaagaagaagaagaccaagtacaccagcagcagcagcggcggcgagagcagctgcgaggagggcagaatgagaagacccacccagctgagacccttccacaccagagccaccgtggaccccgacttccccatcgcccacctgagcagcgaccccgactacagcagcagcagcgagcagagctgcgacaccgtgatctacatcggccccaacggcaccgccctgagcgacaaggagctgaccgacaacgagggcccccccgacttcgtgcccatcgtgcccgccctgcagaagaccagaggcgacagcagacccgccgaggccggcgaggccgccgccggcaagagcgagagagactgcctgaagtgcaacaccttcgccgagctgcaggagagactggactgcatcgacggcagcgaggagcccagcagcttccccttcgaggagctgcccgcccagttcggccccgagcaggccagcagaggccccagactgagccaggccgccggcgccagccccctgagcgagagcgacaaggaggacaacggcagcgagggccagctgaccaacagagagggccccgagctgcccgccagcaagatgcagagaagccacagccccgtgcccgccgccgcccccgcccacagccccagccccgccagccccagaagcgtgcccggcagcagcagccagcacagcgccagccccctggtgcagagccccagcctgcagagcagcagagagagcctgaacagctgcggcttcgtggagggcaagcccagacccatgggcagccccagactgggcatcgccagcctgagcaagaccagcgagtacaagccccccagcagccccagccagagatgcaaggtgtacacccagaagggcgtgctgcccagccccgcccccctgccccccagcagcaaggacagcggcgtggccagcagagagagcctgctgcagcccgaggtgagaaccccccccgtgggcatgagcccccaggtgctgaagaagagcatgagcgccggcagcgagggcttccccgagacccccgtggacgacgagcagcaggccgccacccccagcgagagcaagaaggagatcctgagcaccaccatggtgaccgtgcagcagcccctggagctgaacggcgaggacgagctggtgttcaccctggtggaggagctgaccatcagcggcgtgctggacagcggcagacccaccagcatcatcagcttcaacagcgactgcagcgccagagccctggccagcggcagcagacccgtgagcatcatcagcagcatcagcgaggacctggagtgctacagcagcaccgcccccgtgagcgaggtgagcatcacccagttcctgcccctgcccaagatgagcctggacgagaaggcccaggacgccggcagcagaagaagcagcatcagcagctggctgagcgagatgagcgccggcagcgagggcgagcagagctgccacagcttcatcgcccagacctgcttcggccacggcgaggccatggccgagcccgtggccagcgagttcgtgagcagcctgcagaacaccgccgtggtgtgcagagagaagcccaaggccagccccgacaacctgctgatcctgagcgagatgggcgacgacagcttcaacaaggccgcccccatcaagggctgcaagatcagcaccgtgagcaaggccatggtgaccatcagcaacaccgccaacctgagcagctgcgagggctacatccccatgaagaccaacatcaccgtgtacccctgcatcgccatgagccccagaaacatccaggagcccgaggcccccaccgccacccccaaggccggccccaccctggcccagagcagagagagcaaggagaacagcgccaagaaggagatgaagttcgaggacccctggctgaagagagaggaggaggtgaagaaggagaccgcccaccccaacgaggagggcatgatgagatgcgagaccgccaccggccccagcaacgccgagaccagagccgagcaggagcaggacggcaagcccagccccggcgacagactgagcagcagcagcggcgaggtgagcgccagccccgtgaccgacaacttcagaagagtggtggacggctgcgagatggccctgcccggcctggccacccagagccccgtgcaccccaacaagagcgtgaagagcagcagcctgcccagagccttccagaaggccagcagacaggaggagcccgacagcctgagctactactgcgccgccgagaccaacggcgtgggcgccgccagcggcaccccccccagcaaggccaccctggagggcaaggtggccagccccaagcactgcgtgctggccagacccaagggcaccccccccctgccccccgtgagaaagagcagcctggaccagaagaacagagccagcccccagcacagcgccagcggcagcggcaccagcagccccctgaaccagcccgccgccttccccgccggcctgcccgacgagcccagcggcaagaccaaggacgccagcagcagcagcaagctgttcagcgccaagctggagcagctggccagcagaagcaacagcctgggcagagccaccgtgagccactacgagtgcctgagcctggagagagccgagagcctgagcagcgtgagcagcagactgcacgccggcaaggacggcaccatgcccagagccggcagaagcctgggcagaagcgccggcaccagcccccccagcagcggcgccagccccaaggccggccagagcaagatcagcgccgtgagcagactgctgctggccagccccagagccagaggccccagcgccagcaccaccaagaccctgagcttcagcaccaagagcctgccccaggccgtgggccagggcagcagcagcccccccggcggcaagcacaccccctggagcacccagagcctgagcagaaacagaagcagcggcctggccagcaagctgcccctgagagccgtgagcggcagaatcagcgagctgctgcagggcggcgccggcgccagaggcctgcagctgagagccggccccgaggccgaggccagaggcggcgccctggccgaggacgagcccgccgccgcccacctgctgcccagcccctacagcaagatcaccccccccagaagaccccacagatgcagcagcggccacggcagcgacaacagcagcgtgctgagcggcgagctgccccccgccatgggcaagaccgccctgttctaccacagcggcggcagcagcggctacgagagcgtgatgagagacagcgaggccaccggcagcgccagcagcgcccaggacagcaccagcgagaacagcagcagcgtgggcggcagatgcagaagcctgaagacccccaagaagagaagcaaccccggcagccagagaagaagactgatccccgccctgagcctggacaccagcagccccgtgagaaagccccccaacagcaccggcgtgagatgggtggacggccccctgagaagcagccccagaggcctgggcgagcccttcgagatcaaggtgtacgagatcgacgacgtggagagactgcagagaagaagaggcggcgccagcaaggaggccatgtgcttcaacgccaagctgaagatcctggagcacagacagcagagaatcgccgaggtgagagccaagtacgagtggctgatgaaggagctggaggccaccaagcagtacctgatgctggaccccaacaagtggctgagcgagttcgacctggagcaggtgtgggagctggacagcctggagtacctggaggccctggagtgcgtgaccgagagactggagagcagagtgaacttctgcaaggcccacctgatgatgatcacctgcttcgacatcaccagcagaagaagatag

SEQ ID NO: 86269 - DNA, 2016 bp, Artificial Sequence
  Description of Artificial Sequence: Synthetic coding sequence
atgatcgacttcgacgacgtggccgccatcaaccccgagctgctgcagctgctgcccctgcaccccaaggacaacctgcccctgcaggagaacgtgaccatccagaagcagaagagaagaagcgtgaacagcaagatccccgcccccaaggagagcctgagaagcagaagcaccagaatgagcaccgtgagcgagctgagaatcaccgcccaggagaacgacatggaggtggagctgcccgccgccgccaacagcagaaagcagttcagcgtgccccccgcccccaccagacccagctgccccgccgtggccgagatccccctgagaatggtgagcgaggagatggaggagcaggtgcacagcatcagaggcagcagcagcgccaaccccgtgaacagcgtgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgaaggtggacctgaccaagtacctggagaaccaggccttctgcttcgacttcgccttcgacgagaccgccagcaacgaggtggtgtacagattcaccgccagacccctggtgcagaccatcttcgagggcggcaaggccacctgcttcgcctacggccagaccggcagcggcaagacccacaccatgggcggcgacctgagcggcaaggcccagaacgccagcaagggcatctacgccatggccagcagagacgtgttcctgctgaagaaccagccctgctacagaaagctgggcctggaggtgtacgtgaccttcttcgagatctacaacggcaagctgttcgacctgctgaacaagaaggccaagctgagagtgctggaggacggcaagcagcaggtgcaggtggtgggcctgcaggagcacctggtgaacagcgccgacgacgtgatcaagatgatcgacatgggcagcgcctgcagaaccagcggccagaccttcgccaacagcaacagcagcagaagccacgcctgcttccagatcatcctgagagccaagggcagaatgcacggcaagttcagcctggtggacctggccggcaacgagagaggcgccgacaccagcagcgccgacagacagaccagaatggagggcgccgagatcaacaagagcctgctggccctgaaggagtgcatcagagccctgggccagaacaaggcccacacccccttcagagagagcaagctgacccaggtgctgagagacagcttcatcggcgagaacagcagaacctgcatgatcgccaccatcagccccggcatcagcagctgcgagtacaccctgaacaccctgagatacgccgacagagtgaaggagctgagcccccacagcggccccagcggcgagcagctgatccagatggagaccgaggagatggaggcctgcagcaacggcgccctgatccccggcaacctgagcaaggaggaggaggagctgagcagccagatgagcagcttcaacgaggccatgacccagatcagagagctggaggagaaggccatggaggagctgaaggagatcatccagcagggccccgactggctggagctgagcgagatgaccgagcagcccgactacgacctggagaccttcgtgaacaaggccgagagcgccctggcccagcaggccaagcacttcagcgccctgagagacgtgatcaaggccctgagactggccatgcagctggaggagcaggccagcagacagatcagcagcaagaagagaccccagtag

SEQ ID NO: 86270 - DNA, 2055 bp, Artificial Sequence
  Description of Artificial Sequence: Synthetic coding sequence
atggccatggacagcagcctgcaggccagactgttccccggcctggccatcaagatccagagaagcaacggcctgatccacagcgccaacgtgagaaccgtgaacctggagaagagctgcgtgagcgtggagtgggccgagggcggcgccaccaagggcaaggagatcgacttcgacgacgtggccgccatcaaccccgagctgctgcagctgctgcccctgcaccccaaggacaacctgcccctgcaggagaacgtgaccatccagaagcagaagagaagaagcgtgaacagcaagatccccgcccccaaggagagcctgagaagcagaagcaccagaatgagcaccgtgagcgagctgagaatcaccgcccaggagaacgacatggaggtggagctgcccgccgccgccaacagcagaaagcagttcagcgtgcccctgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgaaggtggacctgaccaagtacctggagaaccaggccttctgcttcgacttcgccttcgacgagaccgccagcaacgaggtggtgtacagattcaccgccagacccctggtgcagaccatcttcgagggcggcaaggccacctgcttcgcctacggccagaccggcagcggcaagacccacaccatgggcggcgacctgagcggcaaggcccagaacgccagcaagggcatctacgccatggccagcagagacgtgttcctgctgaagaaccagccctgctacagaaagctgggcctggaggtgtacgtgaccttcttcgagatctacaacggcaagctgttcgacctgctgaacaagaaggccaagctgagagtgctggaggacggcaagcagcaggtgcaggtggtgggcctgcaggagcacctggtgaacagcgccgacgacgtgatcaagatgatcgacatgggcagcgcctgcagaaccagcggccagaccttcgccaacagcaacagcagcagaagccacgcctgcttccagatcatcctgagagccaagggcagaatgcacggcaagttcagcctggtggacctggccggcaacgagagaggcgccgacaccagcagcgccgacagacagaccagaatggagggcgccgagatcaacaagagcctgctggccctgaaggagtgcatcagagccctgggccagaacaaggcccacacccccttcagagagagcaagctgacccaggtgctgagagacagcttcatcggcgagaacagcagaacctgcatgatcgccaccatcagccccggcatcagcagctgcgagtacaccctgaacaccctgagatacgccgacagagtgaaggagctgagcccccacagcggccccagcggcgagcagctgatccagatggagaccgaggagatggaggcctgcagcaacggcgccctgatccccggcaacctgagcaaggaggaggaggagctgagcagccagatgagcagcttcaacgaggccatgacccagatcagagagctggaggagaaggccatggaggagctgaaggagatcatccagcagggccccgactggctggagctgagcgagatgaccgagcagcccgactacgacctggagaccttcgtgaacaaggccgagagcgccctggcccagcaggccaagcacttcagcgccctgagagacgtgatcaaggccctgagactggccatgcagctggaggagcaggccagcagacagatcagcagcaagaagagaccccagtag

SEQ ID NO: 86271 - DNA, 1839 bp, Artificial Sequence
  Description of Artificial Sequence: Synthetic coding sequence
atgagcaccgtgagcgagctgagaatcaccgcccaggagaacgacatggaggtggagctgcccgccgccgccaacagcagaaagcagttcagcgtgccccccgcccccaccagacccagctgccccgccgtggccgagatccccctgagaatggtgagcgaggagatggaggagcaggtgcacagcatcagaggcagcagcagcgccaaccccgtgaacagcgtgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgaaggtggacctgaccaagtacctggagaaccaggccttctgcttcgacttcgccttcgacgagaccgccagcaacgaggtggtgtacagattcaccgccagacccctggtgcagaccatcttcgagggcggcaaggccacctgcttcgcctacggccagaccggcagcggcaagacccacaccatgggcggcgacctgagcggcaaggcccagaacgccagcaagggcatctacgccatggccagcagagacgtgttcctgctgaagaaccagccctgctacagaaagctgggcctggaggtgtacgtgaccttcttcgagatctacaacggcaagctgttcgacctgctgaacaagaaggccaagctgagagtgctggaggacggcaagcagcaggtgcaggtggtgggcctgcaggagcacctggtgaacagcgccgacgacgtgatcaagatgatcgacatgggcagcgcctgcagaaccagcggccagaccttcgccaacagcaacagcagcagaagccacgcctgcttccagatcatcctgagagccaagggcagaatgcacggcaagttcagcctggtggacctggccggcaacgagagaggcgccgacaccagcagcgccgacagacagaccagaatggagggcgccgagatcaacaagagcctgctggccctgaaggagtgcatcagagccctgggccagaacaaggcccacacccccttcagagagagcaagctgacccaggtgctgagagacagcttcatcggcgagaacagcagaacctgcatgatcgccaccatcagccccggcatcagcagctgcgagtacaccctgaacaccctgagatacgccgacagagtgaaggagctgagcccccacagcggccccagcggcgagcagctgatccagatggagaccgaggagatggaggcctgcagcaacggcgccctgatccccggcaacctgagcaaggaggaggaggagctgagcagccagatgagcagcttcaacgaggccatgacccagatcagagagctggaggagaaggccatggaggagctgaaggagatcatccagcagggccccgactggctggagctgagcgagatgaccgagcagcccgactacgacctggagaccttcgtgaacaaggccgagagcgccctggcccagcaggccaagcacttcagcgccctgagagacgtgatcaaggccctgagactggccatgcagctggaggagcaggccagcagacagatcagcagcaagaagagaccccagtag

SEQ ID NO: 86272 - DNA, 2178 bp, Artificial Sequence
  Description of Artificial Sequence: Synthetic coding sequence
atggccatggacagcagcctgcaggccagactgttccccggcctggccatcaagatccagagaagcaacggcctgatccacagcgccaacgtgagaaccgtgaacctggagaagagctgcgtgagcgtggagtgggccgagggcggcgccaccaagggcaaggagatcgacttcgacgacgtggccgccatcaaccccgagctgctgcagctgctgcccctgcaccccaaggacaacctgcccctgcaggagaacgtgaccatccagaagcagaagagaagaagcgtgaacagcaagatccccgcccccaaggagagcctgagaagcagaagcaccagaatgagcaccgtgagcgagctgagaatcaccgcccaggagaacgacatggaggtggagctgcccgccgccgccaacagcagaaagcagttcagcgtgccccccgcccccaccagacccagctgccccgccgtggccgagatccccctgagaatggtgagcgaggagatggaggagcaggtgcacagcatcagaggcagcagcagcgccaaccccgtgaacagcgtgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgaaggtggacctgaccaagtacctggagaaccaggccttctgcttcgacttcgccttcgacgagaccgccagcaacgaggtggtgtacagattcaccgccagacccctggtgcagaccatcttcgagggcggcaaggccacctgcttcgcctacggccagaccggcagcggcaagacccacaccatgggcggcgacctgagcggcaaggcccagaacgccagcaagggcatctacgccatggccagcagagacgtgttcctgctgaagaaccagccctgctacagaaagctgggcctggaggtgtacgtgaccttcttcgagatctacaacggcaagctgttcgacctgctgaacaagaaggccaagctgagagtgctggaggacggcaagcagcaggtgcaggtggtgggcctgcaggagcacctggtgaacagcgccgacgacgtgatcaagatgatcgacatgggcagcgcctgcagaaccagcggccagaccttcgccaacagcaacagcagcagaagccacgcctgcttccagatcatcctgagagccaagggcagaatgcacggcaagttcagcctggtggacctggccggcaacgagagaggcgccgacaccagcagcgccgacagacagaccagaatggagggcgccgagatcaacaagagcctgctggccctgaaggagtgcatcagagccctgggccagaacaaggcccacacccccttcagagagagcaagctgacccaggtgctgagagacagcttcatcggcgagaacagcagaacctgcatgatcgccaccatcagccccggcatcagcagctgcgagtacaccctgaacaccctgagatacgccgacagagtgaaggagctgagcccccacagcggccccagcggcgagcagctgatccagatggagaccgaggagatggaggcctgcagcaacggcgccctgatccccggcaacctgagcaaggaggaggaggagctgagcagccagatgagcagcttcaacgaggccatgacccagatcagagagctggaggagaaggccatggaggagctgaaggagatcatccagcagggccccgactggctggagctgagcgagatgaccgagcagcccgactacgacctggagaccttcgtgaacaaggccgagagcgccctggcccagcaggccaagcacttcagcgccctgagagacgtgatcaaggccctgagactggccatgcagctggaggagcaggccagcagacagatcagcagcaagaagagaccccagtag

SEQ ID NO: 86273 - DNA, 324 bp, Artificial Sequence
  Description of Artificial Sequence: Synthetic coding sequence
tgaaaggagtgcatcagagccctgggccagaacaaggcccacacccccttcagagagagcaagctgacccaggtgctgagagacagcttcatcggcgagaacagcagaacctgcatgatcgccaccatcagccccggcatcagcagctgcgagtacaccctgaacaccctgagatacgccgacagacagggctgccacagcatccccctggagccccaggccagcaagcccggcagatgccacatccccctgctgagcaaggaggaggaggagctgagcagccagatgagcagcttcaacgaggccatgacccagatcagatag

SEQ ID NO: 86274 - DNA, 1011 bp, Artificial Sequence
  Description of Artificial Sequence: Synthetic coding sequence
atggccatggacagcagcctgcaggccagactgttccccggcctggccatcaagatccagagaagcaacggcctgatccacagcgccaacgtgagaaccgtgaacctggagaagagctgcgtgagcgtggagtgggccgagggcggcgccaccaagggcaaggagatcgacttcgacgacgtggccgccatcaaccccgagctgctgcagctgctgcccctgcaccccaaggacaacctgcccctgcaggagaacgtgaccatccagaagcagaagagaagaagcgtgaacagcaagatccccgcccccaaggagagcctgagaagcagaagcaccagaatgagcaccgtgagcgagctgagaatcaccgcccaggagaacgacatggaggtggagctgcccgccgccgccaacagcagaaagcagttcagcgtgcccctgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgaaggtggacctgaccaagtacctggagaaccaggccttctgcttcgacttcgccttcgacgagaccgccagcaacgaggtggtgtacagattcaccgccagacccctggtgcagaccatcttcgagggcggcaaggccacctgcttcgcctacggccagaccggcagcggcaagacccacaccatgggcggcgacctgagcggcaaggcccagaacgccagcaagggcatctacgccatggcctag

SEQ ID NO: 86275 - DNA, 864 bp, Artificial Sequence
  Description of Artificial Sequence: Synthetic coding sequence
atggtgagaagcggcgtgcccagaagcagaggcctggtgagcggcctgatccacagcgccaacgtgagaaccgtgaacctggagaagagctgcgtgagcgtggagtgggccgagggcggcgccaccaagggcaaggagatcgacttcgacgacgtggccgccatcaaccccgagctgctgcagctgctgcccctgcaccccaaggacaacctgcccctgcaggagaacgtgaccatccagaagcagaagagaagaagcgtgaacagcaagatccccgcccccaaggagagcctgagaagcagaagcaccagaatgagcaccgtgagcgagctgagaatcaccgcccaggagaacgacatggaggtggagctgcccgccgccgccaacagcagaaagcagttcagcgtgccccccgcccccaccagacccagctgccccgccgtggccgagatccccctgagaatggtgagcgaggagatggaggagcaggtgcacagcatcagaggcagcagcagcgccaaccccgtgaacagcgtgagaagaaagagctgcctggtgaaggaggtggagaagatgaagaacaagagagaggagaagaaggcccagaacagcgagatgagaatgaagagagcccaggagtacgacagcagcttccccaactgggagttcgccagaatgatcaaggagttcagagccaccctggagtgccaccccctgaccatgaccgaccccatcgaggagcacagaatctgcgtgtgcgtgagaaagagacccctgaacaagcaggagctggccaagaaggagatcgacgtgatcagcatccccagcaagtgcctgctgctggtgcacgagcccaagctgtag

SEQ ID NO: 86276 - DNA, 2244 bp, Artificial Sequence
  Description of Artificial Sequence: Synthetic coding sequence
atgagcaagctgaagagcagcgagagcgtgagagtggtggtgagatgcagacccatgaacggcaaggagaaggccgccagctacgacaaggtggtggacgtggacgtgaagctgggccaggtgagcgtgaagaaccccaagggcaccgcccacgagatgcccaagaccttcaccttcgacgccgtgtacgactggaacgccaagcagttcgagctgtacgacgagaccttcagacccctggtggacagcgtgctgcagggcttcaacggcaccatcttcgcctacggccagaccggcaccggcaagacctacaccatggagggcatcagaggcgaccccgagaagagaggcgtgatccccaacagcttcgaccacatcttcacccacatcagcagaagccagaaccagcagtacctggtgagagccagctacctggagatctaccaggaggagatcagagacctgctgagcaaggaccagaccaagagactggagctgaaggagagacccgacaccggcgtgtacgtgaaggacctgagcagcttcgtgaccaagagcgtgaaggagatcgagcacgtgatgaacgtgggcaaccagaacagaagcgtgggcgccaccaacatgaacgagcacagcagcagaagccacgccatcttcgtgatcaccatcgagtgcagcgaggtgggcctggacggcgagaaccacatcagagtgggcaagctgaacctggtggacctggccggcagcgagagacaggccaagaccggcgcccagggcgagagactgaaggaggccaccaagatcaacctgagcctgagcgccctgggcaacgtgatcagcgccctggtggacggcaagagcacccacatcccctacagagacagcaagctgaccagactgctgcaggacagcctgggcggcaacgccaagaccgtgatggtggccaacgtgggccccgccagctacaacgtggaggagaccctgaccaccctgagatacgccaacagagccaagaacatcaagaacaagcccagagtgaacgaggaccccaaggacgccctgctgagagagttccaggaggagatcgccagactgaaggcccagctggagaagagaagcatcggcagaagaaagagaagagagaagagaagagagggcggcggcagcggcggcggcggcgaggaggaggaggaggagggcgaggagggcgaggaggagggcgacgacaaggacgactactggagagagcagcaggagaagctggagatcgagaagagagccatcgtggaggaccacagcctggtggccgaggagaagatgagactgctgaaggagaaggagaagaagatggaggacctgagaagagagaaggacgccgccgagatgctgggcgccaagatcaaggccatggagagcaagctgctggtgggcggcaagaacatcgtggaccacaccaacgagcagcagaagatcctggagcagaagagacaggagatcgccgagcagaagagaagagagagagagatccagcagcagatggagagcagagacgaggagaccctggagctgaaggagacctacagcagcctgcagcaggaggtggacatcaagaccaagaagctgaagaagctgttcagcaagctgcaggccgtgaaggccgagatccacgacctgcaggaggagcacatcaaggagagacaggagctggagcagacccagaacgagctgaccagagagctgaagctgaagcacctgatcatcgagaacttcatccccctggaggagaagagcaagatcatgaacagagccttcttcgacgaggaggaggaccactggaagctgcaccccatcaccagactggagaaccagcagatgatgaagagacccgtgagcgccgtgggctacaagagacccctgagccagcacgccagaatgagcatgatgatcagacccgaggccagatacagagccgagaacatcgtgctgctggagctggacatgcccagcagaaccaccagagactacgagggccccgccatcgcccccaaggtgcaggccgccctggacgccgccctgcaggacgaggacgagatccaggtggacgccagcagcttcgagagcaccgccaacaagaagagcaaggccagacccaagagcggcagaaagagcggcagcagcagcagcagcagcggcacccccgccagccagctgtacccccagagcagaggcctggtgcccaagtag

SEQ ID NO: 86277 - DNA, 1122 bp, Artificial Sequence
  Description of Artificial Sequence: Synthetic coding sequence
atggtggccaacgtgggccccgccagctacaacgtggaggagaccctgaccaccctgagatacgccaacagagccaagaacatcaagaacaagcccagagtgaacgaggaccccaaggacgccctgctgagagagttccaggaggagatcgccagactgaaggcccagctggagaagagaagcatcgaggagaagatgagactgctgaaggagaaggagaagaagatggaggacctgagaagagagaaggacgccgccgagatgctgggcgccaagatcaaggccatggagagcaagctgctggtgggcggcaagaacatcgtggaccacaccaacgagcagcagaagatcctggagcagaagagacaggagatcgccgagcagaagagaagagagagagagatccagcagcagatggagagcagagacgaggagaccctggagctgaaggagacctacagcagcctgcagcaggaggtggacatcaagaccaagaagctgaagaagctgttcagcaagctgcaggccgtgaaggccgagatccacgacctgcaggaggagcacatcaaggagagacaggagctggagcagacccagaacgagctgaccagagagctgaagctgaagcacctgatcatcgagaacttcatccccctggaggagaagagcaagatcatgaacagagccttcttcgacgaggaggaggaccactggaagctgcaccccatcaccagactggagaaccagcagatgatgaagagacccgtgagcgccgtgggctacaagagacccctgagccagcacgccagaatgagcatgatgatcagacccgaggccagatacagagccgagaacatcgtgctgctggagctggacatgcccagcagaaccaccagagactacgagggccccgccatcgcccccaaggtgcaggccgccctggacgccgccctgcaggacgaggacgagatccaggtggacgccagcagcttcgagagcaccgccaacaagaagagcaaggccagacccaagagcggcagaaagagcggcagcagcagcagcagcagcggcacccccgccagccagctgtacccccagagcagaggcctggtgcccaagtag

SEQ ID NO: 86278 - DNA, 2382 bp, Artificial Sequence
  Description of Artificial Sequence: Synthetic coding sequence
atggccagcaagaccaaggccagcgaggccctgaaggtggtggccagatgcagacccctgagcagaaaggaggaggccgccggccacgagcagatcctgaccatggacgtgaagctgggccaggtgaccctgagaaaccccagagccgcccccggcgagctgcccaagaccttcaccttcgacgccgtgtacgacgccagcagcaagcaggccgacctgtacgacgagaccgtgagacccctgatcgacagcgtgctgcagggcttcaacggcaccgtgttcgcctacggccagaccggcaccggcaagacctacaccatgcagggcacctgggtggagcccgagctgagaggcgtgatccccaacgccttcgagcacatcttcacccacatcagcagaagccagaaccagcagtacctggtgagagccagctacctggagatctaccaggaggagatcagagacctgctgagcaaggagcccggcaagagactggagctgaaggagaaccccgagaccggcgtgtacatcaaggacctgagcagcttcgtgaccaagaacgtgaaggagatcgagcacgtgatgaacctgggcaaccagaccagagccgtgggcagcacccacatgaacgaggtgagcagcagaagccacgccatcttcatcatcaccgtggagtgcagcgagagaggcagcgacggccaggaccacatcagagtgggcaagctgaacctggtggacctggccggcagcgagagacagaacaaggccggccccaacaccgccggcggcgccgccacccccagcagcggcggcggcggcggcggcggcggcagcggcggcggcgccggcggcgagagacccaaggaggccagcaagatcaacctgagcctgagcgccctgggcaacgtgatcgccgccctggccggcaacagaagcacccacatcccctacagagacagcaagctgaccagactgctgcaggacagcctgggcggcaacgccaagaccatcatggtggccaccctgggccccgccagccacagctacgacgagagcctgagcaccctgagattcgccaacagagccaagaacatcaagaacaagccccaggtgaacgaggaccccaaggacaccctgctgagagagttccaggaggagatcgccagactgaaggcccagctggagaagagaggcatgctgggcaagagacccagaagaaagagcagcagaagaaagaaggccgtgagcgccccccccggctaccccgagggccccgtgatcgaggcctgggtggccgaggaggaggacgacaacaacaacaaccacagacccccccagcccatcctggagagcgccctggagaagaacatggagaactacctgcaggagcagaaggagagactggaggaggagaaggccgccatccaggacgacagaagcctggtgagcgaggagaagcagaagctgctggaggagaaggagaagatgctggaggacctgagaagagagcagcaggccaccgagctgctggccgccaagtacaaggccatggagagcaagctgctgatcggcggcagaaacatcatggaccacaccaacgagcagcagaagatgctggagctgaagagacaggagatcgccgagcagaagagaagagagagagagatgcagcaggagatgatgctgagagacgaggagaccatggagctgagaggcacctacaccagcctgcagcaggaggtggaggtgaagaccaagaagctgaagaagctgtacgccaagctgcaggccgtgaaggccgagatccaggaccagcacgacgagtacatcagagtgagacaggacctggaggaggcccagaacgagcagaccagagagctgaagctgaagtacctgatcatcgagaacttcatcccccccgaggagaagaacaagatcatgaacagactgttcctggactgcgaggaggagcagtggaagttccagcccctggtgcccgccggcgtgagcagcagccagatgaagaagagacccaccagcgccgtgggctacaagagacccatcagccagtacgccagagtggccatggccatgggcagccaccccagatacagagccgagaacatcatgttcctggagctggacgtgagcccccccgccgtgttcgagatggagttcagccacgaccaggagcaggaccccagagccctgcacatggagagactgatgagactggacagcttcctggagagacccagcaccagcaaggtgagaaagagcagaagctggtgccagagcccccagagacccccccccagcaccacccacgccagcctggccagcgccagcctgagacccgccaccgtggccgaccacgagtag

SEQ ID NO: 86279 - DNA, 2382 bp, Artificial Sequence; identical to SEQ ID NO: 86278
  Description of Artificial Sequence: Synthetic coding sequence

SEQ ID NO: 86280 - DNA, 1800 bp, Artificial Sequence
  Description of Artificial Sequence: Synthetic coding sequence
atgaacctgggcaaccagaccagagccgtgggcagcacccacatgaacgaggtgagcagcagaagccacgccatcttcatcatcaccgtggagtgcagcgagagaggcagcgacggccaggaccacatcagagtgggcaagctgaacctggtggacctggccggcagcgagagacagaacaaggccggccccaacaccgccggcggcgccgccacccccagcagcggcggcggcggcggcggcggcggcagcggcggcggcgccggcggcgagagacccaaggaggccagcaagatcaacctgagcctgagcgccctgggcaacgtgatcgccgccctggccggcaacagaagcacccacatcccctacagagacagcaagctgaccagactgctgcaggacagcctgggcggcaacgccaagaccatcatggtggccaccctgggccccgccagccacagctacgacgagagcctgagcaccctgagattcgccaacagagccaagaacatcaagaacaagccccaggtgaacgaggaccccaaggacaccctgctgagagagttccaggaggagatcgccagactgaaggcccagctggagaagagaggcatgctgggcaagagacccagaagaaagagcagcagaagaaagaaggccgtgagcgccccccccggctaccccgagggccccgtgatcgaggcctgggtggccgaggaggaggacgacaacaacaacaaccacagacccccccagcccatcctggagagcgccctggagaagaacatggagaactacctgcaggagcagaaggagagactggaggaggagaaggccgccatccaggacgacagaagcctggtgagcgaggagaagcagaagctgctggaggagaaggagaagatgctggaggacctgagaagagagcagcaggccaccgagctgctggccgccaagtacaaggccatggagagcaagctgctgatcggcggcagaaacatcatggaccacaccaacgagcagcagaagatgctggagctgaagagacaggagatcgccgagcagaagagaagagagagagagatgcagcaggagatgatgctgagagacgaggagaccatggagctgagaggcacctacaccagcctgcagcaggaggtggaggtgaagaccaagaagctgaagaagctgtacgccaagctgcaggccgtgaaggccgagatccaggaccagcacgacgagtacatcagagtgagacaggacctggaggaggcccagaacgagcagaccagagagctgaagctgaagtacctgatcatcgagaacttcatcccccccgaggagaagaacaagatcatgaacagactgttcctggactgcgaggaggagcagtggaagttccagcccctggtgcccgccggcgtgagcagcagccagatgaagaagagacccaccagcgccgtgggctacaagagacccatcagccagtacgccagagtggccatggccatgggcagccaccccagatacagagccgagaacatcatgttcctggagctggacgtgagcccccccgccgtgttcgagatggagttcagccacgaccaggagcaggaccccagagccctgcacatggagagactgatgagactggacagcttcctggagagacccagcaccagcaaggtgagaaagagcagaagctggtgccagagcccccagagacccccccccagcaccacccacgccagcctggccagcgccagcctgagacccgccaccgtggccgaccacgagtag

SEQ ID NO: 86281 - DNA, 3384 bp, Artificial Sequence
  Description of Artificial Sequence: Synthetic coding sequence
atgaaggaggaggtgaagggcatccccgtgagagtggccctgagatgcagacccctggtgcccaaggagatcagcgagggctgccagatgtgcctgagcttcgtgcccggcgagccccaggtggtggtgggcaccgacaagagcttcacctacgacttcgtgttcgaccccagcaccgagcaggaggaggtgttcaacaccgccgtggcccccctgatcaagggcgtgttcaagggctacaacgccaccgtgctggcctacggccagaccggcagcggcaagacctacagcatgggcggcgcctacaccgccgagcaggagaacgagcccaccgtgggcgtgatccccagagtgatccagctgctgttcaaggagatcgacaagaagagcgacttcgagttcaccctgaaggtgagctacctggagatctacaacgaggagatcctggacctgctgtgccccagcagagagaaggcccagatcaacatcagagaggaccccaaggagggcatcaagatcgtgggcctgaccgagaagaccgtgctggtggccctggacaccgtgagctgcctggagcagggcaacaacagcagaaccgtggccagcaccgccatgaacagccagagcagcagaagccacgccatcttcaccatcagcctggagcagagaaagaagagcgacaagaacagcagcttcagaagcaagctgcacctggtggacctggccggcagcgagagacagaagaagaccaaggccgagggcgacagactgaaggagggcatcaacatcaacagaggcctgctgtgcctgggcaacgtgatcagcgccctgggcgacgacaagaagggcggcttcgtgccctacagagacagcaagctgaccagactgctgcaggacagcctgggcggcaacagccacaccctgatgatcgcctgcgtgagccccgccgacagcaacctggaggagaccctgaacaccctgagatacgccgacagagccagaaagatcaagaacaagcccatcgtgaacatcgacccccagaccgccgagctgaaccacctgaagcagcaggtgcagcagctgcaggtgctgctgctgcaggcccacggcggcaccctgcccggcagcatcaccgtggagcccagcgagaacctgcagagcctgatggagaagaaccagagcctggtggaggagaacgagaagctgagcagaggcctgagcgaggccgccggccagaccgcccagatgctggagagaatcatcctgaccgagcaggccaacgagaagatgaacgccaagctggaggagctgagacagcacgccgcctgcaagctggacctgcagaagctggtggagaccctggaggaccaggagctgaaggagaacgtggagatcatctgcaacctgcagcagctgatcacccagctgagcgacgagaccgtggcctgcatggccgccgccatcgacaccgccgtggagcaggaggcccaggtggagaccagccccgagaccagcagaagcagcgacgccttcaccacccagcacgccctgagacaggcccagatgagcaaggagctggtggagctgaacaaggccctggccctgaaggaggccctggccagaaagatgacccagaacgacagccagctgcagcccatccagtaccagtaccaggacaacatcaaggagctggagctggaggtgatcaacctgcagaaggagaaggaggagctggtgctggagctgcagaccgccaagaaggacgccaaccaggccaagctgagcgagagaagaagaaagagactgcaggagctggagggccagatcgccgacctgaagaagaagctgaacgagcagagcaagctgctgaagctgaaggagagcaccgagagaaccgtgagcaagctgaaccaggagatcagaatgatgaagaaccagagagtgcagctgatgagacagatgaaggaggacgccgagaagttcagacagtggaagcagaagaaggacaaggaggtgatccagctgaaggagagagacagaaagagacagtacgagctgctgaagctggagagaaacttccagaagcagagcaacgtgctgagaagaaagaccgaggaggccgccgccgccaacaagagactgaaggacgccctgcagaagcagagagaggtggccgacaagagaaaggagacccagagcagaggcatggagggcaccgccgccagagtgaagaactggctgggcaacgagatcgaggtgatggtgagcaccgaggaggccaagagacacctgaacgacctgctggaggacagaaagatcctggcccaggacgtggcccagctgaaggagaagaaggagagcggcgagaaccccccccccaagctgagaagaagaaccttcagcctgaccgaggtgagaggccaggtgagcgagagcgaggacagcatcaccaagcagatcgagagcctggagaccgagatggagttcagaagcgcccagatcgccgacctgcagcagaagctgctggacgccgagagcgaggacagacccaagcagagatgggagaacatcgccaccatcctggaggccaagtgcgccctgaagtacctgatcggcgagctggtgagcagcaagatccaggtgagcaagctggagagcagcctgaagcagagcaagaccagctgcgccgacatgcagaagatgctgttcgaggagagaaaccacttcgccgagatcgagaccgagctgcaggccgagctggtgagaatggagcagcagcaccaggagaaggtgctgtacctgctgagccagctgcagcagagccagatggccgagaagcagctggaggagagcgtgagcgagaaggagcagcagctgctgagcaccctgaagtgccaggacgaggagctggagaagatgagagaggtgtgcgagcagaaccagcagctgctgagagagaacgagatcatcaagcagaagctgaccctgctgcaggtggccagcagacagaagcacctgcccaaggacaccctgctgagccccgacagcagcttcgagtacgtgccccccaagcccaagcccagcagagtgaaggagaagttcctggagcagagcatggacatcgaggacctgaagtactgcagcgagcacagcgtgaacgagcacgaggacggcgacggcgacgacgacgagggcgacgacgaggagtggaagcccaccaagctggtgaaggtgagcagaaagaacatccagggcgtgctgctgctgacccccgtgatcagcgccctgtgggaggccgaggccagaggcctgctggaggccagaagcagcagacccgcctgggccacctggagagaccccgtgagcaccaagcccaagaactag

SEQ ID NO: 86282 - DNA, 3699 bp, Artificial Sequence
  Description of Artificial Sequence: Synthetic coding sequence
atgaaggaggaggtgaagggcatccccgtgagagtggccctgagatgcagacccctggtgcccaaggagatcagcgagggctgccagatgtgcctgagcttcgtgcccggcgagccccaggtggtggtgggcaccgacaagagcttcacctacgacttcgtgttcgaccccagcaccgagcaggaggaggtgttcaacaccgccgtggcccccctgatcaagggcgtgttcaagggctacaacgccaccgtgctggcctacggccagaccggcagcggcaagacctacagcatgggcggcgcctacaccgccgagcaggagaacgagcccaccgtgggcgtgatccccagagtgatccagctgctgttcaaggagatcgacaagaagagcgacttcgagttcaccctgaaggtgagctacctggagatctacaacgaggagatcctggacctgctgtgccccagcagagagaaggcccagatcaacatcagagaggaccccaaggagggcatcaagatcgtgggcctgaccgagaagaccgtgctggtggccctggacaccgtgagctgcctggagcagggcaacaacagcagaaccgtggccagcaccgccatgaacagccagagcagcagaagccacgccatcttcaccatcagcctggagcagagaaagaagagcgacaagaacagcagcttcagaagcaagctgcacctggtggacctggccggcagcgagagacagaagaagaccaaggccgagggcgacagactgaaggagggcatcaacatcaacagaggcctgctgtgcctgggcaacgtgatcagcgccctgggcgacgacaagaagggcggcttcgtgccctacagagacagcaagctgaccagactgctgcaggacagcctgggcggcaacagccacaccctgatgatcgcctgcgtgagccccgccgacagcaacctggaggagaccctgaacaccctgagatacgccgacagagccagaaagatcaagaacaagcccatcgtgaacatcgacccccagaccgccgagctgaaccacctgaagcagcaggtgcagcagctgcaggtgctgctgctgcaggcccacggcggcaccctgcccggcagcatcaccgtggagcccagcgagaacctgcagagcctgatggagaagaaccagagcctggtggaggagaacgagaagctgagcagaggcctgagcgaggccgccggccagaccgcccagatgctggagagaatcatcctgaccgagcaggccaacgagaagatgaacgccaagctggaggagctgagacagcacgccgcctgcaagctggacctgcagaagctggtggagaccctggaggaccaggagctgaaggagaacgtggagatcatctgcaacctgcagcagctgatcacccagctgagcgacgagaccgtggcctgcatggccgccgccatcgacaccgccgtggagcaggaggcccaggtggagaccagccccgagaccagcagaagcagcgacgccttcaccacccagcacgccctgagacaggcccagatgagcaaggagctggtggagctgaacaaggccctggccctgaaggaggccctggccagaaagatgacccagaacgacagccagctgcagcccatccagtaccagtaccaggacaacatcaaggagctggagctggaggtgatcaacctgcagaaggagaaggaggagctggtgctggagctgcagaccgccaagaaggacgccaaccaggccaagctgagcgagagaagaagaaagagactgcaggagctggagggccagatcgccgacctgaagaagaagctgaacgagcagagcaagctgctgaagctgaaggagagcaccgagagaaccgtgagcaagctgaaccaggagatcagaatgatgaagaaccagagagtgcagctgatgagacagatgaaggaggacgccgagaagttcagacagtggaagcagaagaaggacaaggaggtgatccagctgaaggagagagacagaaagagacagtacgagctgctgaagctggagagaaacttccagaagcagagcaacgtgctgagaagaaagaccgaggaggccgccgccgccaacaagagactgaaggacgccctgcagaagcagagagaggtggccgacaagagaaaggagacccagagcagaggcatggagggcaccgccgccagagtgaagaactggctgggcaacgagatcgaggtgatggtgagcaccgaggaggccaagagacacctgaacgacctgctggaggacagaaagatcctggcccaggacgtggcccagctgaaggagaagaaggagagcggcgagaaccccccccccaagctgagaagaagaaccttcagcctgaccgaggtgagaggccaggtgagcgagagcgaggacagcatcaccaagcagatcgagagcctggagaccgagatggagttcagaagcgcccagatcgccgacctgcagcagaagctgctggacgccgagagcgaggacagacccaagcagagatgggagaacatcgccaccatcctggaggccaagtgcgccctgaagtacctgatcggcgagctggtgagcagcaagatccaggtgagcaagctggagagcagcctgaagcagagcaagaccagctgcgccgacatgcagaagatgctgttcgaggagagaaaccacttcgccgagatcgagaccgagctgcaggccgagctggtgagaatggagcagcagcaccaggagaaggtgctgtacctgctgagccagctgcagcagagccagatggccgagaagcagctggaggagagcgtgagcgagaaggagcagcagctgctgagcaccctgaagtgccaggacgaggagctggagaagatgagagaggtgtgcgagcagaaccagcagctgctgagagagaacgagatcatcaagcagaagctgaccctgctgcaggtggccagcagacagaagcacctgcccaaggacaccctgctgagccccgacagcagcttcgagtacgtgccccccaagcccaagcccagcagagtgaaggagaagttcctggagcagagcatggacatcgaggacctgaagtactgcagcgagcacagcgtgaacgagcacgaggacggcgacggcgacgacgacgagggcgacgacgaggagtggaagcccaccaagctggtgaaggtgagcagaaagaacatccagggctgcagctgcaagggctggtgcggcaacaagcagtgcggctgcagaaagcagaagagcgactgcggcgtggactgctgctgcgaccccaccaagtgcagaaacagacagcagggcaaggacagcctgggcaccgtggagagaacccaggacagcgagggcagcttcaagctggaggaccccaccgaggtgacccccggcctgagcttcttcaaccccgtgtgcgccacccccaacagcaagatcctgaaggagatgtgcgacgtggagcaggtgctgagcaagaagaccccccccgcccccagccccttcgacctgcccgagctgaagcacgtggccaccgagtaccaggagaacaaggcccccggcaagaagaagaagagagccctggccagcaacaccagcttcttcagcggctgcagccccatcgaggaggaggcccactag

SEQ ID NO: 86283 - DNA, 1605 bp, Artificial Sequence
  Description of Artificial Sequence: Synthetic coding sequence
atgtgcagcgacgtgaagagagaggccgccgccgccaacaagagactgaaggacgccctgcagaagcagagagaggtggccgacaagagaaaggagacccagagcagaggcatggagggcaccgccgccagagtgaagaactggctgggcaacgagatcgaggtgatggtgagcaccgaggaggccaagagacacctgaacgacctgctggaggacagaaagatcctggcccaggacgtggcccagctgaaggagaagaaggagagcggcgagaaccccccccccaagctgagaagaagaaccttcagcctgaccgaggtgagaggccaggtgagcgagagcgaggacagcatcaccaagcagatcgagagcctggagaccgagatggagttcagaagcgcccagatcgccgacctgcagcagaagctgctggacgccgagagcgaggacagacccaagcagagatgggagaacatcgccaccatcctggaggccaagtgcgccctgaagtacctgatcggcgagctggtgagcagcaagatccaggtgagcaagctggagagcagcctgaagcagagcaagaccagctgcgccgacatgcagaagatgctgttcgaggagagaaaccacttcgccgagatcgagaccgagctgcaggccgagctggtgagaatggagcagcagcaccaggagaaggtgctgtacctgctgagccagctgcagcagagccagatggccgagaagcagctggaggagagcgtgagcgagaaggagcagcagctgctgagcaccctgaagtgccaggacgaggagctggagaagatgagagaggtgtgcgagcagaaccagcagctgctgagagagaacgagatcatcaagcagaagctgaccctgctgcaggtggccagcagacagaagcacctgcccaaggacaccctgctgagccccgacagcagcttcgagtacgtgccccccaagcccaagcccagcagagtgaaggagaagttcctggagcagagcatggacatcgaggacctgaagtactgcagcgagcacagcgtgaacgagcacgaggacggcgacggcgacgacgacgagggcgacgacgaggagtggaagcccaccaagctggtgaaggtgagcagaaagaacatccagggctgcagctgcaagggctggtgcggcaacaagcagtgcggctgcagaaagcagaagagcgactgcggcgtggactgctgctgcgaccccaccaagtgcagaaacagacagcagggcaaggacagcctgggcaccgtggagagaacccaggacagcgagggcagcttcaagctggaggaccccaccgaggtgacccccggcctgagcttcttcaaccccgtgtgcgccacccccaacagcaagatcctgaaggagatgtgcgacgtggagcaggtgctgagcaagaagaccccccccgcccccagccccttcgacctgcccgagctgaagcacgtggccaccgagtaccaggagaacaaggcccccggcaagaagaagaagagagccctggccagcaacaccagcttcttcagcggctgcagccccatcgaggaggaggcccactag

SEQ ID NO: 86284 - DNA, 3705 bp, Artificial Sequence
  Description of Artificial Sequence: Synthetic coding sequence
atgaaggaggaggtgaagggcatccccgtgagagtggccctgagatgcagacccctggtgcccaaggagatcagcgagggctgccagatgtgcctgagcttcgtgcccggcgagacccaggtggtggtgggcaccgacaagagcttcacctacgacttcgtgttcgacccctgcaccgagcaggaggaggtgttcaacaaggccgtggcccccctgatcaagggcatcttcaagggctacaacgccaccgtgctggcctacggccagaccggcagcggcaagacctacagcatgggcggcgcctacaccgccgagcaggagaacgagcccaccgtgggcatcatccccagagtgatccagctgctgttcaaggagatcgacaagaagagcgacttcgagttcaccctgaaggtgagctacctggagatctacaacgaggagatcctggacctgctgtgccccagcagagagaaggcccagatcaacatcagagaggaccccaaggagggcatcaagatcgtgggcctgaccgagaagaccgtgctggtggccctggacaccgtgagctgcctggagcagggcaacaacagcagaaccgtggccagcaccgccatgaacagccagagcagcagaagccacgccatcttcaccatcagcatcgagcagagaaagaagagcgacaagaactgcagcttcagaagcaagctgcacctggtggacctggccggcagcgagagacagaagaagaccaaggccgagggcgacagactgaaggagggcatcaacatcaacagaggcctgctgtgcctgggcaacgtgatcagcgccctgggcgacgacaagaagggcagcttcgtgccctacagagacagcaagctgaccagactgctgcaggacagcctgggcggcaacagccacaccctgatgatcgcctgcgtgagccccgccgacagcaacctggaggagaccctgagcaccctgagatacgccgacagagccagaaagatcaagaacaagcccatcgtgaacatcgacccccacaccgccgagctgaaccacctgaagcagcaggtgcagcagctgcaggtgctgctgctgcaggcccacggcggcaccctgcccggcagcatcaacgccgagcccagcgagaacctgcagagcctgatggagaagaaccagagcctggtggaggagaacgagaagctgagcagatgcctgagcaaggccgccggccagaccgcccagatgctggagagaatcatcctgaccgagcaggtgaacgagaagctgaacgccaagctggaggagctgagacagcacgtggcctgcaagctggacctgcagaagctggtggagaccctggaggaccaggagctgaaggagaacgtggagatcatctgcaacctgcagcagctgatcacccagctgagcgacgagaccgtggcctgcaccgccgccgccatcgacaccgccgtggaggaggaggcccaggtggagaccagccccgagaccagcagaagcagcgacgccttcaccacccagcacgccctgcaccaggcccagatgagcaaggaggtggtggagctgaacaacgccctggccctgaaggaggccctggtgagaaagatgacccagaacgacaaccagctgcagcccatccagttccagtaccaggacaacatcaagaacctggagctggaggtgatcaacctgcagaaggagaaggaggagctggtgagagagctgcagaccgccaagaagaacgtgaaccaggccaagctgagcgagcacagacacaagctgctgcaggagctggagggccagatcgccgacctgaagaagaagctgaacgagcagagcaagctgctgaagctgaaggagagcaccgagagaaccgtgagcaagctgaaccaggagatctggatgatgaagaaccagagagtgcagctgatgagacagatgaaggaggacgccgagaagttcagacagtggaagcagaagaaggacaaggaggtgatccagctgaaggagagagacagaaagagacagtacgagctgctgaagctggagagaaacttccagaagcagagcagcgtgctgagaagaaagaccgaggaggccgccgccgccaacaagagactgaaggacgccctgcagaagcagagagaggtgaccgacaagagaaaggagacccagagccacggcaaggagggcatcgccgccagagtgagaaactggctgggcaacgagatcgaggtgatggtgagcaccgaggaggccaagagacacctgaacgacctgctggaggacagaaagatcctggcccaggacgtggtgcagctgaaggagaagaaggagagcagagagaaccccccccccaagctgagaaagtgcaccttcagcctgagcgaggtgcacggccaggtgctggagagcgaggactgcatcaccaagcagatcgagagcctggagaccgagatggagctgagaagcgcccagatcgccgacctgcagcagaagctgctggacgccgagagcgaggacagacccaagcagtgctgggagaacatcgccaccatcctggaggccaagtgcgccctgaagtacctgatcggcgagctggtgagcagcaagatccacgtgaccaagctggagaacagcctgagacagagcaaggccagctgcgccgacatgcagaagatgctgttcgaggagcagaaccacttcagcgagatcgagaccgagctgcaggccgagctggtgagaatggagcagcagcaccaggagaaggtgctgtacctggtgagccagctgcaggagagccagatggccgagaagcagctggagaagagcgccagcgagaaggagcagcagctggtgagcaccctgcagtgccaggacgaggagctggagaagatgagagaggtgtgcgagcagaaccagcagctgctgcaggagaacgagatcatcaagcagaagctgatcctgctgcaggtggccagcagacagaagcacctgcccaacgacaccctgctgagccccgacagcagcttcgagtacatcccccccaagcccaagcccagcagagtgaaggagaagttcctggagcagagcatggacatcgaggacctgaagtactgcagcgagcacagcgtgaacgagcacgaggacggcgacggcgacggcgacagcgacgagggcgacgacgaggagtggaagcccaccaagctggtgaaggtgagcagaaagaacatccagggctgcagctgcaagggctggtgcggcaacaagcagtgcggctgcagaaagcagaagagcgactgcggcgtggactgcagctgcgaccccaccaagtgcagaaacagacagcagggcaaggacagcctgggcaccgtggagcagacccaggacagcgagggcagcttcaagctggaggaccccaccgaggtgacccccggcctgagcttcttcaaccccgtgtgcgccacccccaacagcaagatcctgaaggagatgtgcgacatggagcaggtgctgagcaagaagaccgcccccgcccccagccccttcgacctgcccgagagcaagcacggcgccaccgagtaccagcagaacaagccccccggcaagaagaagaagagagccctggccagcaacaccagcttcttcagcggctgcagccccatcgaggaggaggcccactag

SEQ ID NO: 86285 - DNA, 3099 bp, Artificial Sequence
  Description of Artificial Sequence: Synthetic coding sequence
atggccgagaccaacaacgagtgcagcatcaaggtgctgtgcagattcagacccctgaaccaggccgagatcctgagaggcgacaagttcatccccatcttccagggcgacgacagcgtggtgatcggcggcaagccctacgtgttcgacagagtgttcccccccaacaccacccaggagcaggtgtaccacgcctgcgccatgcagatcgtgaaggacgtgctggccggctacaacggcaccatcttcgcctacggccagaccagcagcggcaagacccacaccatggagggcaagctgcacgacccccagctgatgggcatcatccccagaatcgccagagacatcttcaaccacatctacagcatggacgagaacctggagttccacatcaaggtgagctacttcgagatctacctggacaagatcagagacctgctggacgtgaccaagaccaacctgagcgtgcacgaggacaagaacagagtgcccttcgtgaagggctgcaccgagagattcgtgagcagccccgaggagatcctggacgtgatcgacgagggcaagagcaacagacacgtggccgtgaccaacatgaacgagcacagcagcagaagccacagcatcttcctgatcaacatcaagcaggagaacatggagaccgagcagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcaccaagagctacgtgccctacagagacagcaagatgaccagaatcctgcaggacagcctgggcggcaactgcagaaccaccatgttcatctgctgcagccccagcagctacaacgacgccgagaccaagagcaccctgatgttcggccagagagccaagaccatcaagaacaccgccagcgtgaacctggagctgaccgccgagcagtggaagaagaagtacgagaaggagaaggagaagaccaaggcccagaaggagaccatcgccaagctggaggccgagctgagcagatggagaaacggcgagaacgtgcccgagaccgagagactggccggcgaggaggccgccctgggcgccgagctgtgcgaggagacccccgtgaacgacaacagcagcatcgtggtgagaatcgcccccgaggagagacagaagtacgaggaggagatcagaagactgtacaagcagctggacgacaaggacgacgagatcaaccagcagagccagctgatcgagaagctgaagcagcagatgctggaccaggaggagctgctggtgagcaccagaggcgacaacgagaaggtgcagagagagctgagccacctgcagagcgagaacgacgccgccaaggacgaggtgaaggaggtgctgcaggccctggaggagctggccgtgaactacgaccagaagagccaggaggtggaggagaagagccagcagaaccagctgctggtggacgagctgagccagaaggtggccaccatgctgagcctggagagcgagctgcagagactgcaggaggtgagcggccaccagagaaagagaatcgccgaggtgctgaacggcctgatgaaggacctgagcgagttcagcgtgatcgtgggcaacggcgagatcaagctgcccgtggagatcagcggcgccatcgaggaggagttcaccgtggccagactgtacatcagcaagatcaagagcgaggtgaagagcgtggtgaagagatgcagacagctggagaacctgcaggtggagtgccacagaaagatggaggtgaccggcagagagctgagcagctgccagctgctgatcagccagcacgaggccaagatcagaagcctgaccgagtacatgcagagcgtggagctgaagaagagacacctggaggagagctacgacagcctgagcgacgagctggccaagctgcaggcccaggagaccgtgcacgaggtggccctgaaggacaaggagcccgacacccaggacgccgacgaggtgaagaaggccctggagctgcagatggagagccacagagaggcccaccacagacagctggccagactgagagacgagatcaacgagaagcagaagaccatcgacgagctgaaggacctgaaccagaagctgcagctggagctggagaagctgcaggccgactacgagaagctgaagagcgaggagcacgagaagagcaccaagctgcaggagctgaccttcctgtacgagagacacgagcagagcaagcaggacctgaagggcctggaggagaccgtggccagagagctgcagaccctgcacaacctgagaaagctgttcgtgcaggacgtgaccaccagagtgaagaagagcgccgagatggagcccgaggacagcggcggcatccacagccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagggcgccctgaaggaggccaaggagggcgccatgaaggacaagagaagataccagcaggaggtggacagaatcaaggaggccgtgagatacaagagcagcggcaagagaggccacagcgcccagatcgccaagcccgtgagacccggccactaccccgccagcagccccaccaacccctacggcaccagaagccccgagtgcatcagctacaccaacagcctgttccagaactaccagaacctgtacctgcaggccacccccagcagcaccagcgacatgtacttcgccaacagctgcaccagcagcggcgccaccagcagcggcggccccctggccagctaccagaaggccaacatggacaacggcaacgccaccgacatcaacgacaacagaagcgacctgccctgcggctacgaggccgaggaccaggccaagctgttccccctgcaccaggagaccgccgccagctag

SEQ ID NO: 86286 - DNA, 381 bp, Artificial Sequence
  Description of Artificial Sequence: Synthetic coding sequence
aagagcagcggcaagagaggccacagcgcccagatcgccaagcccgtgagacccggccactaccccgccagcagccccaccaacccctacggcaccagaagccccgagtgcatcagctacaccaacagcctgttccagaactaccagaacctgtacctgcaggccacccccagcagcaccagcgacatgtacttcgccaacagctgcaccagcagcggcgccaccagcagcggcggccccctggccagctaccagaaggccaacatggacaacggcaacgccaccgacatcaacgacaacagaagcgacctgccctgcggctacgaggccgaggaccaggccaagctgttccccctgcaccaggagaccgccgccagctag

SEQ ID NO: 86287 - DNA, 2892 bp, Artificial Sequence
  Description of Artificial Sequence: Synthetic coding sequence
atggccgacctggccgagtgcaacatcaaggtgatgtgcagattcagacccctgaacgagagcgaggtgaacagaggcgacaagtacatcgccaagttccagggcgaggacaccgtggtgatcgccagcaagccctacgccttcgacagagtgttccagagcagcaccagccaggagcaggtgtacaacgactgcgccaagaagatcgtgaaggacgtgctggagggctacaacggcaccatcttcgcctacggccagaccagcagcggcaagacccacaccatggagggcaagctgcacgaccccgagggcatgggcatcatccccagaatcgtgcaggacatcttcaactacatctacagcatggacgagaacctggagttccacatcaaggtgagctacttcgagatctacctggacaagatcagagacctgctggacgtgagcaagaccaacctgagcgtgcacgaggacaagaacagagtgccctacgtgaagggctgcaccgagagattcgtgtgcagccccgacgaggtgatggacaccatcgacgagggcaagagcaacagacacgtggccgtgaccaacatgaacgagcacagcagcagaagccacagcatcttcctgatcaacgtgaagcaggagaacacccagaccgagcagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcagcacctacgtgccctacagagacagcaagatgaccagaatcctgcaggacagcctgggcggcaactgcagaaccaccatcgtgatctgctgcagccccagcagctacaacgagagcgagaccaagagcaccctgctgttcggccagagagccaagaccatcaagaacaccgtgtgcgtgaacgtggagctgaccgccgagcagtggaagaagaagtacgagaaggagaaggagaagaacaagatcctgagaaacaccatccagtggctggagaacgagctgaacagatggagaaacggcgagaccgtgcccatcgacgagcagttcgacaaggagaaggccaacctggaggccttcaccgtggacaaggacatcaccctgaccaacgacaagcccgccaccgccatcggcgtgatcggcaacttcaccgacgccgagagaagaaagtgcgaggaggagatcgccaagctgtacaagcagctggacgacaaggacgaggagatcaaccagcagagccagctggtggagaagctgaagacccagatgctggaccaggaggagctgctggccagcaccagaagagaccaggacaacatgcaggccgagctgaacagactgcaggccgagaacgacgccagcaaggaggaggtgaaggaggtgctgcaggccctggaggagctggccgtgaactacgaccagaagagccaggaggtggaggacaagaccaaggagtacgagctgctgagcgacgagctgaaccagaagagcgccaccctggccagcatcgacgccgagctgcagaagctgaaggagatgaccaaccaccagaagaagagagccgccgagatgatggccagcctgctgaaggacctggccgagatcggcatcgccgtgggcaacaacgacgtgaagcagcccgagggcaccggcatgatcgacgaggagttcaccgtggccagactgtacatcagcaagatgaagagcgaggtgaagaccatggtgaagagatgcaagcagctggagagcacccagaccgagagcaacaagaagatggaggagaacgagaaggagctggccgcctgccagctgagaatcagccagcacgaggccaagatcaagagcctgaccgagtacctgcagaacgtggagcagaagaagagacagctggaggagagcgtggacgccctgagcgaggagctggtgcagctgagagcccaggagaaggtgcacgagatggagaaggagcacctgaacaaggtgcagaccgccaacgaggtgaagcaggccgtggagcagcagatccagagccacagagagacccaccagaagcagatcagcagcctgagagacgaggtggaggccaaggccaagctgatcaccgacctgcaggaccagaaccagaagatgatgctggagcaggagagactgagagtggagcacgagaagctgaaggccaccgaccaggagaagagcagaaagctgcacgagctgaccgtgatgcaggacagaagagagcaggccagacaggacctgaagggcctggaggagaccgtggccaaggagctgcagaccctgcacaacctgagaaagctgttcgtgcaggacctggccaccagagtgaagaagagcgccgagatcgacagcgacgacaccggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccagcagagacagaaagagataccagcaggaggtggacagaatcaaggaggccgtgagaagcaagaacatggccagaagaggccacagcgcccagatcgccaagcccatcagacccggccagcaccccgccgccagccccacccaccccagcgccatcagaggcggcggcgccttcgtgcagaacagccagcccgtggccgtgagaggcggcggcggcaagcaggtgtag

SEQ ID NO: 86288 - DNA, 2583 bp, Artificial Sequence
  Description of Artificial Sequence: Synthetic coding sequence
ggcaagctgcacgacccccagctgatgggcatcatccccagaatcgcccacgacatcttcgaccacatctacagcatggacgagaacctggagttccacatcaaggtgagctacttcgagatctacctggacaagatcagagacctgctggacgtgagcaagaccaacctggccgtgcacgaggacaagaacagagtgccctacgtgaagggctgcaccgagagattcgtgagcagccccgaggaggtgatggacgtgatcgacgagggcaaggccaacagacacgtggccgtgaccaacatgaacgagcacagcagcagaagccacagcatcttcctgatcaacatcaagcaggagaacgtggagaccgagaagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcaccaagacccacgtgccctacagagacagcaagatgaccagaatcctgcaggacagcctgggcggcaactgcagaaccaccatcgtgatctgctgcagccccagcgtgttcaacgaggccgagaccaagagcaccctgatgttcggccagagagccaagaccatcaagaacaccgtgagcgtgaacctggagctgaccgccgaggagtggaagaagaagtacgagaaggagaaggagaagaacaagaccctgaagaacgtgatccagcacctggagatggagctgaacagatggagaaacggcgaggccgtgcccgaggacgagcagatcagcgccaaggaccagaagaacctggagccctgcgacaacacccccatcatcgacaacatcgcccccgtggtggccggcatcagcaccgaggagaaggagaagtacgacgaggagatcagcagcctgtacagacagctggacgacaaggacgacgagatcaaccagcagagccagctggccgagaagctgaagcagcagatgctggaccaggacgagctgctggccagcaccagaagagactacgagaagatccaggaggagctgaccagactgcagatcgagaacgaggccgccaaggacgaggtgaaggaggtgctgcaggccctggaggagctggccgtgaactacgaccagaagagccaggaggtggaggacaagaccagagccaacgagcagctgaccgacgagctggcccagaagaccaccaccctgaccaccacccagagagagctgagccagctgcaggagctgagcaaccaccagaagaagagagccaccgagatcctgaacctgctgctgaaggacctgggcgagatcggcggcatcatcggcaccaacgacgtgaagaccctggccgacgtgaacggcgtgatcgaggaggagttcaccatggccagactgtacatcagcaagatgaagagcgaggtgaagagcctggtgaacagaagcaagcagctggagagcgcccagatggacagcaacagaaagatgaacgccagcgagagagagctggccgcctgccagctgctgatcagccagcacgaggccaagatcaagagcctgaccgactacatgcagaacatggagcagaagagaagacagctggaggagagccaggacagcctgagcgaggagctggccaagctgagagcccaggagaagatgcacgaggtgagcttccaggacaaggagaaggagcacctgaccagactgcaggacgccgaggagatgaagaaggccctggagcagcagatggagagccacagagaggcccaccagaagcagctgagcagactgagagacgagatcgaggagaagcagaagatcatcgacgagatcagagacctgaaccagaagctgcagctggagcaggagaagctgagcagcgactacaacaagctgaagatcgaggaccaggagagagagatgaagctggagaagctgctgctgctgaacgacaagagagagcaggccagagaggacctgaagggcctggaggagaccgtgagcagagagctgcagaccctgcacaacctgagaaagctgttcgtgcaggacctgaccaccagagtgaagaagagcgtggagctggacaacgacgacggcggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccatgagagacagaaagagataccagcaggaggtggacagaatcaaggaggccgtgagagccaagaacatggccagaagagcccacagcgcccagatcgccaagcccatcagacccggccactaccccgccagcagccccaccgccgtgcacgccatcagaggcggcggcggcagcagcagcaacagcacccactaccagaagtag

SEQ ID NO: 86289 - DNA, 2178 bp, Artificial Sequence
  Description of Artificial Sequence: Synthetic coding sequence
atggccacctacatccacgtgagcaagaccggcgccgagggcgccgtgctggacgaggccaagaacatcaacaagagcctgagcgccctgggcaacgtgatcagcgccctggccgagggcaccaagacccacgtgccctacagagacagcaagatgaccagaatcctgcaggacagcctgggcggcaactgcagaaccaccatcgtgatctgctgcagccccagcgtgttcaacgaggccgagaccaagagcaccctgatgttcggccagagagccaagaccatcaagaacaccgtgagcgtgaacctggagctgaccgccgaggagtggaagaagaagtacgagaaggagaaggagaagaacaagaccctgaagaacgtgatccagcacctggagatggagctgaacagatggagaaacggcgaggccgtgcccgaggacgagcagatcagcgccaaggaccagaagaacctggagccctgcgacaacacccccatcatcgacaacatcgcccccgtggtggccggcatcagcaccgaggagaaggagaagtacgacgaggagatcagcagcctgtacagacagctggacgacaaggacgacgagatcaaccagcagagccagctggccgagaagctgaagcagcagatgctggaccaggacgagctgctggccagcaccagaagagactacgagaagatccaggaggagctgaccagactgcagatcgagaacgaggccgccaaggacgaggtgaaggaggtgctgcaggccctggaggagctggccgtgaactacgaccagaagagccaggaggtggaggacaagaccagagccaacgagcagctgaccgacgagctggcccagaagaccaccaccctgaccaccacccagagagagctgagccagctgcaggagctgagcaaccaccagaagaagagagccaccgagatcctgaacctgctgctgaaggacctgggcgagatcggcggcatcatcggcaccaacgacgtgaagaccctggccgacgtgaacggcgtgatcgaggaggagttcaccatggccagactgtacatcagcaagatgaagagcgaggtgaagagcctggtgaacagaagcaagcagctggagagcgcccagatggacagcaacagaaagatgaacgccagcgagagagagctggccgcctgccagctgctgatcagccagcacgaggccaagatcaagagcctgaccgactacatgcagaacatggagcagaagagaagacagctggaggagagccaggacagcctgagcgaggagctggccaagctgagagcccaggagaagatgcacgaggtgagcttccaggacaaggagaaggagcacctgaccagactgcaggacgccgaggagatgaagaaggccctggagcagcagatggagagccacagagaggcccaccagaagcagctgagcagactgagagacgagatcgaggagaagcagaagatcatcgacgagatcagagacctgaaccagaagctgcagctggagcaggagaagctgagcagcgactacaacaagctgaagatcgaggaccaggagagagagatgaagctggagaagctgctgctgctgaacgacaagagagagcaggccagagaggacctgaagggcctggaggagaccgtgagcagagagctgcagaccctgcacaacctgagaaagctgttcgtgcaggacctgaccaccagagtgaagaagagcgtggagctggacaacgacgacggcggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccatgagagacagaaagagataccagcaggaggtggacagaatcaaggaggccgtgagagccaagaacatggccagaagagcccacagcgcccagatcgccaagcccatcagacccggccactaccccgccagcagccccaccgccgtgcacgccatcagaggcggcggcggcagcagcagcaacagcacccactaccagaagtag

SEQ ID NO: 86290 - DNA, 2589 bp, Artificial Sequence
  Description of Artificial Sequence: Synthetic coding sequence
atgtggggcaagctgcacgacccccagctgatgggcatcatccccagaatcgcccacgacatcttcgaccacatctacagcatggacgagaacctggagttccacatcaaggtgagctacttcgagatctacctggacaagatcagagacctgctggacgtgagcaagaccaacctggccgtgcacgaggacaagaacagagtgccctacgtgaagggctgcaccgagagattcgtgagcagccccgaggaggtgatggacgtgatcgacgagggcaaggccaacagacacgtggccgtgaccaacatgaacgagcacagcagcagaagccacagcatcttcctgatcaacatcaagcaggagaacgtggagaccgagaagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcaccaagacccacgtgccctacagagacagcaagatgaccagaatcctgcaggacagcctgggcggcaactgcagaaccaccatcgtgatctgctgcagccccagcgtgttcaacgaggccgagaccaagagcaccctgatgttcggccagagagccaagaccatcaagaacaccgtgagcgtgaacctggagctgaccgccgaggagtggaagaagaagtacgagaaggagaaggagaagaacaagaccctgaagaacgtgatccagcacctggagatggagctgaacagatggagaaacggcgaggccgtgcccgaggacgagcagatcagcgccaaggaccagaagaacctggagccctgcgacaacacccccatcatcgacaacatcgcccccgtggtggccggcatcagcaccgaggagaaggagaagtacgacgaggagatcagcagcctgtacagacagctggacgacaaggacgacgagatcaaccagcagagccagctggccgagaagctgaagcagcagatgctggaccaggacgagctgctggccagcaccagaagagactacgagaagatccaggaggagctgaccagactgcagatcgagaacgaggccgccaaggacgaggtgaaggaggtgctgcaggccctggaggagctggccgtgaactacgaccagaagagccaggaggtggaggacaagaccagagccaacgagcagctgaccgacgagctggcccagaagaccaccaccctgaccaccacccagagagagctgagccagctgcaggagctgagcaaccaccagaagaagagagccaccgagatcctgaacctgctgctgaaggacctgggcgagatcggcggcatcatcggcaccaacgacgtgaagaccctggccgacgtgaacggcgtgatcgaggaggagttcaccatggccagactgtacatcagcaagatgaagagcgaggtgaagagcctggtgaacagaagcaagcagctggagagcgcccagatggacagcaacagaaagatgaacgccagcgagagagagctggccgcctgccagctgctgatcagccagcacgaggccaagatcaagagcctgaccgactacatgcagaacatggagcagaagagaagacagctggaggagagccaggacagcctgagcgaggagctggccaagctgagagcccaggagaagatgcacgaggtgagcttccaggacaaggagaaggagcacctgaccagactgcaggacgccgaggagatgaagaaggccctggagcagcagatggagagccacagagaggcccaccagaagcagctgagcagactgagagacgagatcgaggagaagcagaagatcatcgacgagatcagagacctgaaccagaagctgcagctggagcaggagaagctgagcagcgactacaacaagctgaagatcgaggaccaggagagagagatgaagctggagaagctgctgctgctgaacgacaagagagagcaggccagagaggacctgaagggcctggaggagaccgtgagcagagagctgcagaccctgcacaacctgagaaagctgttcgtgcaggacctgaccaccagagtgaagaagagcgtggagctggacaacgacgacggcggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccatgagagacagaaagagataccagcaggaggtggacagaatcaaggaggccgtgagagccaagaacatggccagaagagcccacagcgcccagatcgccaagcccatcagacccggccactaccccgccagcagccccaccgccgtgcacgccatcagaggcggcggcggcagcagcagcaacagcacccactaccagaagtag

SEQ ID NO: 86291 - DNA, 2874 bp, Artificial Sequence
  Description of Artificial Sequence: Synthetic coding sequence
atggccgaccccgccgagtgcagcatcaaggtgatgtgcagattcagacccctgaacgaggccgagatcctgagaggcgacaagttcatccccaagttcaagggcgacgagaccgtggtgatcggccagggcaagccctacgtgttcgacagagtgctgccccccaacaccacccaggagcaggtgtacaacgcctgcgccaagcagatcgtgaaggacgtgctggagggctacaacggcaccatcttcgcctacggccagaccagcagcggcaagacccacaccatggagggcaagctgcacgacccccagctgatgggcatcatccccagaatcgcccacgacatcttcgaccacatctacagcatggacgagaacctggagttccacatcaaggtgagctacttcgagatctacctggacaagatcagagacctgctggacgtgagcaagaccaacctggccgtgcacgaggacaagaacagagtgccctacgtgaagggctgcaccgagagattcgtgagcagccccgaggaggtgatggacgtgatcgacgagggcaaggccaacagacacgtggccgtgaccaacatgaacgagcacagcagcagaagccacagcatcttcctgatcaacatcaagcaggagaacgtggagaccgagaagaagctgagcggcaagctgtacctggtggacctggccggcagcgagaaggtgagcaagaccggcgccgagggcgccgtgctggacgaggccaagaacatcaacaagagcctgagcgccctgggcaacgtgatcagcgccctggccgagggcaccaagacccacgtgccctacagagacagcaagatgaccagaatcctgcaggacagcctgggcggcaactgcagaaccaccatcgtgatctgctgcagccccagcgtgttcaacgaggccgagaccaagagcaccctgatgttcggccagagagccaagaccatcaagaacaccgtgagcgtgaacctggagctgaccgccgaggagtggaagaagaagtacgagaaggagaaggagaagaacaagaccctgaagaacgtgatccagcacctggagatggagctgaacagatggagaaacggcgaggccgtgcccgaggacgagcagatcagcgccaaggaccagaagaacctggagccctgcgacaacacccccatcatcgacaacatcgcccccgtggtggccggcatcagcaccgaggagaaggagaagtacgacgaggagatcagcagcctgtacagacagctggacgacaaggacgacgagatcaaccagcagagccagctggccgagaagctgaagcagcagatgctggaccaggacgagctgctggccagcaccagaagagactacgagaagatccaggaggagctgaccagactgcagatcgagaacgaggccgccaaggacgaggtgaaggaggtgctgcaggccctggaggagctggccgtgaactacgaccagaagagccaggaggtggaggacaagaccagagccaacgagcagctgaccgacgagctggcccagaagaccaccaccctgaccaccacccagagagagctgagccagctgcaggagctgagcaaccaccagaagaagagagccaccgagatcctgaacctgctgctgaaggacctgggcgagatcggcggcatcatcggcaccaacgacgtgaagaccctggccgacgtgaacggcgtgatcgaggaggagttcaccatggccagactgtacatcagcaagatgaagagcgaggtgaagagcctggtgaacagaagcaagcagctggagagcgcccagatggacagcaacagaaagatgaacgccagcgagagagagctggccgcctgccagctgctgatcagccagcacgaggccaagatcaagagcctgaccgactacatgcagaacatggagcagaagagaagacagctggaggagagccaggacagcctgagcgaggagctggccaagctgagagcccaggagaagatgcacgaggtgagcttccaggacaaggagaaggagcacctgaccagactgcaggacgccgaggagatgaagaaggccctggagcagcagatggagagccacagagaggcccaccagaagcagctgagcagactgagagacgagatcgaggagaagcagaagatcatcgacgagatcagagacctgaaccagaagctgcagctggagcaggagaagctgagcagcgactacaacaagctgaagatcgaggaccaggagagagagatgaagctggagaagctgctgctgctgaacgacaagagagagcaggccagagaggacctgaagggcctggaggagaccgtgagcagagagctgcagaccctgcacaacctgagaaagctgttcgtgcaggacctgaccaccagagtgaagaagagcgtggagctggacaacgacgacggcggcggcagcgccgcccagaagcagaagatcagcttcctggagaacaacctggagcagctgaccaaggtgcacaagcagctggtgagagacaacgccgacctgagatgcgagctgcccaagctggagaagagactgagagccaccgccgagagagtgaaggccctggagagcgccctgaaggaggccaaggagaacgccatgagagacagaaagagataccagcaggaggtggacagaatcaaggaggccgtgagagccaagaacatggccagaagagcccacagcgcccagatcgccaagcccatcagacccggccactaccccgccagcagccccaccgccgtgcacgccatcagaggcggcggcggcagcagcagcaacagcacccactaccagaagtag

SEQ ID NO: 86292 - DNA, 219 bp, Artificial Sequence
  Description of Artificial Sequence: Synthetic coding sequence
atggccgaccccgccgagtgcagcatcaaggtgatgtgcagattcagacccctgaacgaggccgagatcctgagaggcgacaagttcatccccaagttcaagggcgacgagaccgtggtgatcggccagggcaagccctacgtgttcgacagagtgctgccccccaacaccacccaggagcaggtgtacaacgcctgcgccaagcagatcgtgaagtag

SEQ ID NO: 86293 - DNA, 552 bp, Artificial Sequence
  Description of Artificial Sequence: Synthetic coding sequence
atggagcagagactggccgagttcagagccgccagaaagagagccggcctggccgcccagccccccgccgccagccagggcgcccagacccccggcgagaaggccgaggccgccgccaccctgaaggccgcccccggctggctgaagagattcctggtgtggaagcccagacccgccagcgccagagcccagcccggcctggtgcaggaggccgcccagccccagggcagcaccagcgagaccccctggaacaccgccatccccctgcccagctgctgggaccagagcttcctgaccaacatcaccttcctgaaggtgctgctgtggctggtgctgctgggcctgttcgtggagctggagttcggcctggcctacttcgtgctgagcctgttctactggatgtacgtgggcaccagaggccccgaggagaagaaggagggcgagaagagcgcctacagcgtgttcaaccccggctgcgaggccatccagggcaccctgaccgccgagcagctggagagagagctgcagctgagacccctggccggcagatag

SEQ ID NO: 86294 - DNA, 2445 bp, Artificial Sequence
  Description of Artificial Sequence: Synthetic coding sequence
atggtgaagcagaccatccagatcttcgccagagtgaagccccccgtgagaaagcaccagcagggcatctacagcatcgacgaggacgagaagctgatccccagcctggagatcatcctgcccagagacctggccgacggcttcgtgaacaacaagagagagagctacaagttcaagttccagagaatcttcgaccaggacgccaaccaggagaccgtgttcgagaacatcgccaagcccgtggccggcagcgtgctggccggctacaacggcaccatcttcgcctacggccagaccggcagcggcaagaccttcaccatcaccggcggcgccgagagatacagcgacagaggcatcatccccagaaccctgagctacatcttcgagcagctgcagaaggacagcagcaagatctacaccacccacatcagctacctggagatctacaacgagtgcggctacgacctgctggaccccagacacgaggccagcagcctggaggacctgcccaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcaacatcctggtgaacatgctgaagaaggagaagaagaaggcccaggaggccctgcacctggccggcatggacagaagagagttcagacagagccagagcccccccttcagactgggcaaccccgaggagggccagagaatgagactgagcagcgcccccagccaggcccaggacttcagcatcctgggcaagagaagcagcctgctgcacaagaagatcggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86295 - DNA, 498 bp, Artificial Sequence
  Description of Artificial Sequence: Synthetic coding sequence
atgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactgaaggcccccagcagcagcgacggcgtgctgttctgcagaaaccagtag

SEQ ID NO: 86296 - DNA, 1962 bp, Artificial Sequence
  Description of Artificial Sequence: Synthetic coding sequence
atggccagcagcctgtacgacctgaagaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcaacatcctggtgaacatgctgaagaaggagaagaagaaggcccaggaggccctgcacctggccggcatggacagaagagagttcagacagagccagagcccccccttcagactgggcaaccccgaggagggccagagaatgagactgagcagcgcccccagccaggcccaggacttcagcatcctgggcaagagaagcagcctgctgcacaagaagatcggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86297 - DNA, 2394 bp, Artificial Sequence
  Description of Artificial Sequence: Synthetic coding sequence
atggtgaagcagaccatccagatcttcgccagagtgaagccccccgtgagaaagcaccagcagggcatctacagcatcgacgaggacgagaagctgatccccagcctggagatcatcctgcccagagacctggccgacggcttcgtgaacaacaagagagagagctacaagttcaagttccagagaatcttcgaccaggacgccaaccaggagaccgtgttcgagaacatcgccaagcccgtggccggcagcgtgctggccggctacaacggcaccatcttcgcctacggccagaccggcagcggcaagaccttcaccatcaccggcggcgccgagagatacagcgacagaggcatcatccccagaaccctgagctacatcttcgagcagctgcagaaggacagcagcaagatctacaccacccacatcagctacctggagatctacaacgagtgcggctacgacctgctggaccccagacacgaggccagcagcctggaggacctgcccaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcaacatcctggtgaacatgctgaagaaggagaagaagaaggcccaggaggccctgcacctggccggcatggacagaagagagttcagacagagccagagcccccccttcagactgggcaaccccgaggagggccagagaatgagactgagcagcgcccccagccaggcccaggacttcagcatcctgggcaagagaagcagcctgctgcacaagaagatcggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86298 - DNA, 2394 bp, Artificial Sequence
  Description of Artificial Sequence: Synthetic coding sequence
atggtgaagcagaccatccagatcttcgccagagtgaagccccccgtgagaaagcaccagcagggcatctacagcatcgacgaggacgagaagctgatccccagcctggagatcatcctgcccagagacctggccgacggcttcgtgaacaacaagagagagagctacaagttcaagttccagagaatcttcgaccaggacgccaaccaggagaccgtgttcgagaacatcgccaagcccgtggccggcagcgtgctggccggctacaacggcaccatcttcgcctacggccagaccggcagcggcaagaccttcaccatcaccggcggcgccgagagatacagcgacagaggcatcatccccagaaccctgagctacatcttcgagcagctgcagaaggacagcagcaagatctacaccacccacatcagctacctggagatctacaacgagtgcggctacgacctgctggaccccagacacgaggccagcagcctggaggacctgcccaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcaacatcctggtgaacatgctgaagaaggagaagaagaaggcccaggaggccctgcacctggccggcatggacagaagagagttcagacagagccagagcccccccttcagactgggcaaccccgaggagggccagagaatgagactgagcagcgcccccagccaggcccaggacttcagcatcctgggcaagagaagcagcctgctgcacaagaagatcggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86299 - DNA, 747 bp, Artificial Sequence
  Description of Artificial Sequence: Synthetic coding sequence
atgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86300 - DNA, 486 bp, Artificial Sequence
  Description of Artificial Sequence: Synthetic coding sequence
acccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactgaaggcccccagcagcagcgacggcgtgctgttctgcagaaaccagtag

SEQ ID NO: 86301 - DNA, 2070 bp, Artificial Sequence
  Description of Artificial Sequence: Synthetic coding sequence
tgaggcgccgagagatacagcgacagaggcatcatccccagaaccctgagctacatcttcgagcagctgcagaaggacagcagcaagatctacaccacccacatcagctacctggagatctacaacgagtgcggctacgacctgctggaccccagacacgaggccagcagcctggaggacctgcccaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcaacatcctggtgaacatgctgaagaaggagaagaagaaggcccaggaggccctgcacctggccggcatggacagaagagagttcagacagagccagagcccccccttcagactgggcaaccccgaggagggccagagaatgagactgagcagcgcccccagccaggcccaggacttcagcatcctgggcaagagaagcagcctgctgcacaagaagatcggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86302 - DNA, 2277 bp, Artificial Sequence
  Description of Artificial Sequence: Synthetic coding sequence
atggtgaagcagaccatccagatcttcgccagagtgaagccccccgtgagaaagcaccagcagggcatctacagcatcgacgaggacgagaagctgatccccagcctggagatcatcctgcccagagacctggccgacggcttcgtgaacaacaagagagagagctacaagttcaagttccagagaatcttcgaccaggacgccaaccaggagaccgtgttcgagaacatcgccaagcccgtggccggcagcgtgctggccggctacaacggcaccatcttcgcctacggccagaccggcagcggcaagaccttcaccatcaccggcggcgccgagagatacagcgacagaggcatcatccccagaaccctgagctacatcttcgagcagctgcagaaggacagcagcaagatctacaccacccacatcagctacctggagatctacaacgagtgcggctacgacctgctggaccccagacacgaggccagcagcctggaggacctgcccaaggtgaccatcctggaggaccccgaccagaacatccacctgaagaacctgaccctgcaccaggccaccaccgaggaggaggccctgaacctgctgttcctgggcgacaccaacagaatgatcgccgagacccccatgaaccaggccagcaccagaagccactgcatcttcaccatccacctgagcagcaaggagcccggcagcgccaccgtgagacacgccaagctgcacctggtggacctggccggcagcgagagagtggccaagaccggcgtgggcggccacctgctgaccgaggccaagtacatcaacctgagcctgcactacctggagcaggtgatcatcgccctgagcgagaagcacagaagccacatcccctacagaaacagcatgatgaccagcgtgctgagagacagcctgggcggcaactgcatgaccaccatgatcgccaccctgagcctggagaagagaaacctggacgagagcatcagcacctgcagattcgcccagagagtggccctgatcaagaacgaggccgtgctgaacgaggagatcaaccccagactggtgatcaagagactgcagaaggagatccaggagctgaaggacgagctggccatggtgaccggcgagcagagaaccgaggccctgaccgaggccgagctgctgcagctggagaagctgatcaccagcttcctggaggaccaggacagcgacagcagactggaggtgggcgccgacatgagaaaggtgcaccactgcttccaccacctgaagaagctgctgaacgacaagaagatcctggagaacaacaccgtgagcagcgagagcaaggaccaggactgccaggagcccctgaaggaggaggagtacagaaagctgagagacatcctgaagcagagagacaacgagatcagcatcctgagcgaggtgatgaagaagctgcccctgagctggttcgagagaggcatgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 86303 - DNA, 516 bp, Artificial Sequence
  Description of Artificial Sequence: Synthetic coding sequence
atgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagagcaagatcaaggccctggccgacagcatgagcggcctgtag

SEQ ID NO: 86304 - DNA, 882 bp, Artificial Sequence
  Description of Artificial Sequence: Synthetic coding sequence
atgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtacctgcagctgctgtgcagcctgttccccaagagcgccgtgagcagcgcccaggccagcaccaacagaaagggcctgagcgacgtgctggtgaccagatag

SEQ ID NO: 86305 - DNA, 4032 bp, Artificial Sequence
  Description of Artificial Sequence: Synthetic coding sequence
atgggcctggaggcccagagactgcccggcgccgaggaggcccccgtgagagtggccctgagagtgagacccctgctgcccaaggagctgctgcacggccaccagagctgcctgcaggtggagcccggcctgggcagagtgaccctgggcagagacagacacttcggcttccacgtggtgctggccgaggacgccggccaggaggccgtgtaccaggcctgcgtgcagcccctgctggaggccttcttcgagggcttcaacgccaccgtgttcgcctacggccagaccggcagcggcaagacctacaccatgggcgaggccagcgtggccagcctgctggaggacgagcagggcatcgtgcccagagccatggccgaggccttcaagctgatcgacgagaacgacctgctggactgcctggtgcacgtgagctacctggaggtgtacaaggaggagttcagagacctgctggaggtgggcaccgccagcagagacatccagctgagagaggacgagagaggcaacgtggtgctgtgcggcgtgaaggaggtggacgtggagggcctggacgaggtgctgagcctgctggagatgggcaacgccgccagacacaccggcgccacccacctgaaccacctgagcagcagaagccacaccgtgttcaccgtgaccctggagcagagaggcagagcccccagcagactgcccagacccgcccccggccagctgctggtgagcaagttccacttcgtggacctggccggcagcgagagagtgctgaagaccggcagcaccggcgagagactgaaggagagcatccagatcaacagcagcctgctggccctgggcaacgtgatcagcgccctgggcgacccccagagaagaggcagccacatcccctacagagacagcaagatcaccagaatcctgaaggacagcctgggcggcaacgccaagaccgtgatgatcgcctgcgtgagccccagcagcagcgacttcgacgagaccctgaacaccctgaactacgccagcagagcccagaacatcagaaacagagccaccgtgaactggagacccgaggccgagagaccccccgaggagaccgccagcggcgccagaggcccccccagacacagaagcgagaccagaatcatccacagaggcagaagagcccccggccccgccaccgccagcgccgccgccgccatgagactgggcgccgagtgcgccagatacagagcctgcaccgacgccgcctacagcctgctgagagagctgcaggccgagcccggcctgcccggcgccgccgccagaaaggtgagagactggctgtgcgccgtggagggcgagagaagcgccctgagcagcgccagcggccccgacagcggcatcgagagcgccagcgtggaggaccaggccgcccagggcgccggcggcagaaaggaggacgagggcgcccagcagctgctgaccctgcagaaccaggtggccagactggaggaggagaacagagacttcctggccgccctggaggacgccatggagcagtacaagctgcagagcgacagactgagagagcagcaggaggagatggtggagctgagactgagactggagctggtgagacccggctggggcggccccagactgctgaacggcctgccccccggcagcttcgtgcccagaccccacaccgcccccctgggcggcgcccacgcccacgtgctgggcatggtgccccccgcctgcctgcccggcgacgaggtgggcagcgagcagagaggcgagcaggtgaccaacggcagagaggccggcgccgagctgctgaccgaggtgaacagactgggcagcggcagcagcgccgccagcgaggaggaggaggaggaggaggagccccccagaagaaccctgcacctgagaagaaacagaatcagcaactgcagccagagagccggcgccagacccggcagcctgcccgagagaaagggccccgagctgtgcctggaggagctggacgccgccatccccggcagcagagccgtgggcggcagcaaggccagagtgcaggccagacaggtgccccccgccaccgccagcgagtggagactggcccaggcccagcagaagatcagagagctggccatcaacatcagaatgaaggaggagctgatcggcgagctggtgagaaccggcaaggccgcccaggccctgaacagacagcacagccagagaatcagagagctggagcaggaggccgagcaggtgagagccgagctgagcgagggccagagacagctgagagagctggagggcaaggagctgcaggacgccggcgagagaagcagactgcaggagttcagaagaagagtggccgccgcccagagccaggtgcaggtgctgaaggagaagaagcaggccaccgagagactggtgagcctgagcgcccagagcgagaagagactgcaggagctggagagaaacgtgcagctgatgagacagcagcagggccagctgcagagaagactgagagaggagaccgagcagaagagaagactggaggccgagatgagcaagagacagcacagagtgaaggagctggagctgaagcacgagcagcagcagaagatcctgaagatcaagaccgaggagatcgccgccttccagagaaagagaagaagcggcagcaacggcagcgtggtgagcctggagcagcagcagaagatcgaggagcagaagaagtggctggaccaggagatggagaaggtgctgcagcagagaagagccctggaggagctgggcgaggagctgcacaagagagaggccatcctggccaagaaggaggccctgatgcaggagaagaccggcctggagagcaagagactgagaagcagccaggccctgaacgaggacatcgtgagagtgagcagcagactggagcacctggagaaggagctgagcgagaagagcggccagctgagacagggcagcgcccagagccagcagcagatcagaggcgagatcgacagcctgagacaggagaaggacagcctgctgaagcagagactggagatcgacggcaagctgagacagggcagcctgctgagccccgaggaggagagaaccctgttccagctggacgaggccatcgaggccctggacgccgccatcgagtacaagaacgaggccatcacctgcagacagagagtgctgagagccagcgccagcctgctgagccagtgcgagatgaacctgatggccaagctgagctacctgagcagcagcgagaccagagccctgctgtgcaagtacttcgacaaggtggtgaccctgagagaggagcagcaccagcagcagatcgccttcagcgagctggagatgcagctggaggagcagcagagactggtgtactggctggaggtggccctggagagacagagactggagatggacagacagctgaccctgcagcagaaggagcacgagcagaacatgcagctgctgctgcagcagagcagagaccacctgggcgagggcctggccgacagcagaagacagtacgaggccagaatccaggccctggagaaggagctgggcagatacatgtggatcaaccaggagctgaagcagaagctgggcggcgtgaacgccgtgggccacagcagaggcggcgagaagagaagcctgtgcagcgagggcagacaggcccccggcaacgaggacgagctgcacctggcccccgagctgctgtggctgagccccctgaccgagggcgcccccagaaccagagaggagaccagagacctggtgcacgcccccctgcccctgacctggaagagaagcagcctgtgcggcgaggagcagggcagccccgaggagctgagacagagagaggccgccgagcccctggtgggcagagtgctgcccgtgggcgaggccggcctgccctggaacttcggccccctgagcaagcccagaagagagctgagaagagccagccccggcatgatcgacgtgagaaagaaccccctgtag

SEQ ID NO: 86306 - DNA, 2022 bp, Artificial Sequence
  Description of Artificial Sequence: Synthetic coding sequence
atggacccccagagaagccccctgctggaggtgaagggcaacatcgagctgaagagacccctgatcaaggcccccagccagctgcccctgagcggcagcagactgaagagaagacccgaccagatggaggacggcctggagcccgagaagaagagaaccagaggcctgggcgccaccaccaagatcaccaccagccaccccagagtgcccagcctgaccaccgtgccccagacccagggccagaccaccgcccagaaggtgagcaagaagaccggccccagatgcagcaccgccatcgccaccggcctgaagaaccagaagcccgtgcccgccgtgcccgtgcagaagagcggcaccagcggcgtgccccccatggccggcggcaagaagcccagcaagagacccgcctgggacctgaagggccagctgtgcgacctgaacgccgagctgaagagatgcagagagagaacccagaccctggaccaggagaaccagcagctgcaggaccagctgagagacgcccagcagcaggtgaaggccctgggcaccgagagaaccaccctggagggccacctggccaaggtgcaggcccaggccgagcagggccagcaggagctgaagaacctgagagcctgcgtgctggagctggaggagagactgagcacccaggagggcctggtgcaggagctgcagaagaagcaggtggagctgcaggaggagagaagaggcctgatgagccagctggaggagaaggagagaagactgcagaccagcgaggccgccctgagcagcagccaggccgaggtggccagcctgagacaggagaccgtggcccaggccgccctgctgaccgagagagaggagagactgcacggcctggagatggagagaagaagactgcacaaccagctgcaggagctgaagggcaacatcagagtgttctgcagagtgagacccgtgctgcccggcgagcccacccccccccccggcctgctgctgttccccagcggccccggcggccccagcgacccccccaccagactgagcctgagcagaagcgacgagagaagaggcaccctgagcggcgcccccgccccccccaccagacacgacttcagcttcgacagagtgttcccccccggcagcggccaggacgaggtgttcgaggagatcgccatgctggtgcagagcgccctggacggctaccccgtgtgcatcttcgcctacggccagaccggcagcggcaagaccttcaccatggagggcggccccggcggcgacccccagctggagggcctgatccccagagccctgagacacctgttcagcgtggcccaggagctgagcggccagggctggacctacagcttcgtggccagctacgtggagatctacaacgagaccgtgagagacctgctggccaccggcaccagaaagggccagggcggcgagtgcgagatcagaagagccggccccggcagcgaggagctgaccgtgaccaacgccagatacgtgcccgtgagctgcgagaaggaggtggacgccctgctgcacctggccagacagaacagagccgtggccagaaccgcccagaacgagagaagcagcagaagccacagcgtgttccagctgcagatcagcggcgagcacagcagcagaggcctgcagtgcggcgcccccctgagcctggtggacctggccggcagcgagagactggaccccggcctggccctgggccccggcgagagagagagactgagagagacccaggccatcaacagcagcctgagcaccctgggcctggtgatcatggccctgagcaacaaggagagccacgtgccctacagaaacagcaagctgacctacctgctgcagaacagcctgggcggcagcgccaagatgctgatgttcgtgaacatcagccccctggaggagaacgtgagcgagagcctgaacagcctgagattcgccagcaaggtgaaccagtgcgtgatcggcaccgcccaggccaacagaaagtag

SEQ ID NO: 86307 - DNA, 612 bp, Artificial Sequence
  Description of Artificial Sequence: Synthetic coding sequence
atggacccccagagaagccccctgctggaggtgaagggcaacatcgagctgaagagacccctgatcaaggcccccagccagctgcccctgagcggcagcagactgaagagaagacccgaccagatggaggacggcctggagcccgagaagaagagaaccagaggcctgggcgccaccaccaagatcaccaccagccaccccagagtgcccagcctgaccaccgtgccccagacccagggccagaccaccggccccagcagccaccccctgccctggcagtgccaccaccagcccttcctggtgaccgaccccggcggcagaagctggggccccggccagaagtggcacagactgcacctgtggtgcaccagcgcccagaaggtgagcaagaagaccggccccagatgcagcaccgccatcgccaccggcctgaagaaccagaagcccgtgcccgccgtgcccgtgcagaagagcggcaccagcggcgtgccccccatggccggcggcaagaagcccagcaagagacccgcctgggacctgaagggccagctgtgcgacctgaacgccgagctgaagagatgcagagagagaacccagaccctggaccagtag

SEQ ID NO: 86308 - DNA, 612 bp, Artificial Sequence
  Description of Artificial Sequence: Synthetic coding sequence
atggacccccagagaagccccctgctggaggtgaagggcaacatcgagctgaagagacccctgatcaaggcccccagccagctgcccctgagcggcagcagactgaagagaagacccgaccagatggaggacggcctggagcccgagaagaagagaaccagaggcctgggcgccaccaccaagatcaccaccagccaccccagagtgcccagcctgaccaccgtgccccagacccagggccagaccaccggccccagcagccaccccctgccctggcagtgccaccaccagcccttcctggagaccgaccccggcggcagaagctggggccccggccagaagtggcacagactgcacctgtggtgcaccagcgcccagaaggtgagcaagaagaccggccccagatgcagcaccgccatcgccaccggcctgaagaaccagaagcccgtgcccgccgtgcccgtgcagaagagcggcaccagcggcgtgccccccatggccggcggcaagaagcccagcaagagacccgcctgggacctgaagggccagctgtgcgacctgaacgccgagctgaagagatgcagagagagaacccagaccctggaccagtag

SEQ ID NO: 86309 - DNA, 2022 bp, Artificial Sequence; identical to SEQ ID NO: 86306
  Description of Artificial Sequence: Synthetic coding sequence

SEQ ID NO: 86310 - DNA, 2022 bp, Artificial Sequence; identical to SEQ ID NO: 86306
  Description of Artificial Sequence: Synthetic coding sequence

SEQ ID NO: 86311 - DNA, 612 bp, Artificial Sequence; identical to SEQ ID NO: 86308
  Description of Artificial Sequence: Synthetic coding sequence

SEQ ID NO: 86312 - DNA, 2502 bp, Artificial Sequence
  Description of Artificial Sequence: Synthetic coding sequence
atggtgcccagcagaagaacctggaacctgggcgccacccccagcctgagaggcctgtggagagtgggcagagcccccgagcccgagcccggcatggccagacccgcccccgcccccgccagccccgccgccagacccttcccccacaccggccccggcagactgagaaccggcagaggcaaggacacccccgtgtgcggcgacgaggacagcagcgccagaagcgccgccagacccgccctggcccagtgcagagccctgagcgtggactgggccggccccggcagcccccacggcctgtacctgaccctgcaggtggagcacctgaaggagaagctgatcagccaggcccaggaggtgagcagactgagaagcgagctgggcggcaccgacctggagaagcacagagacctgctgatggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcggcaagagcagacccctgcccgtgtag

SEQ ID NO: 86313 - DNA, 2064 bp, Artificial Sequence
  Description of Artificial Sequence: Synthetic coding sequence
atggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86314 - DNA, 2481 bp, Artificial Sequence
  Description of Artificial Sequence: Synthetic coding sequence
atggtgcccagcagaagaacctggaacctgggcgccacccccagcctgagaggcctgtggagagtgggcagagcccccgagcccgagcccggcatggccagacccgcccccgcccccgccagccccgccgccagacccttcccccacaccggccccggcagactgagaaccggcagaggcaaggacacccccgtgtgcggcgacgaggacagcagcgccagaagcgccgccagacccgccctggcccagtgcagagccctgagcgtggactgggccggccccggcagcccccacggcctgtacctgaccctgcaggtggagcacctgaaggagaagctgatcagccaggcccaggaggtgagcagactgagaagcgagctgggcggcaccgacctggagaagcacagagacctgctgatggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86315 - DNA, 2307 bp, Artificial Sequence
  Description of Artificial Sequence: Synthetic coding sequence
atggtgctgagaatggtggaggccatgagccagctgcaggacgagaagacccagctgcaggaggagctggtggtgctgcaggagagactggccctgagagacagcgaccagcaggccaccagcacccagctgcagaaccaggtggagcacctgaaggagaagctgatcagccaggcccaggaggtgagcagactgagaagcgagctgggcggcaccgacctggagaagcacagagacctgctgatggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86316 - DNA, 2175 bp, Artificial Sequence
  Description of Artificial Sequence: Synthetic coding sequence
atgatcaaggtggagcacctgaaggagaagctgatcagccaggcccaggaggtgagcagactgagaagcgagctgggcggcaccgacctggagaagcacagagacctgctgatggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86317 - DNA, 2547 bp, Artificial Sequence
  Description of Artificial Sequence: Synthetic coding sequence
atgtgcgccagcgcctgcaaggacaccgccgcctggtgccccgaggaggccgccgagccccaggccatggtgcccagcagaagaacctggaacctgggcgccacccccagcctgagaggcctgtggagagtgggcagagcccccgagcccgagcccggcatggccagacccgcccccgcccccgccagccccgccgccagacccttcccccacaccggccccggcagactgagaaccggcagaggcaaggacacccccgtgtgcggcgacgaggacagcagcgccagaagcgccgccagacccgccctggcccagtgcagagccctgagcgtggactgggccggccccggcagcccccacggcctgtacctgaccctgcaggtggagcacctgaaggagaagctgatcagccaggcccaggaggtgagcagactgagaagcgagctgggcggcaccgacctggagaagcacagagacctgctgatggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgtgttccaggaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86318 - DNA, 2055 bp, Artificial Sequence
  Description of Artificial Sequence: Synthetic coding sequence
atggtggagaacgagagactgagacaggagatgagaagatgcgaggccgagctgcaggagctgagaaccaagcccgccggcccctgccccggctgcgagcacagccaggagagcgcccagctgagagacaagctgagccagctgcagctggagatggccgagagcaagggcatgctgagcgagctgaacctggaggtgcagcagaagaccgacagactggccgaggtggagctgagactgaaggactgcctggccgagaaggcccaggaggaggagagactgagcagaagactgagagacagccacgagaccatcgccagcctgagagcccagagcccccccgtgaagtacgtgatcaagaccgtggaggtggagagcagcaagaccaagcaggccctgagcgagagccaggccagaaaccagcacctgcaggagcaggtggccatgcagagacaggtgctgaaggagatggagcagcagctgcagagcagccaccagctgaccgccagactgagagcccagatcgccatgtacgagagcgagctggagagagcccacggccagatgctggaggagatgcagagcctggaggaggacaagaacagagccatcgaggaggccttcgccagagcccaggtggagatgaaggccgtgcacgagaacctggccggcgtgagaaccaacctgctgaccctgcagcccgccctgagaaccctgaccaacgactacaacggcctgaagagacaggtgagaggcttccccctgctgctgcaggaggccctgagaagcgtgaaggccgagatcggccaggccatcgaggaggtgaacagcaacaaccaggagctgctgagaaagtacagaagagagctgcagctgagaaagaagtgccacaacgagctggtgagactgaagggcaacatcagagtgatcgccagagtgagacccgtgaccaaggaggacggcgagggccccgaggccaccaacgccgtgaccttcgacgccgacgacgacagcatcatccacctgctgcacaagggcaagcccgtgagcttcgagctggacaaggtgttcagcccccaggccagccagcaggacgaggtgcaggccctggtgaccagctgcatcgacggcttcaacgtgtgcatcttcgcctacggccagaccggcgccggcaagacctacaccatggagggcaccgccgagaaccccggcatcaaccagagagccctgcagctgctgttcagcgaggtgcaggagaaggccagcgactgggagtacaccatcaccgtgagcgccgccgagatctacaacgaggtgctgagagacctgctgggcaaggagccccaggagaagctggagatcagactgtgccccgacggcagcggccagctgtacgtgcccggcctgaccgagttccaggtgcagagcgtggacgacatcaacaaggtgttcgagttcggccacaccaacagaaccaccgagttcaccaacctgaacgagcacagcagcagaagccacgccctgctgatcgtgaccgtgagaggcgtggactgcagcaccggcctgagaaccaccggcaagctgaacctggtggacctggccggcagcgagagagtgggcaagagcggcgccgagggcagcagactgagagaggcccagcacatcaacaagagcctgagcgccctgggcgacgtgatcgccgccctgagaagcagacagggccacgtgcccttcagaaacagcaagctgacctacctgctgcaggacagcctgagcggcgacagcaagaccctgatggtggtgcaggtgagccccgtggagaagaacaccagcgagaccctgtacagcctgaagttcgccgagagagtgagaagcgtggagctgggccccggcctgagaagagccgagctgggcagctggagcagccaggagcacctggagtgggagcccgcctgccagaccccccagcccagcgccagagcccacagcgcccccagcagcggcaccagcagcagacccggcagcatcagaagaaagctgcagcccagcgcctag

SEQ ID NO: 86319 - DNA, 1914 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcgacggcaccggcagcctgaagagaagcggcagcttcagcaagctgagagccagcatcagaagaagcagcgagaagctggtgagaaagctgaagggcggcagcagcagagagagcgagcccaagaaccccggcatgaagagagccagcagcctgaacgtgctgaacgtgggcggcaaggccgccgaggacagattccaggagagaaacaactgcctggccgacagcagagccctgagcgccagccacaccgacctggcccactag

SEQ ID NO: 86320 - DNA, 1920 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcgacggcaccggcagcctgaagagaagcggcagcttcagcaagctgagagccagcatcagaagaagcagcgagaagctggtgagaaagctgaagggcggcagcagcagagagagcgagcccaagaaccccggcatgaagagagccagcagcctgaacgtgctgaacgtgggcggcaaggccgccgaggacagattccagggcgtgagcggcagagccagcttctgcggcaagagacagcagcagcagtggcccggcagaagacacagatag

SEQ ID NO: 86321 - DNA, 1887 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggacggcaccggcagcctgaagagaagcggcagcttcagcaagctgagagccagcatcagaagaagcagcgagaagctggtgagaaagctgaagggcggcagcagcagagagagcgagcccaagaaccccggcatgaagagagccagcagcctgaacgtgctgaacgtgggcggcaaggccgccgaggacagattccaggagagaaacaactgcctggccgacagcagagccctgagcgccagccacaccgacctggcccactag

SEQ ID NO: 86322 - DNA, 1722 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcggcgtgagcggcagagccagcttctgcggcaagagacagcagcagcagtggcccggcagaagacacagatag

SEQ ID NO: 86323 - DNA, 1731 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagagaagcatcagcgagatccccaagaagatcctgagcgccaacggcagcaaccacttccccctgcccggcagccagggcctggacaacgtgcacaagcagagagtggccgaggtgctgaacgaccccgagaacatggagaagagaagaagcagagagagcctgaacgtggacgtggtgaagtacgagagcggccccgacggcggcgaggagatgagaaagatgaagctgggcctggtgaactag

SEQ ID NO: 86324 - DNA, 1683 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcatgagaaagatgaagctgggcctggtgaactag

SEQ ID NO: 86325 - DNA, 1755 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggagatgaagagagccagcagcctgaacgtgctgaacgtgggcggcaaggccgccgaggacagattccaggagagaaacaactgcctggccgacagcagagccctgagcgccagccacaccgacctggcccactag

SEQ ID NO: 86326 - DNA, 1857 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcgacggcaccggcagcctgaagagaagcggcagcttcagcaagctgagagccagcatcagaagaagcagcgagaagctggtgagaaagctgaagggcggcagcagcagagagagcgagcccaagaaccccggcgccagcctggccgagcccctgttcgtggagaacgacagcagcagcagcggcctggaggacgccaccgccaactag

SEQ ID NO: 86327 - DNA, 1683 bp, Artificial Sequence; identical to SEQ ID NO: 86324
  Description of Artificial Sequence: Synthetic coding sequence

SEQ ID NO: 86328 - DNA, 396 bp, Artificial Sequence
  Description of Artificial Sequence: Synthetic coding sequence
tgagagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggagatgagaaagatgaagctgggcctggtgaactag

SEQ ID NO: 86329 - DNA, 1893 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggacggcaccggcagcctgaagagaagcggcagcttcagcaagctgagagccagcatcagaagaagcagcgagaagctggtgagaaagctgaagggcggcagcagcagagagagcgagcccaagaaccccggcatgaagagagccagcagcctgaacgtgctgaacgtgggcggcaaggccgccgaggacagattccagggcgtgagcggcagagccagcttctgcggcaagagacagcagcagcagtggcccggcagaagacacagatag

SEQ ID NO: 86330 - DNA, 453 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttctag

SEQ ID NO: 86331 - DNA, 1695 bp, Artificial Sequence
  Description of Artificial Sequence: Synthetic coding sequence
atgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggagggcgtgagcggcagagccagcttctgcggcaagagacagcagcagcagtggcccggcagaagacacagatag

SEQ ID NO: 86332 - DNA, 1869 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggtgatcctggccctgagcagccacctgggcgccgtggagagcgagaagcagaagctgagagcccaggtgagaagactggtgcaggagaaccagtggctgagagaggagctggccggcacccagcagaagctgcagagaagcgagcaggccgtggcccagctggaggaggagaagcagcacctgctgttcatgagccagatcagaaagctggacgaggacgccagccccaacgaggagaagggcgacgtgcccaaggacaccctggacgacctgttccccaacgaggacgagcagagccccgcccccagccccggcggcggcgacgtgagcggccagcacggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggaggccgcccacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaagttccaccccgacgtggccaagcagctgagcaacctggccctgctgtgccagaaccagggcaaggccgaggaggtggagtactactacagaagagccctggagatctacgccaccagactgggccccgacgaccccaacgtggccaagaccaagaacaacctggccagctgctacctgaagcagggcaagtaccaggacgccgagaccctgtacaaggagatcctgaccagagcccacgagaaggagttcggcagcgtgaacggcgacaacaagcccatctggatgcacgccgaggagagagaggagagcaaggacaagagaagagacagcgccccctacggcgagtacggcagctggtacaaggcctgcaaggtggacagccccaccgtgaacaccaccctgagaagcctgggcgccctgtacagaagacagggcaagctggaggccgcccacaccctggaggactgcgccagcagaaacagaaagcagggcctggaccccgccagccagaccaaggtggtggagctgctgaaggacggcagcggcagaagaggcgacagaagaagcagcagagacatggccggcggcgccggccccagaagcgagagcgacctggaggacgtgggccccaccgccgagtggaacggcgacggcagcggcagcctgagaagaagcggcagcttcggcaagctgagagacgccctgagaagaagcagcgagatgctggtgaagaagctgcagggcggcaccccccaggagccccccaaccccagaatgaagagagccagcagcctgaacttcctgaacaagagcgtggaggagcccacccagcccggcggcaccggcctgagcgacagcagaaccctgagcagcagcagcatggacctgagcagaagaagcagcctggtgggctag

SEQ ID NO: 86333 - DNA, 1638 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggaggagaagggcgacgtgcccaaggacaccctggacgacctgttccccaacgaggacgagcagagccccgcccccagccccggcggcggcgacgtgagcggccagcacggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggaggccgcccacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaagttccaccccgacgtggccaagcagctgagcaacctggccctgctgtgccagaaccagggcaaggccgaggaggtggagtactactacagaagagccctggagatctacgccaccagactgggccccgacgaccccaacgtggccaagaccaagaacaacctggccagctgctacctgaagcagggcaagtaccaggacgccgagaccctgtacaaggagatcctgaccagagcccacgagaaggagttcggcagcgtgaacggcgacaacaagcccatctggatgcacgccgaggagagagaggagagcaaggacaagagaagagacagcgccccctacggcgagtacggcagctggtacaaggcctgcaaggtggacagccccaccgtgaacaccaccctgagaagcctgggcgccctgtacagaagacagggcaagctggaggccgcccacaccctggaggactgcgccagcagaaacagaaagcagggcctggaccccgccagccagaccaaggtggtggagctgctgaaggacggcagcggcagaagaggcgacagaagaagcagcagagacatggccggcggcgccggccccagaagcgagagcgacctggaggacgtgggccccaccgccgagtggaacggcgacggcagcggcagcctgagaagaagcggcagcttcggcaagctgagagacgccctgagaagaagcagcgagatgctggtgaagaagctgcagggcggcaccccccaggagccccccaaccccagaatgaagagagccagcagcctgaacttcctgaacaagagcgtggaggagcccacccagcccggcggcaccggcctgagcgacagcagaaccctgagcagcagcagcatggacctgagcagaagaagcagcctggtgggctag

SEQ ID NO: 86334 - DNA, 1869 bp, Artificial Sequence; identical to SEQ ID NO: 86332
  Description of Artificial Sequence: Synthetic coding sequence

SEQ ID NO: 86335 - DNA, 1869 bp, Artificial Sequence; identical to SEQ ID NO: 86332
  Description of Artificial Sequence: Synthetic coding sequence

SEQ ID NO: 86336 - DNA, 1638 bp, Artificial Sequence; identical to SEQ ID NO: 86333
  Description of Artificial Sequence: Synthetic coding sequence

SEQ ID NO: 86337 - DNA, 501 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggtgatcctggccctgagcagccacctgggcgccgtggagagcgagaagcagaagctgagagcccaggtgagaagactggtgcaggagaaccagtggctgagagaggagctggccggcacccagcagaagctgcagagaagcgagcaggccgtggcccagctggaggaggagaagcagcacctgctgttcatgagccagatcagaaagctggacgaggacgccagccccaacgaggagaagggcgacgtgcccaaggacaccctggacgactag

SEQ ID NO: 86338 - DNA, 570 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggaggagaagggcgacgtgcccaaggacaccctggacgacctgttccccaacgaggacgagcagagccccgcccccagccccggcggcggcgacgtgagcggccagcacggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggaggccgcccacctgctgaacgacgcctag

SEQ ID NO: 86339 - DNA, 516 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggtgatcctggccctgagcagccacctgggcgccgtggagagcgagaagcagaagctgagagcccaggtgagaagactggtgcaggagaaccagtggctgagagaggagctggccggcacccagcagaagctgcagagaagcgagcaggccgtggcccagctggaggaggagaagcagcacctgctgttcatgagccagatcagaaagctggacgaggacgccagccccaacgaggagaagggcgacgtgcccaaggacaccctggacgacctgttccccaacgagtag

SEQ ID NO: 86340 - DNA, 438 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggtgatcctggccctgagcagccacctgggcgccgtggagagcgagaagcagaagctgagagcccaggtgagaagactggtgcaggagaaccagtggctgagagaggagctggccggcacccagcagaagctgcagagaagcgagcaggccgtggcccagctggaggaggagaagcagcacctgctgttcatgagccagatcagaaagtag

SEQ ID NO: 86341 - DNA, 318 bp, Artificial Sequence
  Description of Artificial Sequence: Synthetic coding sequence
atggccatgatggtgttccccagagaggagaagctgagccaggacgagatcgtgctgggcaccaaggccgtgatccagggcctggagaccctgagaggcgagcacagagccctgctggcccccctggtggcccccgaggccggcgaggccgagcccggcagccaggagagatgcatcctgctgagaagaagcctggaggccatcgagctgggcctgggcgaggcccaggtgatcctggccctgagcagccacctgggcgccgtggagagcgagaagcagaagctgagagcccaggtgagaagactggtgcaggagtag

SEQ ID NO: 86342 - DNA, 1515 bp, Artificial Sequence
  Description of Artificial Sequence: Synthetic coding sequence
atgagcgtgcaggtggccgcccccggcagcgccggcctgggccccgagagactgagccccgaggagctggtgagacagaccagacaggtggtgcagggcctggaggccctgagagccgagcaccacggcctggccggccacctggccgaggccctggccggccagggccccgccgccggcctggagatgctggaggagaagcagcaggtggtgagccacagcctggaggccatcgagctgggcctgggcgaggcccaggtgctgctggccctgagcgcccacgtgggcgccctggaggccgagaagcagagactgagaagccaggccagaagactggcccaggagaacgtgtggctgagagaggagctggaggagacccagagaagactgagagccagcgaggagagcgtggcccagctggaggaggagaagagacacctggagttcctgggccagctgagacagtacgacccccccgccgagagccagcagagcgagagcccccccagaagagacagcctggccagcctgttccccagcgaggaggaggagagaaagggccccgaggccgccggcgccgccgccgcccagcagggcggctacgagatccccgccagactgagaaccctgcacaacctggtgatccagtacgccggccagggcagatacgaggtggccgtgcccctgtgcagacaggccctggaggacctggagagaagcagcggccactgccaccccgacgtggccaccatgctgaacatcctggccctggtgtacagagaccagaacaagtacaaggaggccaccgacctgctgcacgacgccctgcagatcagagagcagaccctgggccccgagcaccccgccgtggccgccaccctgaacaacctggccgtgctgtacggcaagagaggcagatacagagaggccgagcccctgtgccagagagccctggagatcagagagaaggtgctgggcgccgaccaccccgacgtggccaagcagctgaacaacctggccctgctgtgccagaaccagggcaagttcgaggacgtggagagacactacgccagagccctgagcatctacgaggccctgggcggcccccacgaccccaacgtggccaagaccaagaacaacctggccagcgcctacctgaagcagaacaagtaccagcaggccgaggagctgtacaaggagatcctgcacaaggaggacctgcccgcccccctgggcgcccccaacaccggcaccgccggcgacgccgagcaggccctgagaagaagcagcagcctgagcaagatcagagagagcatcagaagaggcagcgagaagctggtgagcagactgagaggcgaggccgccgccggcgccgccggcatgaagagagccatgagcctgaacaccctgaacgtggacgcccccagagcccccggcacccagttccccagctggcacctggacaaggcccccagaaccctgagcgccagcacccaggacctgagcccccactag

SEQ ID NO: 86343 - DNA, 1557 bp, Artificial Sequence
  Description of Artificial Sequence: Synthetic coding sequence
atgatcccccagaccccccaccactgcagccccggcgccgccatgagcgtgcaggtggccgcccccggcagcgccggcctgggccccgagagactgagccccgaggagctggtgagacagaccagacaggtggtgcagggcctggaggccctgagagccgagcaccacggcctggccggccacctggccgaggccctggccggccagggccccgccgccggcctggagatgctggaggagaagcagcaggtggtgagccacagcctggaggccatcgagctgggcctgggcgaggcccaggtgctgctggccctgagcgcccacgtgggcgccctggaggccgagaagcagagactgagaagccaggccagaagactggcccaggagaacgtgtggctgagagaggagctggaggagacccagagaagactgagagccagcgaggagagcgtggcccagctggaggaggagaagagacacctggagttcctgggccagctgagacagtacgacccccccgccgagagccagcagagcgagagcccccccagaagagacagcctggccagcctgttccccagcgaggaggaggagagaaagggccccgaggccgccggcgccgccgccgcccagcagggcggctacgagatccccgccagactgagaaccctgcacaacctggtgatccagtacgccggccagggcagatacgaggtggccgtgcccctgtgcagacaggccctggaggacctggagagaagcagcggccactgccaccccgacgtggccaccatgctgaacatcctggccctggtgtacagagaccagaacaagtacaaggaggccaccgacctgctgcacgacgccctgcagatcagagagcagaccctgggccccgagcaccccgccgtggccgccaccctgaacaacctggccgtgctgtacggcaagagaggcagatacagagaggccgagcccctgtgccagagagccctggagatcagagagaaggtgctgggcgccgaccaccccgacgtggccaagcagctgaacaacctggccctgctgtgccagaaccagggcaagttcgaggacgtggagagacactacgccagagccctgagcatctacgaggccctgggcggcccccacgaccccaacgtggccaagaccaagaacaacctggccagcgcctacctgaagcagaacaagtaccagcaggccgaggagctgtacaaggagatcctgcacaaggaggacctgcccgcccccctgggcgcccccaacaccggcaccgccggcgacgccgagcaggccctgagaagaagcagcagcctgagcaagatcagagagagcatcagaagaggcagcgagaagctggtgagcagactgagaggcgaggccgccgccggcgccgccggcatgaagagagccatgagcctgaacaccctgaacgtggacgcccccagagcccccggcacccagttccccagctggcacctggacaaggcccccagaaccctgagcgccagcacccaggacctgagcccccactag

SEQ ID NO: 86344 - DNA, 2379 bp, Artificial Sequence
  Description of Artificial Sequence: Synthetic coding sequence
atgcagggcgaggacgccagatacctgaagagaaaggtgaagggcggcaacatcgacgtgcaccccagcgagaaggccctgatcgtgcactacgaggtggaggccaccatcctgggcgagatgggcgaccccatgctgggcgagagaaaggagtgccagaagatcatcagactgaagagcctgaacgccaacaccgacatcaccagcctggccagaaaggtggtggaggagtgcaagctgatccaccccagcaagctgaacgaggtggagcagctgctgtactacctgcagaacagaagagacagcctgagcggcaaggagaagaaggagaagagcagcaagcccaaggaccccccccccttcgagggcatggagatcgacgaggtggccaacatcaacgacatggacgagtacatcgagctgctgtacgaggacatccccgacaaggtgagaggcagcgccctgatcctgcagctggccagaaaccccgacaacctggaggagctgctgctgaacgagaccgccctgggcgccctggccagagtgctgagagaggactggaagcagagcgtggagctggccaccaacatcatctacatcttcttctgcttcagcagcttcagccagttccacggcctgatcacccactacaagatcggcgccctgtgcatgaacatcatcgaccacgagctgaagagacacgagctgtggcaggaggagctgagcaagaagaagaaggccgtggacgaggaccccgagaaccagaccctgagaaaggactacgagaagaccttcaagaagtaccagggcctggtggtgaagcaggagcagctgctgagagtggccctgtacctgctgctgaacctggccgaggacaccagaaccgagctgaagatgagaaacaagaacatcgtgcacatgctggtgaaggccctggacagagacaacttcgagctgctgatcctggtggtgagcttcctgaagaagctgagcatcttcatggagaacaagaacgacatggtggagatggacatcgtggagaagctggtgaagatgatcccctgcgagcacgaggacctgctgaacatcaccctgagactgctgctgaacctgagcttcgacaccggcctgagaaacaagatggtgcaggtgggcctgctgcccaagctgaccgccctgctgggcaacgacaactacaagcagatcgccatgtgcgtgctgtaccacatcagcatggacgacagattcaagagcatgttcgcctacaccgactgcatcccccagctgatgaagatgctgttcgagtgcagcgacgagagaatcgacctggagctgatcagcttctgcatcaacctggccgccaacaagagaaacgtgcagctgatctgcgagggcaacggcctgaagatgctgatgaagagagccctgaagttcaaggaccccctgctgatgaagatgatcagaaacatcagccagcacgacggccccaccaagaacctgttcatcgactacgtgggcgacctggccgcccagatcagcaacgacgaggaggaggagttcgtgatcgagtgcctgggcaccctggccaacctgaccatccccgacctggactgggagctggtgctgaaggagtacaagctggtgccctacctgaaggacaagctgaagcccggcgccgccgaggacgacctggtgctggaggtggtgatcatgatcggcaccgtgagcatggacgacagctgcgccgccctgctggccaagagcggcatcatccccgccctgatcgagctgctgaacgcccagcaggaggacgacgagttcgtgtgccagatcatctacgtgttctaccagatggtgttccaccaggccaccagagacgtgatcatcaaggagacccaggcccccgcctacctgatcgacctgatgcacgacaagaacaacgagatcagaaaggtgtgcgacaacaccctggacatcatcgccgagtacgacgaggagtgggccaagaagatccagagcgagaagttcagatggcacaacagccagtggctggagatggtggagagcagacagatggacgagagcgagcagtacctgtacggcgacgacagaatcgagccctacatccacgagggcgacatcctggagagacccgacctgttctacaacagcgacggcctgatcgccagcgagggcgccatcagccccgacttcttcaacgactaccacctgcagaacggcgacgtggtgggccagcacagcttccccggcagcctgggcatggacggcttcggccagcccgtgggcatcctgggcagacccgccaccgcctacggcttcagacccgacgagccctactactacggctacggcagctag

SEQ ID NO: 86345 - DNA, 2259 bp, Artificial Sequence
  Description of Artificial Sequence: Synthetic coding sequence
atgggcgaccccatgctgggcgagagaaaggagtgccagaagatcatcagactgaagagcctgaacgccaacaccgacatcaccagcctggccagaaaggtggtggaggagtgcaagctgatccaccccagcaagctgaacgaggtggagcagctgctgtactacctgcagaacagaagagacagcctgagcggcaaggagaagaaggagaagagcagcaagcccaaggaccccccccccttcgagggcatggagatcgacgaggtggccaacatcaacgacatggacgagtacatcgagctgctgtacgaggacatccccgacaaggtgagaggcagcgccctgatcctgcagctggccagaaaccccgacaacctggaggagctgctgctgaacgagaccgccctgggcgccctggccagagtgctgagagaggactggaagcagagcgtggagctggccaccaacatcatctacatcttcttctgcttcagcagcttcagccagttccacggcctgatcacccactacaagatcggcgccctgtgcatgaacatcatcgaccacgagctgaagagacacgagctgtggcaggaggagctgagcaagaagaagaaggccgtggacgaggaccccgagaaccagaccctgagaaaggactacgagaagaccttcaagaagtaccagggcctggtggtgaagcaggagcagctgctgagagtggccctgtacctgctgctgaacctggccgaggacaccagaaccgagctgaagatgagaaacaagaacatcgtgcacatgctggtgaaggccctggacagagacaacttcgagctgctgatcctggtggtgagcttcctgaagaagctgagcatcttcatggagaacaagaacgacatggtggagatggacatcgtggagaagctggtgaagatgatcccctgcgagcacgaggacctgctgaacatcaccctgagactgctgctgaacctgagcttcgacaccggcctgagaaacaagatggtgcaggtgggcctgctgcccaagctgaccgccctgctgggcaacgacaactacaagcagatcgccatgtgcgtgctgtaccacatcagcatggacgacagattcaagagcatgttcgcctacaccgactgcatcccccagctgatgaagatgctgttcgagtgcagcgacgagagaatcgacctggagctgatcagcttctgcatcaacctggccgccaacaagagaaacgtgcagctgatctgcgagggcaacggcctgaagatgctgatgaagagagccctgaagttcaaggaccccctgctgatgaagatgatcagaaacatcagccagcacgacggccccaccaagaacctgttcatcgactacgtgggcgacctggccgcccagatcagcaacgacgaggaggaggagttcgtgatcgagtgcctgggcaccctggccaacctgaccatccccgacctggactgggagctggtgctgaaggagtacaagctggtgccctacctgaaggacaagctgaagcccggcgccgccgaggacgacctggtgctggaggtggtgatcatgatcggcaccgtgagcatggacgacagctgcgccgccctgctggccaagagcggcatcatccccgccctgatcgagctgctgaacgcccagcaggaggacgacgagttcgtgtgccagatcatctacgtgttctaccagatggtgttccaccaggccaccagagacgtgatcatcaaggagacccaggcccccgcctacctgatcgacctgatgcacgacaagaacaacgagatcagaaaggtgtgcgacaacaccctggacatcatcgccgagtacgacgaggagtgggccaagaagatccagagcgagaagttcagatggcacaacagccagtggctggagatggtggagagcagacagatggacgagagcgagcagtacctgtacggcgacgacagaatcgagccctacatccacgagggcgacatcctggagagacccgacctgttctacaacagcgacggcctgatcgccagcgagggcgccatcagccccgacttcttcaacgactaccacctgcagaacggcgacgtggtgggccagcacagcttccccggcagcctgggcatggacggcttcggccagcccgtgggcatcctgggcagacccgccaccgcctacggcttcagacccgacgagccctactactacggctacggcagctag

SEQ ID NO: 86346 - DNA, 2247 bp, Artificial Sequence
  Description of Artificial Sequence: Synthetic coding sequence
atgcagggcgaggacgccagatacctgaagagcatcagactgaagagcctgaacgccaacaccgacatcaccagcctggccagaaaggtggtggaggagtgcaagctgatccaccccagcaagctgaacgaggtggagcagctgctgtactacctgcagaacagaagagacagcctgagcggcaaggagaagaaggagaagagcagcaagcccaaggaccccccccccttcgagggcatggagatcgacgaggtggccaacatcaacgacatggacgagtacatcgagctgctgtacgaggacatccccgacaaggtgagaggcagcgccctgatcctgcagctggccagaaaccccgacaacctggaggagctgctgctgaacgagaccgccctgggcgccctggccagagtgctgagagaggactggaagcagagcgtggagctggccaccaacatcatctacatcttcttctgcttcagcagcttcagccagttccacggcctgatcacccactacaagatcggcgccctgtgcatgaacatcatcgaccacgagctgaagagacacgagctgtggcaggaggagctgagcaagaagaagaaggccgtggacgaggaccccgagaaccagaccctgagaaaggactacgagaagaccttcaagaagtaccagggcctggtggtgaagcaggagcagctgctgagagtggccctgtacctgctgctgaacctggccgaggacaccagaaccgagctgaagatgagaaacaagaacatcgtgcacatgctggtgaaggccctggacagagacaacttcgagctgctgatcctggtggtgagcttcctgaagaagctgagcatcttcatggagaacaagaacgacatggtggagatggacatcgtggagaagctggtgaagatgatcccctgcgagcacgaggacctgctgaacatcaccctgagactgctgctgaacctgagcttcgacaccggcctgagaaacaagatggtgcaggtgggcctgctgcccaagctgaccgccctgctgggcaacgacaactacaagcagatcgccatgtgcgtgctgtaccacatcagcatggacgacagattcaagagcatgttcgcctacaccgactgcatcccccagctgatgaagatgctgttcgagtgcagcgacgagagaatcgacctggagctgatcagcttctgcatcaacctggccgccaacaagagaaacgtgcagctgatctgcgagggcaacggcctgaagatgctgatgaagagagccctgaagttcaaggaccccctgctgatgaagatgatcagaaacatcagccagcacgacggccccaccaagaacctgttcatcgactacgtgggcgacctggccgcccagatcagcaacgacgaggaggaggagttcgtgatcgagtgcctgggcaccctggccaacctgaccatccccgacctggactgggagctggtgctgaaggagtacaagctggtgccctacctgaaggacaagctgaagcccggcgccgccgaggacgacctggtgctggaggtggtgatcatgatcggcaccgtgagcatggacgacagctgcgccgccctgctggccaagagcggcatcatccccgccctgatcgagctgctgaacgcccagcaggaggacgacgagttcgtgtgccagatcatctacgtgttctaccagatggtgttccaccaggccaccagagacgtgatcatcaaggagacccaggcccccgcctacctgatcgacctgatgcacgacaagaacaacgagatcagaaaggtgtgcgacaacaccctggacatcatcgccgagtacgacgaggagtgggccaagaagatccagagcgagaagttcagatggcacaacagccagtggctggagatggtggagagcagacagatggacgagagcgagcagtacctgtacggcgacgacagaatcgagccctacatccacgagggcgacatcctggagagacccgacctgttctacaacagcgacggcctgatcgccagcgagggcgccatcagccccgacttcttcaacgactaccacctgcagaacggcgacgtggtgggccagcacagcttccccggcagcctgggcatggacggcttcggccagcccgtgggcatcctgggcagacccgccaccgcctacggcttcagacccgacgagccctactactacggctacggcagctag

SEQ ID NO: 86347 - DNA, 2145 bp, Artificial Sequence
  Description of Artificial Sequence: Synthetic coding sequence
atgagcatcgccctgggcaacacctacagaagaagcctgagcgacagcgagaccgtgagcgtgctgcaggccagcctgtgcgaggagaagaaggagaagagcagcaagcccaaggaccccccccccttcgagggcatggagatcgacgaggtggccaacatcaacgacatggacgagtacatcgagctgctgtacgaggacatccccgacaaggtgagaggcagcgccctgatcctgcagctggccagaaaccccgacaacctggaggagctgctgctgaacgagaccgccctgggcgccctggccagagtgctgagagaggactggaagcagagcgtggagctggccaccaacatcatctacatcttcttctgcttcagcagcttcagccagttccacggcctgatcacccactacaagatcggcgccctgtgcatgaacatcatcgaccacgagctgaagagacacgagctgtggcaggaggagctgagcaagaagaagaaggccgtggacgaggaccccgagaaccagaccctgagaaaggactacgagaagaccttcaagaagtaccagggcctggtggtgaagcaggagcagctgctgagagtggccctgtacctgctgctgaacctggccgaggacaccagaaccgagctgaagatgagaaacaagaacatcgtgcacatgctggtgaaggccctggacagagacaacttcgagctgctgatcctggtggtgagcttcctgaagaagctgagcatcttcatggagaacaagaacgacatggtggagatggacatcgtggagaagctggtgaagatgatcccctgcgagcacgaggacctgctgaacatcaccctgagactgctgctgaacctgagcttcgacaccggcctgagaaacaagatggtgcaggtgggcctgctgcccaagctgaccgccctgctgggcaacgacaactacaagcagatcgccatgtgcgtgctgtaccacatcagcatggacgacagattcaagagcatgttcgcctacaccgactgcatcccccagctgatgaagatgctgttcgagtgcagcgacgagagaatcgacctggagctgatcagcttctgcatcaacctggccgccaacaagagaaacgtgcagctgatctgcgagggcaacggcctgaagatgctgatgaagagagccctgaagttcaaggaccccctgctgatgaagatgatcagaaacatcagccagcacgacggccccaccaagaacctgttcatcgactacgtgggcgacctggccgcccagatcagcaacgacgaggaggaggagttcgtgatcgagtgcctgggcaccctggccaacctgaccatccccgacctggactgggagctggtgctgaaggagtacaagctggtgccctacctgaaggacaagctgaagcccggcgccgccgaggacgacctggtgctggaggtggtgatcatgatcggcaccgtgagcatggacgacagctgcgccgccctgctggccaagagcggcatcatccccgccctgatcgagctgctgaacgcccagcaggaggacgacgagttcgtgtgccagatcatctacgtgttctaccagatggtgttccaccaggccaccagagacgtgatcatcaaggagacccaggcccccgcctacctgatcgacctgatgcacgacaagaacaacgagatcagaaaggtgtgcgacaacaccctggacatcatcgccgagtacgacgaggagtgggccaagaagatccagagcgagaagttcagatggcacaacagccagtggctggagatggtggagagcagacagatggacgagagcgagcagtacctgtacggcgacgacagaatcgagccctacatccacgagggcgacatcctggagagacccgacctgttctacaacagcgacggcctgatcgccagcgagggcgccatcagccccgacttcttcaacgactaccacctgcagaacggcgacgtggtgggccagcacagcttccccggcagcctgggcatggacggcttcggccagcccgtgggcatcctgggcagacccgccaccgcctacggcttcagacccgacgagccctactactacggctacggcagctag

SEQ ID NO: 86348 - DNA, 1485 bp, Artificial Sequence
  Description of Artificial Sequence: Synthetic coding sequence
atgagaaacaagaacatcgtgcacatgctggtgaaggccctggacagagacaacttcgagctgctgatcctggtggtgagcttcctgaagaagctgagcatcttcatggagaacaagaacgacatggtggagatggacatcgtggagaagctggtgaagatgatcccctgcgagcacgaggacctgctgaacatcaccctgagactgctgctgaacctgagcttcgacaccggcctgagaaacaagatggtgcaggtgggcctgctgcccaagctgaccgccctgctgggcaacgacaactacaagcagatcgccatgtgcgtgctgtaccacatcagcatggacgacagattcaagagcatgttcgcctacaccgactgcatcccccagctgatgaagatgctgttcgagtgcagcgacgagagaatcgacctggagctgatcagcttctgcatcaacctggccgccaacaagagaaacgtgcagctgatctgcgagggcaacggcctgaagatgctgatgaagagagccctgaagttcaaggaccccctgctgatgaagatgatcagaaacatcagccagcacgacggccccaccaagaacctgttcatcgactacgtgggcgacctggccgcccagatcagcaacgacgaggaggaggagttcgtgatcgagtgcctgggcaccctggccaacctgaccatccccgacctggactgggagctggtgctgaaggagtacaagctggtgccctacctgaaggacaagctgaagcccggcgccgccgaggacgacctggtgctggaggtggtgatcatgatcggcaccgtgagcatggacgacagctgcgccgccctgctggccaagagcggcatcatccccgccctgatcgagctgctgaacgcccagcaggaggacgacgagttcgtgtgccagatcatctacgtgttctaccagatggtgttccaccaggccaccagagacgtgatcatcaaggagacccaggcccccgcctacctgatcgacctgatgcacgacaagaacaacgagatcagaaaggtgtgcgacaacaccctggacatcatcgccgagtacgacgaggagtgggccaagaagatccagagcgagaagttcagatggcacaacagccagtggctggagatggtggagagcagacagatggacgagagcgagcagtacctgtacggcgacgacagaatcgagccctacatccacgagggcgacatcctggagagacccgacctgttctacaacagcgacggcctgatcgccagcgagggcgccatcagccccgacttcttcaacgactaccacctgcagaacggcgacgtggtgggccagcacagcttccccggcagcctgggcatggacggcttcggccagcccgtgggcatcctgggcagacccgccaccgcctacggcttcagacccgacgagccctactactacggctacggcagctag

SEQ ID NO: 86349 - DNA, 1935 bp, Artificial Sequence
  Description of Artificial Sequence: Synthetic coding sequence
atgaagctgatcaccatcctgttcctgtgcagcagactgctgctgagcctgacccaggagagccagagcgaggagatcgactgcaacgacaaggacctgttcaaggccgtggacgccgccctgaagaagtacaacagccagaaccagagcaacaaccagttcgtgctgtacagaatcaccgaggccaccaagaccgtgggcagcgacaccttctacagcttcaagtacgagatcaaggagggcgactgccccgtgcagagcggcaagacctggcaggactgcgagtacaaggacgccgccaaggccgccaccggcgagtgcaccgccaccgtgggcaagagaagcagcaccaagttcagcgtggccacccagacctgccagatcacccccgccgagggccccgtggtgaccgcccagtacgactgcctgggctgcgtgcaccccatcagcacccagagccccgacctggagcccatcctgagacacggcatccagtacttcaacaacaacacccagcacagcagcctgttcatgctgaacgaggtgaagagagcccagagacaggtggtggccggcctgaacttcagaatcacctacagcatcgtgcagaccaactgcagcaaggagaacttcctgttcctgacccccgactgcaagagcctgtggaacggcgacaccggcgagtgcaccgacaacgcctacatcgacatccagctgagaatcgccagcttcagccagaactgcgacatctaccccggcaaggacttcgtgcagccccccaccaagatctgcgtgggctgccccagagacatccccaccaacagccccgagctggaggagaccctgacccacaccatcaccaagctgaacgccgagaacaacgccaccttctacttcaagatcgacaacgtgaagaaggccagagtgcaggtggtggccggcaagaagtacttcatcgacttcgtggccagagagaccacctgcagcaaggagagcaacgaggagctgaccgagagctgcgagaccaagaagctgggccagagcctggactgcaacgccgaggtgtacgtggtgccctgggagaagaagatctaccccaccgtgaactgccagcccctgggcatgatcagcctgatgaagagaccccccggcttcagccccttcagaagcagcagaatcggcgagatcaaggaggagaccaccgtgagccccccccacaccagcatggcccccgcccaggacgaggagagagacagcggcaaggagcagggccacaccagaagacacgactggggccacgagaagcagagaaagcacaacctgggccacggccacaagcacgagagagaccagggccacggccaccagagaggccacggcctgggccacggccacgagcagcagcacggcctgggccacggccacaagttcaagctggacgacgacctggagcaccagggcggccacgtgctggaccacggccacaagcacaagcacggccacggccacggcaagcacaagaacaagggcaagaagaacggcaagcacaacggctggaagaccgagcacctggccagcagcagcgaggacagcaccacccccagcgcccagacccaggagaagaccgagggccccacccccatccccagcctggccaagcccggcgtgaccgtgaccttcagcgacttccaggacagcgacctgatcgccaccatgatgccccccatcagccccgcccccatccagagcgacgacgactggatccccgacatccagatcgaccccaacggcctgagcttcaaccccatcagcgacttccccgacaccaccagccccaagtgccccggcagaccctggaagagcgtgagcgagatcaaccccaccacccagatgaaggagagctactacttcgacctgaccgacggcctgagctag

SEQ ID NO: 86350 - DNA, 1284 bp, Artificial Sequence
  Description of Artificial Sequence: Synthetic coding sequence
atgaagctgatcaccatcctgttcctgtgcagcagactgctgctgagcctgacccaggagagccagagcgaggagatcgactgcaacgacaaggacctgttcaaggccgtggacgccgccctgaagaagtacaacagccagaaccagagcaacaaccagttcgtgctgtacagaatcaccgaggccaccaagaccgtgggcagcgacaccttctacagcttcaagtacgagatcaaggagggcgactgccccgtgcagagcggcaagacctggcaggactgcgagtacaaggacgccgccaaggccgccaccggcgagtgcaccgccaccgtgggcaagagaagcagcaccaagttcagcgtggccacccagacctgccagatcacccccgccgagggccccgtggtgaccgcccagtacgactgcctgggctgcgtgcaccccatcagcacccagagccccgacctggagcccatcctgagacacggcatccagtacttcaacaacaacacccagcacagcagcctgttcatgctgaacgaggtgaagagagcccagagacaggtggtggccggcctgaacttcagaatcacctacagcatcgtgcagaccaactgcagcaaggagaacttcctgttcctgacccccgactgcaagagcctgtggaacggcgacaccggcgagtgcaccgacaacgcctacatcgacatccagctgagaatcgccagcttcagccagaactgcgacatctaccccggcaaggacttcgtgcagccccccaccaagatctgcgtgggctgccccagagacatccccaccaacagccccgagctggaggagaccctgacccacaccatcaccaagctgaacgccgagaacaacgccaccttctacttcaagatcgacaacgtgaagaaggccagagtgcaggtggtggccggcaagaagtacttcatcgacttcgtggccagagagaccacctgcagcaaggagagcaacgaggagctgaccgagagctgcgagaccaagaagctgggccagagcctggactgcaacgccgaggtgtacgtggtgccctgggagaagaagatctaccccaccgtgaactgccagcccctgggcatgatcagcctgatgaagagaccccccggcttcagccccttcagaagcagcagaatcggcgagatcaaggaggagaccaccagccacctgagaagctgcgagtacaagggcagaccccccaaggccggcgccgagcccgccagcgagagagaggtgagctag

SEQ ID NO: 86351 - DNA, 1248 bp, Artificial Sequence
  Description of Artificial Sequence: Synthetic coding sequence
atgaagctgagcctgacccaggagagccagagcgaggagatcgactgcaacgacaaggacctgttcaaggccgtggacgccgccctgaagaagtacaacagccagaaccagagcaacaaccagttcgtgctgtacagaatcaccgaggccaccaagaccgtgggcagcgacaccttctacagcttcaagtacgagatcaaggagggcgactgccccgtgcagagcggcaagacctggcaggactgcgagtacaaggacgccgccaaggccgccaccggcgagtgcaccgccaccgtgggcaagagaagcagcaccaagttcagcgtggccacccagacctgccagatcacccccgccgagggccccgtggtgaccgcccagtacgactgcctgggctgcgtgcaccccatcagcacccagagccccgacctggagcccatcctgagacacggcatccagtacttcaacaacaacacccagcacagcagcctgttcatgctgaacgaggtgaagagagcccagagacaggtggtggccggcctgaacttcagaatcacctacagcatcgtgcagaccaactgcagcaaggagaacttcctgttcctgacccccgactgcaagagcctgtggaacggcgacaccggcgagtgcaccgacaacgcctacatcgacatccagctgagaatcgccagcttcagccagaactgcgacatctaccccggcaaggacttcgtgcagccccccaccaagatctgcgtgggctgccccagagacatccccaccaacagccccgagctggaggagaccctgacccacaccatcaccaagctgaacgccgagaacaacgccaccttctacttcaagatcgacaacgtgaagaaggccagagtgcaggtggtggccggcaagaagtacttcatcgacttcgtggccagagagaccacctgcagcaaggagagcaacgaggagctgaccgagagctgcgagaccaagaagctgggccagagcctggactgcaacgccgaggtgtacgtggtgccctgggagaagaagatctaccccaccgtgaactgccagcccctgggcatgatcagcctgatgaagagaccccccggcttcagccccttcagaagcagcagaatcggcgagatcaaggaggagaccaccagccacctgagaagctgcgagtacaagggcagaccccccaaggccggcgccgagcccgccagcgagagagaggtgagctag

SEQ ID NO: 86352 - DNA, 1176 bp, Artificial Sequence
  Description of Artificial Sequence: Synthetic coding sequence
atgaagctgatcaccatcctgttcctgtgcagcagactgctgctgagcctgacccaggagagccagagcgaggagatcgactgcaacgacaaggacctgttcaaggccgtggacgccgccctgaagaagtacaacagccagaaccagagcaacaaccagttcgtgctgtacagaatcaccgaggccaccaagaccgtgggcagcgacaccttctacagcttcaagtacgagatcaaggagggcgactgccccgtgcagagcggcaagacctggcaggactgcgagtacaaggacgccgccaaggccgccaccggcgagtgcaccgccaccgtgggcaagagaagcagcaccaagttcagcgtggccacccagacctgccagatcacccccgccgagggccccgtggtgaccgcccagtacgactgcctgggctgcgtgcaccccatcagcacccagagccccgacctggagcccatcctgagacacggcatccagtacttcaacaacaacacccagcacagcagcctgttcatgctgaacgaggtgaagagagcccagagacaggacaccggcgagtgcaccgacaacgcctacatcgacatccagctgagaatcgccagcttcagccagaactgcgacatctaccccggcaaggacttcgtgcagccccccaccaagatctgcgtgggctgccccagagacatccccaccaacagccccgagctggaggagaccctgacccacaccatcaccaagctgaacgccgagaacaacgccaccttctacttcaagatcgacaacgtgaagaaggccagagtgcaggtggtggccggcaagaagtacttcatcgacttcgtggccagagagaccacctgcagcaaggagagcaacgaggagctgaccgagagctgcgagaccaagaagctgggccagagcctggactgcaacgccgaggtgtacgtggtgccctgggagaagaagatctaccccaccgtgaactgccagcccctgggcatgatcagcctgatgaagagaccccccggcttcagccccttcagaagcagcagaatcggcgagatcaaggaggagaccaccagccacctgagaagctgcgagtacaagggcagaccccccaaggccggcgccgagcccgccagcgagagagaggtgagctag

SEQ ID NO: 86353 - DNA, 306 bp, Artificial Sequence
  Description of Artificial Sequence: Synthetic coding sequence
atggacatccccatcagcagcagagacttcagaggcctgcagctggcctgcgtggccctgggcctggtggccggcagcatcatcatcggcatcagcgtgagcaaggccgccgccgccatgggcggcgtgttcatcggcgccgccgtgctgggcagcctgagaatccacccccaccccggcgccgaccacggcgagggcagaagcagcaccaacggcaacaaggagggcgccagaagcagcctgagcaccgtgagcagaaccctggagaagctgaagcccggcaccagaggcgccgaggagtgctag

SEQ ID NO: 86354 - DNA, 375 bp, Artificial Sequence
  Description of Artificial Sequence: Synthetic coding sequence
atggacatccccatcagcagcagagacttcagaggcctgcagctggcctgcgtggccctgggcctggtggccggcagcatcatcatcggcatcagcgtgagcaaggccgccgccgccatgggcggcgtgttcatcggcgccgccgtgctgggcctgctgatcctggcctaccccttcctgaaggccagattcaacctggaccacatcctgcccaccatcggcagcctgagaatccacccccaccccggcgccgaccacggcgagggcagaagcagcaccaacggcaacaaggagggcgccagaagcagcctgagcaccgtgagcagaaccctggagaagctgaagcccggcaccagaggcgccgaggagtgctag

SEQ ID NO: 86355 - DNA, 3135 bp, Artificial Sequence
  Description of Artificial Sequence: Synthetic coding sequence
atgaagcccggctgcgccgccggcagccccggcaacgagtggatcttcttcagcaccgacgagatcaccaccagatacagaaacaccatgagcaacggcggcctgcagagaagcgtgatcctgagcgccctgatcctgctgagagccgtgaccggcttcagcggcgacggcagagccatctggagcaagaaccccaacttcacccccgtgaacgagagccagctgttcctgtacgacaccttccccaagaacttcttctggggcatcggcaccggcgccctgcaggtggagggcagctggaagaaggacggcaagggccccagcatctgggaccacttcatccacacccacctgaagaacgtgagcagcaccaacggcagcagcgacagctacatcttcctggagaaggacctgagcgccctggacttcatcggcgtgagcttctaccagttcagcatcagctggcccagactgttccccgacggcatcgtgaccgtggccaacgccaagggcctgcagtactacagcaccctgctggacgccctggtgctgagaaacatcgagcccatcgtgaccctgtaccactgggacctgcccctggccctgcaggagaagtacggcggctggaagaacgacaccatcatcgacatcttcaacgactacgccacctactgcttccagatgttcggcgacagagtgaagtactggatcaccatccacaacccctacctggtggcctggcacggctacggcaccggcatgcacgcccccggcgagaagggcaacctggccgccgtgtacaccgtgggccacaacctgatcaaggcccacagcaaggtgtggcacaactacaacacccacttcagaccccaccagaagggctggctgagcatcaccctgggcagccactggatcgagcccaacagaagcgagaacaccatggacatcttcaagtgccagcagagcatggtgagcgtgctgggctggttcgccaaccccatccacggcgacggcgactaccccgagggcatgagaaagaagctgttcagcgtgctgcccatcttcagcgaggccgagaagcacgagatgagaggcaccgccgacttcttcgccttcagcttcggccccaacaacttcaagcccctgaacaccatggccaagatgggccagaacgtgagcctgaacctgagagaggccctgaactggatcaagctggagtacaacaaccccagaatcctgatcgccgagaacggctggttcaccgacagcagagtgaagaccgaggacaccaccgccatctacatgatgaagaacttcctgagccaggtgctgcaggccatcagactggacgagatcagagtgttcggctacaccgcctggagcctgctggacggcttcgagtggcaggacgcctacaccatcagaagaggcctgttctacgtggacttcaacagcaagcagaaggagagaaagcccaagagcagcgcccactactacaagcagatcatcagagagaacggcttcagcctgaaggagagcacccccgacgtgcagggccagttcccctgcgacttcagctggggcgtgaccgagagcgtgctgaagcccgagagcgtggccagcagcccccagttcagcgacccccacctgtacgtgtggaacgccaccggcaacagactgctgcacagagtggagggcgtgagactgaagaccagacccgcccagtgcaccgacttcgtgaacatcaagaagcagctggagatgctggccagaatgaaggtgacccactacagattcgccctggactgggccagcgtgctgcccaccggcaacctgagcgccgtgaacagacaggccctgagatactacagatgcgtggtgagcgagggcctgaagctgggcatcagcgccatggtgaccctgtactaccccacccacgcccacctgggcctgcccgagcccctgctgcacgccgacggctggctgaaccccagcaccgccgaggccttccaggcctacgccggcctgtgcttccaggagctgggcgacctggtgaagctgtggatcaccatcaacgagcccaacagactgagcgacatctacaacagaagcggcaacgacacctacggcgccgcccacaacctgctggtggcccacgccctggcctggagactgtacgacagacagttcagacccagccagagaggcgccgtgagcctgagcctgcacgccgactgggccgagcccgccaacccctacgccgacagccactggagagccgccgagagattcctgcagttcgagatcgcctggttcgccgagcccctgttcaagaccggcgactaccccgccgccatgagagagtacatcgccagcaagcacagaagaggcctgagcagcagcgccctgcccagactgaccgaggccgagagaagactgctgaagggcaccgtggacttctgcgccctgaaccacttcaccaccagattcgtgatgcacgagcagctggccggcagcagatacgacagcgacagagacatccagttcctgcaggacatcaccagactgagcagccccaccagactggccgtgatcccctggggcgtgagaaagctgctgagatgggtgagaagaaactacggcgacatggacatctacatcaccgccagcggcatcgacgaccaggccctggaggacgacagactgagaaagtactacctgggcaagtacctgcaggaggtgctgaaggcctacctgatcgacaaggtgagaatcaagggctactacgccttcaagctggccgaggagaagagcaagcccagattcggcttcttcaccagcgacttcaaggccaagagcagcatccagttctacaacaaggtgatcagcagcagaggcttccccttcgagaacagcagcagcagatgcagccagacccaggagaacaccgagtgcaccgtgtgcctgttcctggtgcagaagaagcccctgatcttcctgggctgctgcttcttcagcaccctggtgctgctgctgagcatcgccatcttccagagacagaagagaagaaagttctggaaggccaagaacctgcagcacatccccctgaagaagggcaagagagtggtgagctag

SEQ ID NO: 86356 - DNA, 1389 bp, Artificial Sequence
  Description of Artificial Sequence: Synthetic coding sequence
atgggcacccaggccctgcagggcttcctgttcctgctgttcctgcccctgctgcagcccagaggcgccagcgccggcagcctgcacagccccggcctgagcgagtgcttccaggtgaacggcgccgactacagaggccaccagaacagaaccggccccagaggcgccggcagaccctgcctgttctgggaccagacccagcagcacagctacagcagcgccagcgacccccacggcagatggggcctgggcgcccacaacttctgcagaaaccccgacggcgacgtgcagccctggtgctacgtggccgagaccgaggagggcatctactggagatactgcgacatccccagctgccacatgcccggctacctgggctgcttcgtggacagcggcgccccccccgccctgagcggccccagcggcaccagcaccaagctgaccgtgcaggtgtgcctgagattctgcagaatgaagggctaccagctggccggcgtggaggccggctacgcctgcttctgcggcagcgagagcgacctggccagaggcagactggcccccgccaccgactgcgaccagatctgcttcggccaccccggccagctgtgcggcggcgacggcagactgggcgtgtacgaggtgagcgtgggcagctgccagggcaactggaccgccccccagggcgtgatctacagccccgacttccccgacgagtacggccccgacagaaactgcagctgggccctgggcccccccggcgccgccctggagctgaccttcagactgttcgagctggccgaccccagagacagactggagctgagagacgccgccagcggcagcctgctgagagccttcgacggcgccagacccccccccagcggccccctgagactgggcaccgccgccctgctgctgaccttcagaagcgacgccagaggccacgcccagggcttcgccctgacctacagaggcctgcaggacgccgccgaggaccccgaggcccccgagggcagcgcccagacccccgccgcccccctggacggcgccaacgtgagctgcagccccagacccggcgccccccccgccgccatcggcgccagagtgttcagcaccgtgaccgccgtgagcgtgctgctgctgctgctgctgggcctgctgagacccctgagaagaagaagctgcctgctggcccccggcaagggcccccccgccctgggcgccagcagaggccccagaagaagctgggccgtgtggtaccagcagcccagaggcgtggccctgccctgcagccccggcgacccccaggccgagggcagcgccgccggctacagacccctgagcgccagcagccagagcagcctgagaagcctgatcagcgccctgtag

SEQ ID NO: 86357 - DNA, 1263 bp, Artificial Sequence
  Description of Artificial Sequence: Synthetic coding sequence
atgggcacccaggccctgcagggcttcctgttcctgctgttcctgcccctgctgcagcccagaggcgccagcgccggcagcctgcacagccccggcctgagcgagtgcttccaggtgaacggcgccgactacagaggccaccagaacagaaccggccccagaggcgccggcagaccctgcctgttctgggaccagacccagcagcacagctacagcagcgccagcgacccccacggcagatggggcctgggcgcccacaacttctgcagaaaccccgacggcgacgtgcagccctggtgctacgtggccgagaccgaggagggcatctactggagatactgcgacatccccagctgccacatgcccggctacctgggctgcttcgtggacagcggcgccccccccgccctgagcggccccagcggcaccagcaccaagctgaccgtgcaggtgtgcctgagattctgcagaatgaagggctaccagctggccggcgtggaggccggctacgcctgcttctgcggcagcgagagcgacctggccagaggcagactggcccccgccaccgactgcgaccagatctgcttcggccaccccggccagctgtgcggcggcgacggcagactgggcgtgtacgaggtgagcgtgggcagctgccagggcaactggaccgccccccagggcgtgatctacagccccgacttccccgacgagtacggccccgacagaaactgcagctgggccctgggcccccccggcgccgccctggagctgaccttcagactgttcgagctggccgaccccagagacagactggagctgagagacgccgccagcggcagcctgctgagagccttcgacggcgccagacccccccccagcggccccctgagactgggcaccgccgccctgctgctgaccttcagaagcgacgccagaggccacgcccagggcttcgccctgacctacagaggcctgcaggacgccgccgaggaccccgaggcccccgagggcagcgcccagacccccgccgcccccctggacggcgccaacgtgagctgcagccccagacccggcgccccccccgccgccatcggcggcgccgtgtgctggctgagagagaagggccccagaagatggggcctgcccggcgcccccggcgaggccggcctgtgcggcaccaacagccccgagggctggccctgccccgccccccccggcacccccagactgagagtgctgcccagagccaccggcctgtag

SEQ ID NO: 86358 - DNA, 1272 bp, Artificial Sequence
  Description of Artificial Sequence: Synthetic coding sequence
atgggcacccaggccctgcagggcttcctgttcctgctgttcctgcccctgctgcagcccagaggcgccagcgccggcagcctgcacagccccggcctgagcgagtgcttccaggtgaacggcgccgactacagaggccaccagaacagaaccggccccagaggcgccggcagaccctgcctgttctgggaccagacccagcagcacagctacagcagcgccagcgacccccacggcagatggggcctgggcgcccacaacttctgcagaaaccccgacggcgacgtgcagccctggtgctacgtggccgagaccgaggagggcatctactggagatactgcgacatccccagctgccacatgcccggctacctgggctgcttcgtggacagcggcgccccccccgccctgagcggccccagcggcaccagcaccaagctgaccgtgcaggtgtgcctgagattctgcagaatgaagggctaccagctgtgcggcggcgacggcagactgggcgtgtacgaggtgagcgtgggcagctgccagggcaactggaccgccccccagggcgtgatctacagccccgacttccccgacgagtacggccccgacagaaactgcagctgggccctgggcccccccggcgccgccctggagctgaccttcagactgttcgagctggccgaccccagagacagactggagctgagagacgccgccagcggcagcctgctgagagccttcgacggcgccagacccccccccagcggccccctgagactgggcaccgccgccctgctgctgaccttcagaagcgacgccagaggccacgcccagggcttcgccctgacctacagaggcctgcaggacgccgccgaggaccccgaggcccccgagggcagcgcccagacccccgccgcccccctggacggcgccaacgtgagctgcagccccagacccggcgccccccccgccgccatcggcgccagagtgttcagcaccgtgaccgccgtgagcgtgctgctgctgctgctgctgggcctgctgagacccctgagaagaagaagctgcctgctggcccccggcaagggcccccccgccctgggcgccagcagaggccccagaagaagctgggccgtgtggtaccagcagcccagaggcgtggccctgccctgcagccccggcgacccccaggccgagggcagcgccgccggctacagacccctgagcgccagcagccagagcagcctgagaagcctgatcagcgccctgtag

SEQ ID NO: 86359 - DNA, 1146 bp, Artificial Sequence
  Description of Artificial Sequence: Synthetic coding sequence
atgggcacccaggccctgcagggcttcctgttcctgctgttcctgcccctgctgcagcccagaggcgccagcgccggcagcctgcacagccccggcctgagcgagtgcttccaggtgaacggcgccgactacagaggccaccagaacagaaccggccccagaggcgccggcagaccctgcctgttctgggaccagacccagcagcacagctacagcagcgccagcgacccccacggcagatggggcctgggcgcccacaacttctgcagaaaccccgacggcgacgtgcagccctggtgctacgtggccgagaccgaggagggcatctactggagatactgcgacatccccagctgccacatgcccggctacctgggctgcttcgtggacagcggcgccccccccgccctgagcggccccagcggcaccagcaccaagctgaccgtgcaggtgtgcctgagattctgcagaatgaagggctaccagctgtgcggcggcgacggcagactgggcgtgtacgaggtgagcgtgggcagctgccagggcaactggaccgccccccagggcgtgatctacagccccgacttccccgacgagtacggccccgacagaaactgcagctgggccctgggcccccccggcgccgccctggagctgaccttcagactgttcgagctggccgaccccagagacagactggagctgagagacgccgccagcggcagcctgctgagagccttcgacggcgccagacccccccccagcggccccctgagactgggcaccgccgccctgctgctgaccttcagaagcgacgccagaggccacgcccagggcttcgccctgacctacagaggcctgcaggacgccgccgaggaccccgaggcccccgagggcagcgcccagacccccgccgcccccctggacggcgccaacgtgagctgcagccccagacccggcgccccccccgccgccatcggcggcgccgtgtgctggctgagagagaagggccccagaagatggggcctgcccggcgcccccggcgaggccggcctgtgcggcaccaacagccccgagggctggccctgccccgccccccccggcacccccagactgagagtgctgcccagagccaccggcctgtag

SEQ ID NO: 86360 - DNA, 2211 bp, Artificial Sequence
  Description of Artificial Sequence: Synthetic coding sequence
atgggcaaccccgagaacatcgaggacgcctacgtggccgtgatcagacccaagaacaccgccagcctgaacagcagagagtacagagccaagagctacgagatcctgctgcacgaggtgcccatcgagggccagaagaagaagagaaagaaggtgctgctggagaccaagctgcagggcaacagcgagatcacccagggcatcctggactacgtggtggagaccaccaagcccatcagccccgccaaccagggcatcagaggcaagagagtggtgctgatgaagaagttccccctggacggcgagaagatgggcagagaggccagcctgttcatcgtgcccagcgtggtgaaggacaacaccaagtacacctacacccccggctgccccatcttctactgcctgcaggacatcatgagagtgtgcagcgagagcagcacccacttcgccaccctgaccgccagaatgctgatcgccctggacaagtggctggacgagagacacgcccagagccacttcatccccgccctgttcagacccagccccctggagagaatcaagaccaacgtgatcaaccccgcctacgccaccgagagcggccagaccgagaacagcctgcacatgggctacagcgccctggagatcaagagcaagatgctggccctggagaaggccgacacctgcatctacaaccccctgttcggcagcgacctgcagtacaccaacagagtggacaaggtggtgatcaacccctacttcggcctgggcgcccccgactacagcaagatccagatccccaagcaggagaagtggcagagaagcatgagcagcgtgaccgaggacaaggagagacagtgggtggacgacttccccctgcacagaagcgcctgcgagggcgacagcgagctgctgagcagactgctgagcgagagattcagcgtgaaccagctggacagcgaccactgggcccccatccactacgcctgctggtacggcaaggtggaggccaccagaatcctgctggagaagggcaagtgcaaccccaacctgctgaacggccagctgagcagccccctgcacttcgccgccggcggcggccacgccgagatcgtgcagatcctgctgaaccaccccgagaccgacagacacatcaccgaccagcagggcagaagccccctgaacatctgcgaggagaacaagcagaacaactgggaggaggccgccaagctgctgaaggaggccatcaacaagccctacgagaaggtgagaatctacagaatggacggcagctacagaagcgtggagctgaagcacggcaacaacaccaccgtgcagcagatcatggagggcatgagactgagccaggagacccagcagtacttcaccatctggatctgcagcgagaacctgagcctgcagctgaagccctaccacaagcccctgcagcacgtgagagactggcccgagatcctggccgagctgaccaacctggacccccagagagagaccccccagctgttcctgagaagagacgtgagactgcccctggaggtggagaagcagatcgaggaccccctggccatcctgatcctgttcgacgaggccagatacaacctgctgaagggcttctacaccgcccccgacgccaagctgatcaccctggccagcctgctgctgcagatcgtgtacggcaactacgagagcaagaagcacaagcagggcttcctgaacgaggagaacctgaagagcatcgtgcccgtgaccaagctgaagagcaaggccccccactggaccaacagaatcctgcacgagtacaagaacctgagcaccagcgagggcgtgagcaaggagatgcaccacctgcagagaatgttcctgcagaactgctgggagatccccacctacggcgccgccttcttcaccggccagatcttcaccaaggccagccccagcaaccacaaggtgatccccgtgtacgtgggcgtgaacatcaagggcctgcacctgctgaacatggagaccaaggccctgctgatcagcctgaagtacggctgcttcatgtggcagctgggcgacaccgacacctgcttccagatccacagcatggagaacaagatgagcttcatcgtgcacaccaagcaggccggcctggtggtgaagctgctgatgaagctgaacggccagctgatgcccaccgagagaaacagctag

SEQ ID NO: 86361 - DNA, 3624 bp, Artificial Sequence
  Description of Artificial Sequence: Synthetic coding sequence
atggacctgcacatgatgaactgcgagctgctggccacctgcagcgccctgggctacctggagggcgacacctaccacaaggagcccgactgcctggagagcgtgaaggacctgatcagatacctgagacacgaggacgagaccagagacgtgagacagcagctgggcgccgcccagatcctgcagagcgacctgctgcccatcctgacccagcaccaccaggacaagcccctgttcgacgccgtgatcagactgatggtgaacctgacccagcccgccctgctgtgcttcggcaacctgcccaaggagcccagcttcagacaccacttcctgcaggtgctgacctacctgcaggcctacaaggaggccttcgccagcgagaaggccttcggcgtgctgagcgagaccctgtacgagctgctgcagctgggctgggaggagagacaggaggaggacaacctgctgatcgagagaatcctgctgctggtgagaaacatcctgcacgtgcccgccgacctggaccaggagaagatcgacgacgacgccagcgcccacgaccagctgctgtgggccatccacctgagcggcctggacgacctgctgctgttcctggccagcagcagcgccgaggagcagtggagcctgcacgtgctggagatcgtgagcctgatgttcagagaccagaaccccgagcagctggccggcgtgggccagggcagactggcccaggagagaagcgccgacttcgccgagctggaggtgctgagacagagagagatggccgagaagaagaccagagccctgcagagaggcaacagacacagcagattcggcggcagctacatcgtgcagggcctgaagagcatcggcgagagagacctgatcttccacaagggcctgcacaacctgagaaactacagcagcgacctgggcaagcagcccaagaaggtgcccaagagaagacaggccgccagagagctgagcatccagagaagaagcgccctgaacgtgagactgttcctgagagacttctgcagcgagttcctggagaactgctacaacagactgatgggcagcgtgaaggaccacctgctgagagagaaggcccagcagcacgacgagacctactacatgtgggccctggccttcttcatggccttcaacagagccgccagcttcagacccggcctggtgagcgagaccctgagcgtgagaaccttccacttcatcgagcagaacctgaccaactactacgagatgatgctgaccgacagaaaggaggccgccagctgggccagaagaatgcacctggccctgaaggcctaccaggagctgctggccaccgtgaacgagatggacatcagccccgacgaggccgtgagagagagcagcagaatcatcaagaacaacatcttctacgtgatggagtacagagagctgttcctggccctgttcagaaagttcgacgagagatgccagcccagaagcttcctgagagacctggtggagaccacccacctgttcctgaagatgctggagagattctgcagaagcagaggcaacctggtggtgcagaacaagcagaagaagagaagaaagaagaagaagaaggtgctggaccaggccatcgtgagcggcaacgtgcccagcagccccgaggaggtggaggccgtgtggcccgccctggccgagcagctgcagtgctgcgcccagaacagcgagctgagcatggacagcgtggtgcccttcgacgccgccagcgaggtgcccgtggaggagcagagagccgaggccatggtgagaatccaggactgcctgctggccggccaggccccccaggccctgaccctgctgagaagcgccagagaggtgtggcccgagggcgacgtgttcggcagccaggacatcagccccgaggaggagatccagctgctgaagcagatcctgagcgcccccctgcccagacagcagggccccgaggagagaggcgccgaggaggaggaggaggaggaggaggaggaggaggaggagctgcaggtggtgcaggtgagcgagaaggagttcaacttcctggactacctgaagagattcgcctgcagcaccgtggtgagagcctacgtgctgctgctgagaagctaccagcagaacagcgcccacaccaaccactgcatcgtgaagatgctgcacagactggcccacgacctgaagatggaggccctgctgttccagctgagcgtgttctgcctgttcaacagactgctgagcgaccccgccgccggcgcctacaaggagctggtgaccttcgccaagtacatcctgggcaagttcttcgccctggccgccgtgaaccagaaggccttcgtggagctgctgttctggaagaacaccgccgtggtgagagagatgaccgagggctacggcagcctggacgacagaagcagcagcagaagagcccccacctggagccccgaggaggaggcccacctgagagagctgtacctggccaacaaggacgtggagggccaggacgtggtggaggccatcctggcccacctgaacaccgtgcccagaaccagaaagcagatcatccaccacctggtgcagatgggcctggccgacagcgtgaaggacttccagagaaagggcacccacatcgtgctgtggaccggcgaccaggagctggagctgcagagactgttcgaggagttcagagacagcgacgacgtgctgggccacatcatgaagaacatcaccgccaagagaagcagagccagaatcgtggacaagctgctggccctgggcctggtggccgagagaagagagctgtacaagaagagacagaagaagctggccagcagcatcctgcccaacggcgccgagagcctgaaggacttctgccaggaggacctggaggaggaggagaacctgcccgaggaggacagcgaggaggaggaggagggcggcagcgaggccgagcaggtgcagggcagcctggtgctgagcaacgagaacctgggccagagcctgcaccaggagggcttcagcatccccctgctgtggctgcagaactgcctgatcagagccgccgacgacagagaggaggacggctgcagccaggccgtgcccctggtgcccctgaccgaggagaacgaggaggccatggagaacgagcagttccagcagctgctgagaaagctgggcgtgagaccccccgccagcggccaggagaccttctggagaatccccgccaagctgagccccacccagctgagaagagccgccgccagcctgagccagcccgaggaggagcagaagctgcagcccgagctgcagcccaaggtgcccggcgagcagggcagcgacgaggagcactgcaaggagcacagagcccaggccctgagagccctgctgctggcccacaagaagaaggccggcctggccagccccgaggaggaggacgccgtgggcaaggagcccctgaaggccgcccccaagaagagacagctgctggacagcgacgaggagcaggaggaggacgagggcagaaacagagcccccgagctgggcgcccccggcatccagaagaagaagagataccagatcgaggacgacgaggacgactag

SEQ ID NO: 86362 - DNA, 1539 bp, Artificial Sequence
  Description of Artificial Sequence: Synthetic coding sequence
atgcacacccccgacttcgccggccccgacgacgccagagccgtggacatcatggacatctgcgagagcatcctggagagaaagagacacgacagcgagagaagcacctgcagcatcctggagcagaccgacatggaggccgtggaggccctggtgtgcatgagcagctggggccagagaagccagaagggcgacctgctgagaatcagacccctgacccccgtgagcgacagcggcgacgtgaccaccaccgtgcacatggacgccgccacccccgagctgcccaaggacttccacagcctgagcaccctgtgcatcacccccccccagagccccgacctggtggagcccagcaccagaacccccgtgagcccccaggtgaccgacagcaaggcctgcaccgccaccgacgtgctgcagagcagcgccgtggtggccagagccctgagcggcggcgccgagagaggcctgctgggcctggagcccgtgcccagcagcccctgcagagccaagggcaccagcgtgatcagacacaccggcgagagccccgccgcctgcttccccaccatccagacccccgactgcagactgagcgacagcagagagggcgaggagcagctgctgggccacttcgagaccctgcaggacacccacctgaccgacagcctgctgagcaccaacctggtgagctgccagccctgcctgcacaagagcggcggcctgctgctgaccgacaagggccagcaggccggctggcccggcgccgtgcagacctgcagccccaagaactacgagaacgacctgcccagaaagaccacccccctgatcagcgtgagcgtgcccgccccccccgtgctgtgccagatgatccccgtgaccggccagagcagcatgctgcccgccttcctgaagccccccccccagctgagcgtgggcaccgtgagacccatcctggcccaggccgcccccgccccccagcccgtgttcgtgggccccgccgtgccccagggcgccgtgatgctggtgctgccccagggcgccctgcccccccccgccccctgcgccgccaacgtgatggccgccggcaacaccaagctgctgcccctggcccccgcccccgtgttcatcaccagcagccagaactgcgtgccccaggtggacttcagcagaagaagaaactacgtgtgcagcttccccggctgcagaaagacctacttcaagagcagccacctgaaggcccacctgagaacccacaccggcgagaagcccttcaactgcagctgggacggctgcgacaagaagttcgccagaagcgacgagctgagcagacacagaagaacccacaccggcgagaagaagttcgtgtgccccgtgtgcgacagaagattcatgagaagcgaccacctgaccaagcacgccagaagacacatgaccaccaagaagatccccggctggcaggccgaggtgggcaagctgaacagaatcgccagcgccgagagccccggcagccccctggtgagcatgcccgccagcgcctag

SEQ ID NO: 86363 - DNA, 1488 bp, Artificial Sequence
  Description of Artificial Sequence: Synthetic coding sequence
atggacatctgcgagagcatcctggagagaaagagacacgacagcgagagaagcacctgcagcatcctggagcagaccgacatggaggccgtggaggccctggtgtgcatgagcagctggggccagagaagccagaagggcgacctgctgagaatcagacccctgacccccgtgagcgacagcggcgacgtgaccaccaccgtgcacatggacgccgccacccccgagctgcccaaggacttccacagcctgagcaccctgtgcatcacccccccccagagccccgacctggtggagcccagcaccagaacccccgtgagcccccaggtgaccgacagcaaggcctgcaccgccaccgacgtgctgcagagcagcgccgtggtggccagagccctgagcggcggcgccgagagaggcctgctgggcctggagcccgtgcccagcagcccctgcagagccaagggcaccagcgtgatcagacacaccggcgagagccccgccgcctgcttccccaccatccagacccccgactgcagactgagcgacagcagagagggcgaggagcagctgctgggccacttcgagaccctgcaggacacccacctgaccgacagcctgctgagcaccaacctggtgagctgccagccctgcctgcacaagagcggcggcctgctgctgaccgacaagggccagcaggccggctggcccggcgccgtgcagacctgcagccccaagaactacgagaacgacctgcccagaaagaccacccccctgatcagcgtgagcgtgcccgccccccccgtgctgtgccagatgatccccgtgaccggccagagcagcatgctgcccgccttcctgaagccccccccccagctgagcgtgggcaccgtgagacccatcctggcccaggccgcccccgccccccagcccgtgttcgtgggccccgccgtgccccagggcgccgtgatgctggtgctgccccagggcgccctgcccccccccgccccctgcgccgccaacgtgatggccgccggcaacaccaagctgctgcccctggcccccgcccccgtgttcatcaccagcagccagaactgcgtgccccaggtggacttcagcagaagaagaaactacgtgtgcagcttccccggctgcagaaagacctacttcaagagcagccacctgaaggcccacctgagaacccacaccggcgagaagcccttcaactgcagctgggacggctgcgacaagaagttcgccagaagcgacgagctgagcagacacagaagaacccacaccggcgagaagaagttcgtgtgccccgtgtgcgacagaagattcatgagaagcgaccacctgaccaagcacgccagaagacacatgaccaccaagaagatccccggctggcaggccgaggtgggcaagctgaacagaatcgccagcgccgagagccccggcagccccctggtgagcatgcccgccagcgcctag

SEQ ID NO: 86364 - DNA, 1488 bp, Artificial Sequence; identical to SEQ ID NO: 86363
  Description of Artificial Sequence: Synthetic coding sequence

SEQ ID NO: 86365 - DNA, 1209 bp, Artificial Sequence
  Description of Artificial Sequence: Synthetic coding sequence
atcagcgtgcacctgatgagaaagcacgtgaagaacatcaacaccttcgagaacagaatgctgatgctggacggcatgcccgccgtgagagtgaagaccgagctgctggagagcgagcagggcagccccaacgtgcacaactaccccgacatggaggccgtgcccctgctgctgaacaacgtgaagggcgagccccccgaggacagcctgagcgtggaccacttccagacccagaccgagcccgtggacctgagcatcaacaaggccagaaccagccccaccgccgtgagcagcagccccgtgagcatgaccgccagcgccagcagccccagcagcaccagcaccagcagcagcagcagcagcagactggccagcagccccaccgtgatcaccagcgtgagcagcgccagcagcagcagcaccgtgctgacccccggccccctggtggccagcgccagcggcgtgggcggccagcagttcctgcacatcatccaccccgtgccccccagcagccccatgaacctgcagagcaacaagctgagccacgtgcacagaatccccgtggtggtgcagagcgtgcccgtggtgtacaccgccgtgagaagccccggcaacgtgaacaacaccatcgtggtgcccctgctggaggacggcagaggccacggcaaggcccagatggaccccagaggcctgagccccagacagagcaagagcgacagcgacgacgacgacctgcccaacgtgaccctggacagcgtgaacgagaccggcagcaccgccctgagcatcgccagagccgtgcaggaggtgcaccccagccccgtgagcagagtgagaggcaacagaatgaacaaccagaagttcccctgcagcatcagccccttcagcatcgagagcaccagaagacagagaagaagcgagagccccgacagcagaaagagaagaatccacagatgcgacttcgagggctgcaacaaggtgtacaccaagagcagccacctgaaggcccacagaagaacccacaccggcgagaagccctacaagtgcacctgggagggctgcacctggaagttcgccagaagcgacgagctgaccagacactacagaaagcacaccggcgtgaagcccttcaagtgcgccgactgcgacagaagcttcagcagaagcgaccacctggccctgcacagaagaagacacatgctggtgtag

SEQ ID NO: 86366 - DNA, 1209 bp, Artificial Sequence
  Description of Artificial Sequence: Synthetic coding sequence
atgaacatccacatgaagagaaagaccatcaagaacatcaacaccttcgagaacagaatgctgatgctggacggcatgcccgccgtgagagtgaagaccgagctgctggagagcgagcagggcagccccaacgtgcacaactaccccgacatggaggccgtgcccctgctgctgaacaacgtgaagggcgagccccccgaggacagcctgagcgtggaccacttccagacccagaccgagcccgtggacctgagcatcaacaaggccagaaccagccccaccgccgtgagcagcagccccgtgagcatgaccgccagcgccagcagccccagcagcaccagcaccagcagcagcagcagcagcagactggccagcagccccaccgtgatcaccagcgtgagcagcgccagcagcagcagcaccgtgctgacccccggccccctggtggccagcgccagcggcgtgggcggccagcagttcctgcacatcatccaccccgtgccccccagcagccccatgaacctgcagagcaacaagctgagccacgtgcacagaatccccgtggtggtgcagagcgtgcccgtggtgtacaccgccgtgagaagccccggcaacgtgaacaacaccatcgtggtgcccctgctggaggacggcagaggccacggcaaggcccagatggaccccagaggcctgagccccagacagagcaagagcgacagcgacgacgacgacctgcccaacgtgaccctggacagcgtgaacgagaccggcagcaccgccctgagcatcgccagagccgtgcaggaggtgcaccccagccccgtgagcagagtgagaggcaacagaatgaacaaccagaagttcccctgcagcatcagccccttcagcatcgagagcaccagaagacagagaagaagcgagagccccgacagcagaaagagaagaatccacagatgcgacttcgagggctgcaacaaggtgtacaccaagagcagccacctgaaggcccacagaagaacccacaccggcgagaagccctacaagtgcacctgggagggctgcacctggaagttcgccagaagcgacgagctgaccagacactacagaaagcacaccggcgtgaagcccttcaagtgcgccgactgcgacagaagcttcagcagaagcgaccacctggccctgcacagaagaagacacatgctggtgtag

SEQ ID NO: 86367 - DNA, 1209 bp, Artificial Sequence; identical to SEQ ID NO: 86366
  Description of Artificial Sequence: Synthetic coding sequence

SEQ ID NO: 86368 - DNA, 867 bp, Artificial Sequence
  Description of Artificial Sequence: Synthetic coding sequence
atggccgccgccgcctacgtggaccacttcgccgccgagtgcctggtgagcatgagcagcagagccgtggtgcacggccccagagagggccccgagagcagacccgagggcgccgccgtggccgccacccccaccctgcccagagtggaggagagaagagacggcaaggacagcgccagcctgttcgtggtggccagaatcctggccgacctgaaccagcaggcccccgcccccgcccccgccgagagaagagagggcgccgccgccagaaaggccagaaccccctgcagactgcccccccccgcccccgagcccaccagccccggcgccgagggcgccgccgccgccccccccagccccgcctggagcgagcccgagcccgaggccggcctggagcccgagagagagcccggccccgccggcagcggcgagcccggcctgagacagagagtgagaagaggcagaagcagagccgacctggagagcccccagagaaagcacaagtgccactacgccggctgcgagaaggtgtacggcaagagcagccacctgaaggcccacctgagaacccacaccggcgagagacccttcgcctgcagctggcaggactgcaacaagaagttcgccagaagcgacgagctggccagacactacagaacccacaccggcgagaagaagttcagctgccccatctgcgagaagagattcatgagaagcgaccacctgaccaagcacgccagaagacacgccaacttccaccccggcatgctgcagagaagaggcggcggcagcagaaccggcagcctgagcgactacagcagaagcgacgccagcagccccaccatcagccccgccagcagcccctag

SEQ ID NO: 86369 - DNA, 1251 bp, Artificial Sequence
  Description of Artificial Sequence: Synthetic coding sequence
atggtggaccacctgctgcccgtggacgagaacttcagcagccccaagtgccccgtgggctacctgggcgacagactggtgggcagaagagcctaccacatgctgcccagccccgtgagcgaggacgacagcgacgccagcagcccctgcagctgcagcagccccgacagccaggccctgtgcagctgctacggcggcggcctgggcaccgagagccaggacagcatcctggacttcctgctgagccaggccaccctgggcagcggcggcggcagcggcagcagcatcggcgccagcagcggccccgtggcctggggcccctggagaagagccgccgcccccgtgaagggcgagcacttctgcctgcccgagttccccctgggcgaccccgacgacgtgcccagacccttccagcccaccctggaggagatcgaggagttcctggaggagaacatggagcccggcgtgaaggaggtgcccgagggcaacagcaaggacctggacgcctgcagccagctgagcgccggcccccacaagagccacctgcaccccggcagcagcggcagagagagatgcagccccccccccggcggcgccagcgccggcggcgcccagggccccggcggcggccccacccccgacggccccatccccgtgctgctgcagatccagcccgtgcccgtgaagcaggagagcggcaccggccccgccagccccggccaggcccccgagaacgtgaaggtggcccagctgctggtgaacatccagggccagaccttcgccctggtgccccaggtggtgcccagcagcaacctgaacctgcccagcaagttcgtgagaatcgcccccgtgcccatcgccgccaagcccgtgggcagcggccccctgggccccggccccgccggcctgctgatgggccagaagttccccaagaaccccgccgccgagctgatcaagatgcacaagtgcaccttccccggctgcagcaagatgtacaccaagagcagccacctgaaggcccacctgagaagacacaccggcgagaagcccttcgcctgcacctggcccggctgcggctggagattcagcagaagcgacgagctgagcagacacagaagaagccacagcggcgtgaagccctaccagtgccccgtgtgcgagaagaagttcgccagaagcgaccacctgagcaagcacatcaaggtgcacagattccccagaagcagcagaagcgtgagaagcgtgaactag

SEQ ID NO: 86370 - DNA, 1068 bp, Artificial Sequence
  Description of Artificial Sequence: Synthetic coding sequence
atggccctgagcgagcccatcctgcccagcttcagcaccttcgccagcccctgcagagagagaggcctgcaggagagatggcccagagccgagcccgagagcggcggcaccgacgacgacctgaacagcgtgctggacttcatcctgagcatgggcctggacggcctgggcgccgaggccgcccccgagccccccccccccccccccccccccgccttctactaccccgagcccggcgccccccccccctacagcgcccccgccggcggcctggtgagcgagctgctgagacccgagctggacgcccccctgggccccgccctgcacggcagattcctgctggccccccccggcagactggtgaaggccgagccccccgaggccgacggcggcggcggctacggctgcgcccccggcctgaccagaggccccagaggcctgaagagagagggcgcccccggccccgccgccagctgcatgagaggccccggcggcagacccccccccccccccgacaccccccccctgagccccgacggccccgccagactgcccgcccccggccccagagccagcttccccccccccttcggcggccccggcttcggcgcccccggccccggcctgcactacgccccccccgccccccccgccttcggcctgttcgacgacgccgccgccgccgccgccgccctgggcctggccccccccgccgccagaggcctgctgaccccccccgccagccccctggagctgctggaggccaagcccaagagaggcagaagaagctggcccagaaagagaaccgccacccacacctgcagctacgccggctgcggcaagacctacaccaagagcagccacctgaaggcccacctgagaacccacaccggcgagaagccctaccactgcaactgggacggctgcggctggaagttcgccagaagcgacgagctgaccagacactacagaaagcacaccggccacagacccttccagtgccacctgtgcgacagagccttcagcagaagcgaccacctggccctgcacatgaagagacacatgtag

SEQ ID NO: 86371 - DNA, 234 bp, Artificial Sequence
  Description of Artificial Sequence: Synthetic coding sequence
atggacgtgctgcccatgtgcagcatcttccaggagctgcagatcgtgcacgagaccggctacttcagcgccctgcccagcctggaggagtactggcagcagacctgcctggagctggagagatacctgcagagcgagccctgctacgtgagcgccagcgagatcaagttcgacagccaggagagcgtggaccagaaccactggctgggcagaaagagaagaaaccccaactag

SEQ ID NO: 86372 - DNA, 846 bp, Artificial Sequence
  Description of Artificial Sequence: Synthetic coding sequence
atggacgtgctgcccatgtgcagcatcttccaggagctgcagatcgtgcacgagaccggctacttcagcgccctgcccagcctggaggagtactggcagcagacctgcctggagctggagagatacctgcagagcgagccctgctacgtgagcgccagcgagatcaagttcgacagccaggaggacctgtggaccaagatcatcctggccagagagaagaaggaggagagcgagctgaagatcagcagcagcccccccgaggacaccctgatcagccccagcttctgctacaacctggagaccaacagcctgaacagcgacgtgagcagcgagagcagcgacagcagcgaggagctgagccccaccgccaagttcaccagcgaccccatcggcgaggtgctggtgagcagcggcaagctgagcagcagcgtgaccagcaccccccccagcagccccgagctgagcagagagcccagccagctgtggggctgcgtgcccggcgagctgcccagccccggcaaggtgagaagcggcaccagcggcaagcccggcgacaagggcaacggcgacgccagccccgacggcagaagaagagtgcacagatgccacttcaacggctgcagaaaggtgtacaccaagagcagccacctgaaggcccaccagagaacccacaccggccagtgccccagaggccccagaagagccgccgccggcggcagacactgcatcgcccccgccctggagggcgccggccccggctgcaccggctgcggccagggcagacagatcctgaccagcagcgacgtgttccaccagagcatcagaagcttctggagcagcgagtag

SEQ ID NO: 86373 - DNA, 852 bp, Artificial Sequence
  Description of Artificial Sequence: Synthetic coding sequence
atggacgtgctgcccatgtgcagcatcttccaggagctgcagatcgtgcacgagaccggctacttcagcgccctgcccagcctggaggagtactggcagcagacctgcctggagctggagagatacctgcagagcgagccctgctacgtgagcgccagcgagatcaagttcgacagccaggaggacctgtggaccaagatcatcctggccagagagaagaaggaggagagcgagctgaagatcagcagcagcccccccgaggacaccctgatcagccccagcttctgctacaacctggagaccaacagcctgaacagcgacgtgagcagcgagagcagcgacagcagcgaggagctgagccccaccgccaagttcaccagcgaccccatcggcgaggtgctggtgagcagcggcaagctgagcagcagcgtgaccagcaccccccccagcagccccgagctgagcagagagcccagccagctgtggggctgcgtgcccggcgagctgcccagccccggcaaggtgagaagcggcaccagcggcaagcccggcgacaagggcaacggcgacgccagccccgacggcagaagaagagtgcacagatgccacttcaacggctgcagaaaggtgtacaccaagagcagccacctgaaggcccaccagagaacccacaccggcgagaagccctacagatgcagctgggagggctgcgagtggagattcgccagaagcgacgagctgaccagacacttcagaaagcacaccggcgccaagcccttcaagtgcagccactgcgacagatgcttcagcagaagcgaccacctggccctgcacatgaagagacacctgtag

SEQ ID NO: 86374 - DNA, 714 bp, Artificial Sequence
  Description of Artificial Sequence: Synthetic coding sequence
atggacgtgctgcccatgtgcagcatcttccaggagctgcagatcgtgcacgagaccggctacttcagcgccctgcccagcctggaggagtactggcagcagacctgcctggagctggagagatacctgcagagcgagccctgctacgtgagcgccagcgagatcaagttcgacagccaggaggacctgtggaccaagatcatcctggccagagagaagaaggaggagagcgagctgaagatcagcagcagcccccccgaggacaccctgatcagccccagcttctgctacaacctggagaccaacagcctgaacagcgacgtgagcagcgagagcagcgacagcagcgaggagctgagccccaccgccaagttcaccagcgaccccatcggcgaggtgctggtgagcagcggcaagctgagcagcagcgtgaccagcaccccccccagcagccccgagctgagcagagagcccagccagctgtggggctgcgtgcccggcgagctgcccagccccggcaaggtgagaagcggcaccagcggcaagcccggcgacaagggcaacggcgacgccagccccgacggcagaagaagagtgcacagatgccacttcaacggctgcagaaaggtgtacaccaagagcagccacctgaaggcccaccagagaacccacaccggcgtgttccccggcctgaccacctggccctgcacctag

SEQ ID NO: 86375 - DNA, 909 bp, Artificial Sequence
  Description of Artificial Sequence: Synthetic coding sequence
atggacgtgctggccagctacagcatcttccaggagctgcagctggtgcacgacaccggctacttcagcgccctgcccagcctggaggagacctggcagcagacctgcctggagctggagagatacctgcagaccgagcccagaagaatcagcgagaccttcggcgaggacctggactgcttcctgcacgccagcccccccccctgcatcgaggagagcttcagaagactggaccccctgctgctgcccgtggaggccgccatctgcgagaagagcagcgccgtggacatcctgctgagcagagacaagctgctgagcgagacctgcctgagcctgcagcccgccagcagcagcctggacagctacaccgccgtgaaccaggcccagctgaacgccgtgaccagcctgaccccccccagcagccccgagctgagcagacacctggtgaagaccagccagaccctgagcgccgtggacggcaccgtgaccctgaagctggtggccaagaaggccgccctgagcagcgtgaaggtgggcggcgtggccaccgccgccgccgccgtgaccgccgccggcgccgtgaagagcggccagagcgacagcgaccagggcggcctgggcgccgaggcctgccccgagaacaagaagagagtgcacagatgccagttcaacggctgcagaaaggtgtacaccaagagcagccacctgaaggcccaccagagaacccacaccggcgagaagccctacaagtgcagctgggagggctgcgagtggagattcgccagaagcgacgagctgaccagacactacagaaagcacaccggcgccaagcccttcaagtgcaaccactgcgacagatgcttcagcagaagcgaccacctggccctgcacatgaagagacacatctag

SEQ ID NO: 86376 - DNA, 825 bp, Artificial Sequence
  Description of Artificial Sequence: Synthetic coding sequence
atgttccccagctggcccacctgcctggagctggagagatacctgcagaccgagcccagaagaatcagcgagaccttcggcgaggacctggactgcttcctgcacgccagcccccccccctgcatcgaggagagcttcagaagactggaccccctgctgctgcccgtggaggccgccatctgcgagaagagcagcgccgtggacatcctgctgagcagagacaagctgctgagcgagacctgcctgagcctgcagcccgccagcagcagcctggacagctacaccgccgtgaaccaggcccagctgaacgccgtgaccagcctgaccccccccagcagccccgagctgagcagacacctggtgaagaccagccagaccctgagcgccgtggacggcaccgtgaccctgaagctggtggccaagaaggccgccctgagcagcgtgaaggtgggcggcgtggccaccgccgccgccgccgtgaccgccgccggcgccgtgaagagcggccagagcgacagcgaccagggcggcctgggcgccgaggcctgccccgagaacaagaagagagtgcacagatgccagttcaacggctgcagaaaggtgtacaccaagagcagccacctgaaggcccaccagagaacccacaccggcgagaagccctacaagtgcagctgggagggctgcgagtggagattcgccagaagcgacgagctgaccagacactacagaaagcacaccggcgccaagcccttcaagtgcaaccactgcgacagatgcttcagcagaagcgaccacctggccctgcacatgaagagacacatctag

SEQ ID NO: 86377 - DNA, 810 bp, Artificial Sequence
  Description of Artificial Sequence: Synthetic coding sequence
atgacctgcctggagctggagagatacctgcagaccgagcccagaagaatcagcgagaccttcggcgaggacctggactgcttcctgcacgccagcccccccccctgcatcgaggagagcttcagaagactggaccccctgctgctgcccgtggaggccgccatctgcgagaagagcagcgccgtggacatcctgctgagcagagacaagctgctgagcgagacctgcctgagcctgcagcccgccagcagcagcctggacagctacaccgccgtgaaccaggcccagctgaacgccgtgaccagcctgaccccccccagcagccccgagctgagcagacacctggtgaagaccagccagaccctgagcgccgtggacggcaccgtgaccctgaagctggtggccaagaaggccgccctgagcagcgtgaaggtgggcggcgtggccaccgccgccgccgccgtgaccgccgccggcgccgtgaagagcggccagagcgacagcgaccagggcggcctgggcgccgaggcctgccccgagaacaagaagagagtgcacagatgccagttcaacggctgcagaaaggtgtacaccaagagcagccacctgaaggcccaccagagaacccacaccggcgagaagccctacaagtgcagctgggagggctgcgagtggagattcgccagaagcgacgagctgaccagacactacagaaagcacaccggcgccaagcccttcaagtgcaaccactgcgacagatgcttcagcagaagcgaccacctggccctgcacatgaagagacacatctag

SEQ ID NO: 86378 - DNA, 339 bp, Artificial Sequence
  Description of Artificial Sequence: Synthetic coding sequence
atggacgtgctggccagctacagcatcttccaggagctgcagctggtgcacgacaccggctacttcagcgccctgcccagcctggaggagacctggcagcagacctgcctggagctggagagatacctgcagaccgagcccagaagaatcagcgagaccttcggcgaggacctggactgcttcctgcacgccagcccccccccctgcatcgaggagagcttcagaagactggaccccctgctgctgcccgtggaggccgccatctgcgagaagagcagcgccgtggacatcctgctgagcagagacaagctgctgagcgagacctgcctgagcctgtag

SEQ ID NO: 86379 - DNA, 183 bp, Artificial Sequence
  Description of Artificial Sequence: Synthetic coding sequence
atggacgtgctggccagctacagcatcttccaggagctgcagctggtgcacgacaccggctacttcagcgccctgcccagcctggaggagacctggcagcagacctgcctggagctggagagatacctgcagaccgagcccagaagaatcagcgagaccttcggcgaggacctggactgctag

SEQ ID NO: 86380 - DNA, 339 bp, Artificial Sequence
  Description of Artificial Sequence: Synthetic coding sequence
atggacgtgctggccagctacagcatcttccaggagctgcagctggtgcacgacaccggctacttcagcgccctgcccagcctggaggagacctggcagcagacctgcctggagctggagagatacctgcagaccgagcccagaagaatcagcgagaccttcggcgagaagccctacaagtgcagctgggagggctgcgagtggagattcgccagaagcgacgagctgaccagacactacagaaagcacaccggcgccaagcccttcaagtgcaaccactgcgacagatgcttcagcagaagcgaccacctggccctgcacatgaagagacacatctag

SEQ ID NO: 86381 - DNA, 774 bp, Artificial Sequence
  Description of Artificial Sequence: Synthetic coding sequence
atggtggacatggacaagctgatcaacaacctggaggtgcagctgaacagcgagggcggcagcatgcaggtgttcaagcaggtgaccgccagcgtgagaaacagagacccccccgagatcgagtacagaagcaacatgaccagccccaccctgctggacgccaaccccatggagaaccccgccctgttcaacgacatcaagatcgagccccccgaggagctgctggccagcgacttcagcctgccccaggtggagcccgtggacctgagcttccacaagcccaaggcccccctgcagcccgccagcatgctgcaggcccccatcagaccccccaagccccagagcagcccccagaccctggtggtgagcaccagcaccagcgacatgagcaccagcgccaacatccccaccgtgctgacccccggcagcgtgctgaccagcagccagagcaccggcagccagcagatcctgcacgtgatccacaccatccccagcgtgagcctgcccaacaagatgggcggcctgaagaccatccccgtggtggtgcagagcctgcccatggtgtacaccaccctgcccgccgacggcggccccgccgccatcaccgtgcccctgatcggcggcgacggcaagaacgccggcagcgtgaaggtggaccccaccagcatgagccccctggagatccccagcgacagcgaggagagcaccatcgagagcggcagcagcgccctgcagagcctgcagggcctgcagcaggagagagaggccctgtag

SEQ ID NO: 86382 - DNA, 1080 bp, Artificial Sequence
  Description of Artificial Sequence: Synthetic coding sequence
atggtggacatggacaagctgatcaacaacctggaggtgcagctgaacagcgagggcggcagcatgcaggtgttcaagcaggtgaccgccagcgtgagaaacagagacccccccgagatcgagtacagaagcaacatgaccagccccaccctgctggacgccaaccccatggagaaccccgccctgttcaacgacatcaagatcgagccccccgaggagctgctggccagcgacttcagcctgccccaggtggagcccgtggacctgagcttccacaagcccaaggcccccctgcagcccgccagcatgctgcaggcccccatcagaccccccaagccccagagcagcccccagaccctggtggtgagcaccagcaccagcgacatgagcaccagcgccaacatccccaccgtgctgacccccggcagcgtgctgaccagcagccagagcaccggcagccagcagatcctgcacgtgatccacaccatccccagcgtgagcctgcccaacaagatgggcggcctgaagaccatccccgtggtggtgcagagcctgcccatggtgtacaccaccctgcccgccgacggcggccccgccgccatcaccgtgcccctgatcggcggcgacggcaagaacgccggcagcgtgaaggtggaccccaccagcatgagccccctggagatccccagcgacagcgaggagagcaccatcgagagcggcagcagcgccctgcagagcctgcagggcctgcagcaggagcccgccgccatggcccagatgcagggcgaggagagcctggacctgaagagaagaagaatccaccagtgcgacttcgccggctgcagcaaggtgtacaccaagagcagccacctgaaggcccacagaagaatccacaccggcgagaagccctacaagtgcacctgggacggctgcagctggaagttcgccagaagcgacgagctgaccagacacttcagaaagcacaccggcatcaagcccttcagatgcaccgactgcaacagaagcttcagcagaagcgaccacctgagcctgcacagaagaagacacgacaccatgtag

SEQ ID NO: 86383 - DNA, 771 bp, Artificial Sequence
  Description of Artificial Sequence: Synthetic coding sequence
atgcagcccgccaaggaggtgaccaaggccagcgacggcagcctgctgggcgacctgggccacacccccctgagcaagaaggagggcatcaagtggcagagacccagactgagcagacaggccctgatgagatgctgcctggtgaagtggatcctgagcagcaccgccccccagggcagcgacagcagcgacagcgagctggagctgagcaccgtgagacaccagcccgagggcctggaccagctgcaggcccagaccaagttcaccaagaaggagctgcagagcctgtacagaggcttcaagaacgagtgccccaccggcctggtggacgaggacaccttcaagctgatctacgcccagttcttcccccagggcgacgccaccacctacgcccacttcctgttcaacgccttcgacgccgacggcaacggcgccatccacttcgaggacttcgtggtgggcctgagcatcctgctgagaggcaccgtgcacgagaagctgaagtgggccttcaacctgtacgacatcaacaaggacggctacatcaccaaggaggagatgctggccatcatgaagagcatctacgacatgatgggcagacacacctaccccatcctgagagaggacgcccccgccgagcacgtggagagattcttcgagaagatggacagaaaccaggacggcgtggtgaccatcgaggagttcctggaggcctgccagaaggacgagaacatcatgagcagcatgcagctgttcgagaacgtgatctag

SEQ ID NO: 86384 - DNA, 705 bp, Artificial Sequence
  Description of Artificial Sequence: Synthetic coding sequence
atgcagcccagaaaggaggtgaccaaggccagcgacggcagcctgctgggcgacctgggccacacccccctgagcaagaaggagggcatcaagtggcagagacccagactgagcagacaggccctgatgagatgctgcctggtgaagtggatcctgagcagcaccgccccccagggcagcgacagcagcgacagcgagctggagctgagcaccgtgagacaccagcccgagggcctggaccagctgcaggcccagaccaagttcaccaagaaggagctgcagagcctgtacagaggcttcaagaacggcgacgccaccacctacgcccacttcctgttcaacgccttcgacgccgacggcaacggcgccatccacttcgaggacttcgtggtgggcctgagcatcctgctgagaggcaccgtgcacgagaagctgaagtgggccttcaacctgtacgacatcaacaaggacggctacatcaccaaggaggagatgctggccatcatgaagagcatctacgacatgatgggcagacacacctaccccatcctgagagaggacgcccccgccgagcacgtggagagattcttcgagaagatggacagaaaccaggacggcgtggtgaccatcgaggagttcctggaggcctgccagaaggacgagaacatcatgagcagcatgcagctgttcgagaacgtgatctag

SEQ ID NO: 86385 - DNA, 693 bp, Artificial Sequence
  Description of Artificial Sequence: Synthetic coding sequence
atgggcatccagggcatggagctgtgcgccatggccgtggtggtgctgctgttcatcgccgtgctgaagcagttcggcatcctggagcccatcagcatggaggacagcagcgacagcgagctggagctgagcaccgtgagacaccagcccgagggcctggaccagctgcaggcccagaccaagttcaccaagaaggagctgcagagcctgtacagaggcttcaagaacgagtgccccaccggcctggtggacgaggacaccttcaagctgatctacgcccagttcttcccccagggcgacgccaccacctacgcccacttcctgttcaacgccttcgacgccgacggcaacggcgccatccacttcgaggacttcgtggtgggcctgagcatcctgctgagaggcaccgtgcacgagaagctgaagtgggccttcaacctgtacgacatcaacaaggacggctacatcaccaaggaggagatgctggccatcatgaagagcatctacgacatgatgggcagacacacctaccccatcctgagagaggacgcccccgccgagcacgtggagagattcttcgagaagatggacagaaaccaggacggcgtggtgaccatcgaggagttcctggaggcctgccagaaggacgagaacatcatgagcagcatgcagctgttcgagaacgtgatctag

SEQ ID NO: 86386 - DNA, 567 bp, Artificial Sequence
  Description of Artificial Sequence: Synthetic coding sequence
atggccaccgtgagacacagacccgaggccctggagctgctggaggcccagagcaagttcaccaagaaggagctgcagatcctgtacagaggcttcaagaacgagtgccccagcggcgtggtgaacgaggagaccttcaaggagatctacagccagttcttcccccagggcgacagcaccacctacgcccacttcctgttcaacgccttcgacaccgaccacaacggcgccgtgagcttcgaggacttcatcaagggcctgagcatcctgctgagaggcaccgtgcaggagaagctgaactgggccttcaacctgtacgacatcaacaaggacggctacatcaccaaggaggagatgctggacatcatgaaggccatctacgacatgatgggcaagtgcacctaccccgtgctgaaggaggacgcccccagacagcacgtggagaccttcttccagaagatggacaagaacaaggacggcgtggtgaccatcgacgagttcatcgagagctgccagaaggacgagaacatcatgagaagcatgcagctgttcgagaacgtgatctag

SEQ ID NO: 86387 - DNA, 678 bp, Artificial Sequence
  Description of Artificial Sequence: Synthetic coding sequence
atgagcggctgcagaaagagatgcaagagagagatcctgaagttcgcccagtacctgctgagactgctgaccggcagcctgcacaccgacagcgtggaggacgagctggagatggccaccgtgagacacagacccgaggccctggagctgctggaggcccagagcaagttcaccaagaaggagctgcagatcctgtacagaggcttcaagaacgagtgccccagcggcgtggtgaacgaggagaccttcaaggagatctacagccagttcttcccccagggcgacagcaccacctacgcccacttcctgttcaacgccttcgacaccgaccacaacggcgccgtgagcttcgaggacttcatcaagggcctgagcatcctgctgagaggcaccgtgcaggagaagctgaactgggccttcaacctgtacgacatcaacaaggacggctacatcaccaaggaggagatgctggacatcatgaaggccatctacgacatgatgggcaagtgcacctaccccgtgctgaaggaggacgcccccagacagcacgtggagaccttcttccagaagatggacaagaacaaggacggcgtggtgaccatcgacgagttcatcgagagctgccagaaggacgagaacatcatgagaagcatgcagctgttcgagaacgtgatctag

SEQ ID NO: 86388 - DNA, 690 bp, Artificial Sequence
  Description of Artificial Sequence: Synthetic coding sequence
atgaacctggagggcctggagatgatcgccgtgctgatcgtgatcgtgctgttcgtgaagctgctggagcagttcggcctgatcgaggccggcctggaggacagcgtggaggacgagctggagatggccaccgtgagacacagacccgaggccctggagctgctggaggcccagagcaagttcaccaagaaggagctgcagatcctgtacagaggcttcaagaacgagtgccccagcggcgtggtgaacgaggagaccttcaaggagatctacagccagttcttcccccagggcgacagcaccacctacgcccacttcctgttcaacgccttcgacaccgaccacaacggcgccgtgagcttcgaggacttcatcaagggcctgagcatcctgctgagaggcaccgtgcaggagaagctgaactgggccttcaacctgtacgacatcaacaaggacggctacatcaccaaggaggagatgctggacatcatgaaggccatctacgacatgatgggcaagtgcacctaccccgtgctgaaggaggacgcccccagacagcacgtggagaccttcttccagaagatggacaagaacaaggacggcgtggtgaccatcgacgagttcatcgagagctgccagaaggacgagaacatcatgagaagcatgcagctgttcgagaacgtgatctag

SEQ ID NO: 86389 - DNA, 753 bp, Artificial Sequence
  Description of Artificial Sequence: Synthetic coding sequence
atgaacgtgagaagagtggagagcatcagcgcccagctggaggaggccagcagcaccggcggcttcctgtacgcccagaacagcaccaagagaagcatcaaggagagactgatgaagctgctgccctgcagcgccgccaagaccagcagccccgccatccagaacagcgtggaggacgagctggagatggccaccgtgagacacagacccgaggccctggagctgctggaggcccagagcaagttcaccaagaaggagctgcagatcctgtacagaggcttcaagaacgagtgccccagcggcgtggtgaacgaggagaccttcaaggagatctacagccagttcttcccccagggcgacagcaccacctacgcccacttcctgttcaacgccttcgacaccgaccacaacggcgccgtgagcttcgaggacttcatcaagggcctgagcatcctgctgagaggcaccgtgcaggagaagctgaactgggccttcaacctgtacgacatcaacaaggacggctacatcaccaaggaggagatgctggacatcatgaaggccatctacgacatgatgggcaagtgcacctaccccgtgctgaaggaggacgcccccagacagcacgtggagaccttcttccagaagatggacaagaacaaggacggcgtggtgaccatcgacgagttcatcgagagctgccagaaggacgagaacatcatgagaagcatgcagctgttcgagaacgtgatctag

SEQ ID NO: 86390 - DNA, 567 bp, Artificial Sequence; identical to SEQ ID NO: 86386
  Description of Artificial Sequence: Synthetic coding sequence

SEQ ID NO: 86391 - DNA, 651 bp, Artificial Sequence
  Description of Artificial Sequence: Synthetic coding sequence
atgaacgtgagaagagtggagagcatcagcgcccagctggaggaggccagcagcaccggcgacagcgtggaggacgagctggagatggccaccgtgagacacagacccgaggccctggagctgctggaggcccagagcaagttcaccaagaaggagctgcagatcctgtacagaggcttcaagaacgagtgccccagcggcgtggtgaacgaggagaccttcaaggagatctacagccagttcttcccccagggcgacagcaccacctacgcccacttcctgttcaacgccttcgacaccgaccacaacggcgccgtgagcttcgaggacttcatcaagggcctgagcatcctgctgagaggcaccgtgcaggagaagctgaactgggccttcaacctgtacgacatcaacaaggacggctacatcaccaaggaggagatgctggacatcatgaaggccatctacgacatgatgggcaagtgcacctaccccgtgctgaaggaggacgcccccagacagcacgtggagaccttcttccagaagatggacaagaacaaggacggcgtggtgaccatcgacgagttcatcgagagctgccagaaggacgagaacatcatgagaagcatgcagctgttcgagaacgtgatctag

SEQ ID NO: 86392 - DNA, 567 bp, Artificial Sequence; identical to SEQ ID NO: 86386
  Description of Artificial Sequence: Synthetic coding sequence

SEQ ID NO: 86393 - DNA, 549 bp, Artificial Sequence
  Description of Artificial Sequence: Synthetic coding sequence
tgaggcatgaacgccggcttcgaggactgcctggtgttcgacgagctgatggacaagttcagcaacgacctgagcctgtgcctgcccgtgttcagcagactgagaatccccgacgaccacgccatcagcgacctgagcatgtacaactacatcgagatgagagcccacgtgaacagcagctggttcatcttccagaagaacatggagagattcctgcacgccatcatgcccagcaccttcatccccctgtacaccatggtgaccttcagcagaatcagataccacgaggccgtgcagagatggcactggcagaagaaggtgatcaacaagggcctgttcttcctgggcagcctgatcgccatcagcagcacctacctgctgatccactacatgagccccagaagcttcctgagactgagaagaccctggaactggatcgcccacttcagaaacaccacctgcttccccgccaaggccgtggacagcctggagcagatcagcaacctgatcagcagactgctgagccacagcgagatcctgcagacctag

SEQ ID NO: 86394 - DNA, 1359 bp, Artificial Sequence
  Description of Artificial Sequence: Synthetic coding sequence
atggacagcagcgtgatccagagaaagaaggtggccgtgatcggcggcggcctggtgggcagcctgcaggcctgcttcctggccaagagaaacttccagatcgacgtgtacgaggccagagaggacaccagagtggccaccttcaccagaggcagaagcatcaacctggccctgagccacagaggcagacaggccctgaaggccgtgggcctggaggaccagatcgtgagccagggcatccccatgagagccagaatgatccacagcctgagcggcaagaagagcgccatcccctacggcaccaagagccagtacatcctgagcgtgagcagagagaacctgaacaaggacctgctgaccgccgccgagaagtaccccaacgtgaagatgcacttcaaccacagactgctgaagtgcaaccccgaggagggcatgatcaccgtgctgggcagcgacaaggtgcccaaggacgtgacctgcgacctgatcgtgggctgcgacggcgcctacagcaccgtgagaagccacctgatgaagaagcccagattcgactacagccagcagtacatcccccacggctacatggagctgaccatcccccccaagaacggcgactacgccatggagcccaactacctgcacatctggcccagaaacaccttcatgatgatcgccctgcccaacatgaacaagagcttcacctgcaccctgttcatgcccttcgaggagttcgagaagctgctgaccagcaacgacgtggtggacttcttccagaagtacttccccgacgccatccccctgatcggcgagaagctgctggtgcaggacttcttcctgctgcccgcccagcccatgatcagcgtgaagtgcagcagcttccacttcaagagccactgcgtgctgctgggcgacgccgcccacgccatcgtgcccttcttcggccagggcatgaacgccggcttcgaggactgcctggtgttcgacgagctgatggacaagttcagcaacgacctgagcctgtgcctgcccgtgttcagcagactgagaatccccgacgaccacgccatcagcgacctgagcatgtacaactacatcgaggtgaccttcagcagaatcagataccacgaggccgtgcagagatggcactggcagaagaaggtgatcaacaagggcctgttcttcctgggcagcctgatcgccatcagcagcacctacctgctgatccactacatgagccccagaagcttcctgagactgagaagaccctggaactggatcgcccacttcagaaacaccacctgcttccccgccaaggccgtggacagcctggagcagatcagcaacctgatcagcagatag

SEQ ID NO: 86395 - DNA, 1422 bp, Artificial Sequence
  Description of Artificial Sequence: Synthetic coding sequence
atggacagcagcgtgatccagagaaagaaggtggccgtgatcggcggcggcctggtgggcagcctgcaggcctgcttcctggccaagagaaacttccagatcgacgtgtacgaggccagagaggacaccagagtggccaccttcaccagaggcagaagcatcaacctggccctgagccacagaggcagacaggccctgaaggccgtgggcctggaggaccagatcgtgagccagggcatccccatgagagccagaatgatccacagcctgagcggcaagaagagcgccatcccctacggcaccaagagccagtacatcctgagcgtgagcagagagaacctgaacaaggacctgctgaccgccgccgagaagtaccccaacgtgaagatgcacttcaaccacagactgctgaagtgcaaccccgaggagggcatgatcaccgtgctgggcagcgacaaggtgcccaaggacgtgacctgcgacctgatcgtgggctgcgacggcgcctacagcaccgtgagaagccacctgatgaagaagcccagattcgactacagccagcagtacatcccccacggctacatggagctgaccatcccccccaagaacggcgactacgccatggagcccaactacctgcacatctggcccagaaacaccttcatgatgatcgccctgcccaacatgaacaagagcttcacctgcaccctgttcatgcccttcgaggagttcgagaagctgctgaccagcaacgacgtggtggacttcttccagaagtacttccccgacgccatccccctgatcggcgagaagctgctggtgcaggacttcttcctgctgcccgcccagcccatgatcagcgtgaagtgcagcagcttccacttcaagagccactgcgtgctgctgggcgacgccgcccacgccatcgtgcccttcttcggccagggcatgaacgccggcttcgaggactgcctggtgttcgacgagctgatggacaagttcagcaacgacctgagcctgtgcctgcccgtgttcagcagactgagaatccccgacgaccacgccatcagcgacctgagcatgtacaactacatcgagaagaacatggagagattcctgcacgccatcatgcccagcaccttcatccccctgtacaccatggtgaccttcagcagaatcagataccacgaggccgtgcagagatggcactggcagaagaaggtgatcaacaagggcctgttcttcctgggcagcctgatcgccatcagcagcacctacctgctgatccactacatgagccccagaagcttcctgagactgagaagaccctggaactggatcgcccacttcagaaacaccacctgcttccccgccaaggccgtggacagcctggagcagatcagcaacctgatcagcagatag

SEQ ID NO: 86396 - DNA, 1461 bp, Artificial Sequence
  Description of Artificial Sequence: Synthetic coding sequence
atggacagcagcgtgatccagagaaagaaggtggccgtgatcggcggcggcctggtgggcagcctgcaggcctgcttcctggccaagagaaacttccagatcgacgtgtacgaggccagagaggacaccagagtggccaccttcaccagaggcagaagcatcaacctggccctgagccacagaggcagacaggccctgaaggccgtgggcctggaggaccagatcgtgagccagggcatccccatgagagccagaatgatccacagcctgagcggcaagaagagcgccatcccctacggcaccaagagccagtacatcctgagcgtgagcagagagaacctgaacaaggacctgctgaccgccgccgagaagtaccccaacgtgaagatgcacttcaaccacagactgctgaagtgcaaccccgaggagggcatgatcaccgtgctgggcagcgacaaggtgcccaaggacgtgacctgcgacctgatcgtgggctgcgacggcgcctacagcaccgtgagaagccacctgatgaagaagcccagattcgactacagccagcagtacatcccccacggctacatggagctgaccatcccccccaagaacggcgactacgccatggagcccaactacctgcacatctggcccagaaacaccttcatgatgatcgccctgcccaacatgaacaagagcttcacctgcaccctgttcatgcccttcgaggagttcgagaagctgctgaccagcaacgacgtggtggacttcttccagaagtacttccccgacgccatccccctgatcggcgagaagctgctggtgcaggacttcttcctgctgcccgcccagcccatgatcagcgtgaagtgcagcagcttccacttcaagagccactgcgtgctgctgggcgacgccgcccacgccatcgtgcccttcttcggccagggcatgaacgccggcttcgaggactgcctggtgttcgacgagctgatggacaagttcagcaacgacctgagcctgtgcctgcccgtgttcagcagactgagaatccccgacgaccacgccatcagcgacctgagcatgtacaactacatcgagatgagagcccacgtgaacagcagctggttcatcttccagaagaacatggagagattcctgcacgccatcatgcccagcaccttcatccccctgtacaccatggtgaccttcagcagaatcagataccacgaggccgtgcagagatggcactggcagaagaaggtgatcaacaagggcctgttcttcctgggcagcctgatcgccatcagcagcacctacctgctgatccactacatgagccccagaagcttcctgagactgagaagaccctggaactggatcgcccacttcagaaacaccacctgcttccccgccaaggccgtggacagcctggagcagatcagcaacctgatcagcagatag

SEQ ID NO: 86397 - DNA, 1689 bp, Artificial Sequence
  Description of Artificial Sequence: Synthetic coding sequence
atggagctgaagaaggacatcaacgccgtgagcatcgacatgctgctgatcgtgcacagcgagaagagaagagccgcccagggcaccctgagcgaccagcaggccaaccccagcagcctgctgcagagaggcggcggcttccagggcgtgggcaacggcgtgagaagatggcagaagctggagggcaacgacttccacgagaacctggtggagaagcagcacccccagcagccccaggtgatcaccagctacaacagccagggcacccagctgaccgtggaggtgcaccccagagacgccatgccccagctgctgaagaagttcagcctggccaagagactgcagggcgacaagaacggcaacaccagacccagacagcccggcggcaaggacgcccacgcctacccctgggacagaagcagcctgaagagcatgagcctggacctgcagcagttcgagaagctggacatctacgccagccaggtgaccgccaagagcggcctggacgagctggtgagcgacctgctgcaggaggcccacaccgacctggagagagtgagagccatctggatctggatctgccaccacatcgagtacgacatcgccgccgcccaggagaaggacagacaggccttcaagcccaccgacatcctgagaacccagaagaccaactgcgacggctacgccggcctgttcgagagaatgtgcagactggccggcgtgcagtgcatgaccgtgcccggctacagcaagggcttcggctaccagaccggccagagcttcagcggcgagttcgaccacgcctggaacgccgtgtacctggagggcagatggcacctggtggacagcacctggggcagcggcctggtggacaccatcaccagcaagttcaccttcctgtacaacgagttctacttcctgacccaccccgccctgttcatcgaggaccacttccccgacaacaagaactggcagctgctgaagcccccccagagcctgagacagttcgagaacaacatgtaccacaagagcgagttctacaacaagggcatgctgagcgcccaccccgagaccagcatgatcagaaccgtgaacggcaaggccaccgtgaccatcgagagctgcgcccccaccctgttcatgttcatgctgaacggcaagcaggagcacggcctgctgagcctgagaaagaacggcatgaagctggaggtgtacccccccaccatgggcacccacaagctgcagatcttcgccaagggcaacagcgacatctacagcagcgtgctggagtacaccctgaagtgcaactacgtggacatgggcgtgcagctgcccgccgagctgcaccagcccgtgggccccagctggttcagcgagcagatgggcatcatgaagcccagccaccccgaccccatcatccacaccagcgacggcagatgcagcatcagcttcagcgtggaggagggcatcaacgtgctggccagcctgcacggcgacgacggccccatcaccgaggagacccagagaagatacatcttccagctgcacagagagaagcagaccgagctgaaggtgcagctgccccacgccggcaagttcgccctgaaggaggtgtacgtgatggtgctggagaacgccaaccacaacttctacagctacatcctgaagtacaaggtgaacgcccagtag

SEQ ID NO: 86398 - DNA, 1986 bp, Artificial Sequence
  Description of Artificial Sequence: Synthetic coding sequence
atggagctgaagaaggacatcaacgccgtgagcatcgacatgctgctgatcgtgcacagcgagaagagaagagccgcccagggcaccctgagcgaccagcaggccaaccccagcagcctgctgcagagaggcggcggcttccagggcgtgggcaacggcgtgagaagatggcagaagctggagggcaacgacttccacgagaacctggtggagaagcagcacccccagcagccccaggtgatcaccagctacaacagccagggcacccagctgaccgtggaggtgcaccccagagacgccatgccccagctgctgaagaagttcagcctggccaagagactgcagggcgacaagaacggcaacaccagacccagacagcccggcggcaaggacgcccacgcctacccctgggacagaagcagcctgaagagcatgagcctggacctgcagcagttcgagaagctggacatctacgccagccaggtgaccgccaagagcggcctggacgagctggtgagcgacctgctgcaggaggcccacaccgacctggagagagtgagagccatctggatctggatctgccaccacatcgagtacgacatcgccgccgcccaggagaaggacagacaggccttcaagcccaccgacatcctgagaacccagaagaccaactgcgacggctacgccggcctgttcgagagaatgtgcagactggccggcgtgcagtgcatgaccgtgcccggctacagcaagggcttcggctaccagaccggccagagcttcagcggcgagttcgaccacgcctggaacgccgtgtacctggagggcagatggcacctggtggacagcacctggggcagcggcctggtggacaccatcaccagcaagttcaccttcctgtacaacgagttctacttcctgacccaccccgccctgttcatcgaggaccacttccccgacaacaagaactggcagctgctgaagcccccccagagcctgagacagttcgagaacaacatgtaccacaagagcgagttctacaacaagggcatgctgagcgcccaccccgagaccagcatgatcagaaccgtgaacggcaaggccaccgtgaccatcgagagctgcgcccccaccctgttcatgttcatgctgaacggcaagcaggagcacggcctgctgagcctgagaaagaacggcatgaagctggaggtgtacccccccaccatgggcacccacaagctgcagatcttcgccaagggcaacagcgacatctacagcagcgtgctggagtacaccctgaagtgcaactacgtggacatgggcgtgcagctgcccgccgagctgcaccagcccgtgggccccagctggttcagcgagcagatgggcatcatgaagcccagccaccccgaccccatcatccacaccagcgacggcagatgcagcatcagcttcagcgtggaggagggcatcaacgtgctggccagcctgcacggcgacgacggccccatcaccgaggagacccagagaagatacatcttccagctgcacagagagaagcagaccgagctgaaggtgcagctgccccacgccggcaagttcgccctgaagatcttcgtgaagaagagacaggagcccggcaactacatcttcgtgttcaactacctggtgtgctgcgccaacaccaaggtgaactggcccatgttccccgagagcttcggcaactggggccaggacaacgagctgctggagcccctgagcggcgtgctgcccgccaacagaaacgtgcccttcaagctgaagctgcacggcatcgccaaggtgctggtgaagggccaggacacctggcccctgaccctgaaccacgagggctactgggagggcagctgcagcaccgccggctgccaggaggtgtacgtgatggtgctggagaacgccaaccacaacttctacagctacatcctgaagtacaaggtgaacgcccagtag

SEQ ID NO: 86399 - DNA, 1173 bp, Artificial Sequence
  Description of Artificial Sequence: Synthetic coding sequence
atgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgaggtgagatgcaagtgcagagtgggcgacagagccggcgtgaccgtgctgaagaccgccggcagcagatgccccccccagagacacttctgctag

SEQ ID NO: 86400 - DNA, 2232 bp, Artificial Sequence
  Description of Artificial Sequence: Synthetic coding sequence
atgagaagaagagagggccacggcaccgacagcgagatgggccagggccccgtgagagagagccagagcagcgacccccccgccctgcagttcagaatcagcgagtacaagcccctgaacatggccggcgtggagcagccccccagccccgagctgagacaggagggcgtgaccgagtacgaggacggcggcgcccccgccggcgacggcgaggccggcccccagcaggccgaggaccacccccagaacccccccgaggaccccaaccaggacccccccgaggacgacagcacctgccagtgccaggcctgcggcccccaccaggccgccggccccgacctgggcagcagcaacgacggctgcccccagctgttccaggagagaagcgtgatcgtggagaacagcagcggcagcaccagcgccagcgagctgctgaagcccatgaagaagagaaagagaagagagtaccagagccccagcgaggaggagagcgagcccgaggccatggagaagcaggaggagggcaaggaccccgagggccagcccaccgccagcacccccgagagcgaggagtggagcagcagccagcccgccaccggcgagaagaaggagtgctggagctgggagagctacctggaggagcagaaggccatcaccgcccccgtgagcctgttccaggacagccaggccgtgacccacaacaagaacggcttcaagctgggcatgaagctggagggcatcgacccccagcaccccagcatgtacttcatcctgaccgtggccgaggtgtgcggctacagactgagactgcacttcgacggctacagcgagtgccacgacttctgggtgaacgccaacagccccgacatccaccccgccggctggttcgagaagaccggccacaagctgcagccccccaagggctacaaggaggaggagttcagctggagccagtacctgagaagcaccagagcccaggccgcccccaagcacctgttcgtgagccagagccacagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagactgttcttccccagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgaggtgagatgcaagtgcagagtgggcgacagagccggcgtgaccgtgctgaagaccgccggcagcagatgccccccccagagacacttctgctag

SEQ ID NO: 86401 - DNA, 2319 bp, Artificial Sequence
  Description of Artificial Sequence: Synthetic coding sequence
atgagaagaagagagggccacggcaccgacagcgagatgggccagggccccgtgagagagagccagagcagcgacccccccgccctgcagttcagaatcagcgagtacaagcccctgaacatggccggcgtggagcagccccccagccccgagctgagacaggagggcgtgaccgagtacgaggacggcggcgcccccgccggcgacggcgaggccggcccccagcaggccgaggaccacccccagaacccccccgaggaccccaaccaggacccccccgaggacgacagcacctgccagtgccaggcctgcggcccccaccaggccgccggccccgacctgggcagcagcaacgacggctgcccccagctgttccaggagagaagcgtgatcgtggagaacagcagcggcagcaccagcgccagcgagctgctgaagcccatgaagaagagaaagagaagagagtaccagagccccagcgaggaggagagcgagcccgaggccatggagaagcaggaggagggcaaggaccccgagggccagcccaccgccagcacccccgagagcgaggagtggagcagcagccagcccgccaccggcgagaagaaggagtgctggagctgggagagctacctggaggagcagaaggccatcaccgcccccgtgagcctgttccaggacagccaggccgtgacccacaacaagaacggcttcaagctgggcatgaagctggagggcatcgacccccagcaccccagcatgtacttcatcctgaccgtggccgaggtgtgcggctacagactgagactgcacttcgacggctacagcgagtgccacgacttctgggtgaacgccaacagccccgacatccaccccgccggctggttcgagaagaccggccacaagctgcagccccccaagggctacaaggaggaggagttcagctggagccagtacctgagaagcaccagagcccaggccgcccccaagcacctgttcgtgagccagagccacagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgaggccagaatcgtgagagtgacccacgtgagcggcaagaccctggtgtggaccgtggcccagctgggcgacctggtgtgcagcgaccacctgcaggagggcaagggcatcctggagaccggcgtgcacagcctgctgtgcagcctgcccacccacctgctggccaagctgagcttcgccagcgacagccagtactag

SEQ ID NO: 86402 - DNA, 2523 bp, Artificial Sequence
  Description of Artificial Sequence: Synthetic coding sequence
atgcacctggtggccggcgacagccccggcagcggcccccacctgcccgccaccgccttcatcatccccgccagcagcgccaccctgggcctgcccagcagcgccctggacgtgagctgcttccccagagagcccatccacgtgggcgcccccgagcaggtggccggctgcgagcccgtgagcgccaccgtgctgccccagctgagcgccggccccgccagcagcagcaccagcaccgtgagactgctggagtggaccgaggccgccgcccccccccccggcggcggcctgagattcagaatcagcgagtacaagcccctgaacatggccggcgtggagcagccccccagccccgagctgagacaggagggcgtgaccgagtacgaggacggcggcgcccccgccggcgacggcgaggccggcccccagcaggccgaggaccacccccagaacccccccgaggaccccaaccaggacccccccgaggacgacagcacctgccagtgccaggcctgcggcccccaccaggccgccggccccgacctgggcagcagcaacgacggctgcccccagctgttccaggagagaagcgtgatcgtggagaacagcagcggcagcaccagcgccagcgagctgctgaagcccatgaagaagagaaagagaagagagtaccagagccccagcgaggaggagagcgagcccgaggccatggagaagcaggaggagggcaaggaccccgagggccagcccaccgccagcacccccgagagcgaggagtggagcagcagccagcccgccaccggcgagaagaaggagtgctggagctgggagagctacctggaggagcagaaggccatcaccgcccccgtgagcctgttccaggacagccaggccgtgacccacaacaagaacggcttcaagctgggcatgaagctggagggcatcgacccccagcaccccagcatgtacttcatcctgaccgtggccgaggtgtgcggctacagactgagactgcacttcgacggctacagcgagtgccacgacttctgggtgaacgccaacagccccgacatccaccccgccggctggttcgagaagaccggccacaagctgcagccccccaagggctacaaggaggaggagttcagctggagccagtacctgagaagcaccagagcccaggccgcccccaagcacctgttcgtgagccagagccacagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgaggccagaatcgtgagagtgacccacgtgagcggcaagaccctggtgtggaccgtggcccagctgggcgacctggtgtgcagcgaccacctgcaggagggcaagggcatcctggagaccggcgtgcacagcctgctgtgcagcctgcccacccacctgctggccaagctgagcttcgccagcgacagccagtactag

SEQ ID NO: 86403 - DNA, 1617 bp, Artificial Sequence
  Description of Artificial Sequence: Synthetic coding sequence
cagaaggccatcaccgcccccgtgagcctgttccaggacagccaggccgtgacccacaacaagaacggcttcaagctgggcatgaagctggagggcatcgacccccagcaccccagcatgtacttcatcctgaccgtggccgaggtgtgcggctacagactgagactgcacttcgacggctacagcgagtgccacgacttctgggtgaacgccaacagccccgacatccaccccgccggctggttcgagaagaccggccacaagctgcagccccccaagggctacaaggaggaggagttcagctggagccagtacctgagaagcaccagagcccaggccgcccccaagcacctgttcgtgagccagagccacagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgagatgatcgacggcgaggccttcctgctgctgacccaggccgacatcgtgaagatcatgagcgtgaagctgggccccgccctgaagatctacaacgccatcctgatgttcaagaacgccgacgacaccctgaagtag

SEQ ID NO: 86404 - DNA, 2523 bp, Artificial Sequence; identical to SEQ ID NO: 86402
  Description of Artificial Sequence: Synthetic coding sequence

SEQ ID NO: 86405 - DNA, 255 bp, Artificial Sequence
  Description of Artificial Sequence: Synthetic coding sequence
atggccggcgtggagcagccccccagccccgagctgagacaggagggcgtgaccgagtacgaggacggcggcgcccccgccggcgacggcgaggccggcccccagcaggccgaggaccacccccagaacccccccgaggaccccaaccaggacccccccgaggacgacagcacctgccagtgccaggcctgcggcccccaccaggccgccggccccgacctgggcagcagcaacgacggctgcccccagctgtag

SEQ ID NO: 86406 - DNA, 417 bp, Artificial Sequence
  Description of Artificial Sequence: Synthetic coding sequence
atgcacctggtggccggcgacagccccggcagcggcccccacctgcccgccaccgccttcatcatccccgccagcagcgccaccctgggcctgcccagcagcgccctggacgtgagctgcttccccagagagcccatccacgtgggcgcccccgagcaggtggccggctgcgagcccgtgagcgccaccgtgctgccccagctgagcgccggccccgccagcagcagcaccagcaccgtgagactgctggagtggaccgaggccgccgcccccccccccggcggcggcctgagattcagaatcagcgagtacaagcccctgaacatggccggcgtggagcagccccccagccccgagctgagacaggagggcgtgaccgagtacgaggacggcggcgcccccgccggcgacggctag

SEQ ID NO: 86407 - DNA, 2217 bp, Artificial Sequence
  Description of Artificial Sequence: Synthetic coding sequence
atgagaagaagagagggccacggcaccgacagcgagatgggccagggccccgtgagagagagccagagcagcgacccccccgccctgcagttcagaatcagcgagtacaagcccctgaacatggccggcgtggagcagccccccagccccgagctgagacaggagggcgtgaccgagtacgaggacggcggcgcccccgccggcgacggcgaggccggcccccagcaggccgaggaccacccccagaacccccccgaggaccccaaccaggacccccccgaggacgacagcacctgccagtgccaggcctgcggcccccaccaggccgccggccccgacctgggcagcagcaacgacggctgcccccagctgttccaggagagaagcgtgatcgtggagaacagcagcggcagcaccagcgccagcgagctgctgaagcccatgaagaagagaaagagaagagagtaccagagccccagcgaggaggagagcgagcccgaggccatggagaagcaggaggagggcaaggaccccgagggccagcccaccgccagcacccccgagagcgaggagtggagcagcagccagcccgccaccggcgagaagaaggagtgctggagctgggagagctacctggaggagcagaaggccatcaccgcccccgtgagcctgttccaggacagccaggccgtgacccacaacaagaacggcttcaagctgggcatgaagctggagggcatcgacccccagcaccccagcatgtacttcatcctgaccgtggccgaggtgtgcggctacagactgagactgcacttcgacggctacagcgagtgccacgacttctgggtgaacgccaacagccccgacatccaccccgccggctggttcgagaagaccggccacaagctgcagccccccaagggctacaaggaggaggagttcagctggagccagtacctgagaagcaccagagcccaggccgcccccaagcacctgttcgtgagccagagccacagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagcgccagaaagaagaacctgagcggcttcagccccagaaagaagcccagacaccacggcagaatcggcagaccccccaagtacagaaagatcccccaggaggacttccagaccctgacccccgacgtggtgcaccagagcctgttcatgagcgccctgagcgcccaccccgacagaagcctgagcgtgtgctgggagcagcactgcaagctgctgcccggcgtggccggcatcagcgccagcaccgtggccaagtggaccatcgacgaggtgttcggcttcgtgcagaccctgaccggctgcgaggaccaggccagactgttcaaggacgaggtgagatgcaagtgcagagtgggcgacagagccggcgtgaccgtgctgaagaccgccggcagcagatgccccccccagagacacttctgctag

SEQ ID NO: 86408 - DNA, 870 bp, Artificial Sequence
  Description of Artificial Sequence: Synthetic coding sequence
tgaaccagcggcagcatgcccacccccctgaccttcaccctgctggccggcagcagaagaagagccaccagctgcagcctgcccaagagccccccccccctgggcttccaggtgggcatgaagctggaggccgtggacagaatgaaccccagcctggtgtgcgtggccagcgtgaccgacgtggtggacagcagattcctggtgcacttcgacaactgggacgacacctacgactactggtgcgaccccagcagcccctacatccaccccgtgggctggtgccagaagcagggcaagcccctgacccccccccaggactaccccgaccccgacaacttctgctgggagaagtacctggaggagaccggcgccagcgccgtgcccacctgggccttcaaggtgagacccccccacagcttcctggtgaacatgaagctggaggccgtggacagaagaaaccccgccctgatcagagtggccagcgtggaggacgtggaggaccacagaatcaagatccacttcgacggctggagccacggctacgacttctggatcgacgccgaccaccccgacatccaccccgccggctggtgcagcaagaccggccaccccctgcagccccccctgggccccagagagcccagcagcgccagccccggcggctgcccccccctgagctacagaagcctgccccacaccagaaccagcaagtacagcttccaccacagaaagtgccccacccccggctgcgacggcagcggccacgtgaccggcaagttcaccgcccaccactgcctgagcggctgccccctggccgagagaaaccagagcagactgaaggccgagctgagcgacagcgaggccagctag

SEQ ID NO: 86409 - DNA, 327 bp, Artificial Sequence
  Description of Artificial Sequence: Synthetic coding sequence
atggccgccgccatggacgtggacacccccagcggcaccaacagcggcgccggcaagaagagattcgaggtgaagaagtggaacgccgtggccctgtgggcctgggacatcgtggtggacaactgcgccatctgcagaaaccacatcatggacctgtgcatcgagtgccaggccaaccaggccagcgccaccagcgaggagtgcaccgtggcctggggcgtgtgcaaccacgccttccacttccactgcatcagcagatggctgaagaccagacaggtgtgccccctggacaacagagagtgggagttccagaagtacggccactag

SEQ ID NO: 86410 - DNA, 867 bp, Artificial Sequence
  Description of Artificial Sequence: Synthetic coding sequence
tgaagaccccacctgcagaaccagtggagaaagagaaagatgaccacctggagctgcctggtggccatgatcgtgagcggcgtgatcaccgccgtgtgggccgtgagagccgcccccatctggagaagccaggtgaagcagaagatgagaatcggcaagcagggcaactgcagaccccccagatgcatctgcagcgccctgggcctgctggccccctggatggccgtggtgctgagccagggcaagccccccaccaagaaggccaaggtgctgcacaaggccgcctggagcgccaagatcggcgccttcctgcacagccagggcaccggccagctggccgacggcacccccaccggccaggacgccctggtgctgggcttcgactggggcaagttcctgaaggaccacagctacaaggccgcccccgtgagctgcttcaagcacgtgcccctgtacgaccagtgggaggacgtgatgaagggcatgaaggtggaggtgctgaacagcgacgccgtgctgcccagcagagtgtactggatcgccagcgtgatccagaccgccggctacagagtgctgctgagatacgagggcttcgagaacgacgccagccacgacttctggtgcaacctgggcaccgtggacgtgcaccccatcggctggtgcgccatcaacagcaagatcctggtgccccccagaaccatccacgccaagttcaccgactggaagggctacctgatgaagagactggtgggcagcagaaccctgcccgtggacttccacatcaaggtgggcagcgagcccctgaccgacgtgccccccagcgccctgcccttcttctgcatcctgcacgccacccactggagctag

SEQ ID NO: 86411 - DNA, 3762 bp, Artificial Sequence
  Description of Artificial Sequence: Synthetic coding sequence
atggtggtggccctgagatacgtgtggcccctgctgctgtgcagcccctgcctgctgatccagatccccgaggagtacgagggccaccacgtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 86412 - DNA, 3747 bp, Artificial Sequence
  Description of Artificial Sequence: Synthetic coding sequence
atggtggtggccctgagatacgtgtggcccctgctgctgtgcagcccctgcctgctgatccagatccccgaggagctgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 86413 - DNA, 3747 bp, Artificial Sequence; identical to SEQ ID NO: 86412
  Description of Artificial Sequence: Synthetic coding sequence

SEQ ID NO: 86414 - DNA, 3774 bp, Artificial Sequence
  Description of Artificial Sequence: Synthetic coding sequence
atggtggtggccctgagatacgtgtggcccctgctgctgtgcagcccctgcctgctgatccagatccccgaggagtacgagggccaccacgtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagaagcctggagagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 86415 - DNA, 3774 bp, Artificial Sequence; identical to SEQ ID NO: 86414
  Description of Artificial Sequence: Synthetic coding sequence

SEQ ID NO: 86416 - DNA, 456 bp, Artificial Sequence
  Description of Artificial Sequence: Synthetic coding sequence
atggtggtggccctgagatacgtgtggcccctgctgctgtgcagcccctgcctgctgatccagatccccgaggagtacgagggccaccacgtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggctag

SEQ ID NO: 86417 - DNA, 255 bp, Artificial Sequence
  Description of Artificial Sequence: Synthetic coding sequence
atggtggtggccctgagatacgtgtggcccctgctgctgtgcagcccctgcctgctgatccagatccccgaggagtacgagggccaccacgtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgtag

SEQ ID NO: 86418 - DNA, 3768 bp, Artificial Sequence
  Description of Artificial Sequence: Synthetic coding sequence
atggtggtggccctgagatacgtgtggcccctgctgctgtgcagcccctgcctgctgatccagatccccgaggagagcttccccggccacagagtggtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 86419 - DNA, 351 bp, Artificial Sequence
  Description of Artificial Sequence: Synthetic coding sequence
atggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccacctag

SEQ ID NO: 86420 - DNA, 3780 bp, Artificial Sequence
  Description of Artificial Sequence: Synthetic coding sequence
atggtggtggccctgagatacgtgtggcccctgctgctgtgcagcccctgcctgctgatccagatccccgaggagagcttccccggccacagagtggtgatggagccccccgtgatcaccgagcagagccccagaagactggtggtgttccccaccgacgacatcagcctgaagtgcgaggccagcggcaagcccgaggtgcagttcagatggaccagagacggcgtgcacttcaagcccaaggaggagctgggcgtgaccgtgtaccagagcccccacagcggcagcttcaccatcaccggcaacaacagcaacttcgcccagagattccagggcatctacagatgcttcgccagcaacaagctgggcaccgccatgagccacgagatcagactgatggccgagggcgcccccaagtggcccaaggagaccgtgaagcccgtggaggtggaggagggcgagagcgtggtgctgccctgcaaccccccccccagcgccgagcccctgagaatctactggatgaacagcaagatcctgcacatcaagcaggacgagagagtgaccatgggccagaacggcaacctgtacttcgccaacgtgctgaccagcgacaaccacagcgactacatctgccacgcccacttccccggcaccagaaccatcatccagaaggagcccatcgacctgagagtgaaggccaccaacagcatgatcgacagaaagcccagactgctgttccccaccaacagcagcagccacctggtggccctgcagggccagcccctggtgctggagtgcatcgccgagggcttccccacccccaccatcaagtggctgagacccagcggccccatgcccgccgacagagtgacctaccagaaccacaacaagaccctgcagctgctgaaggtgggcgaggaggacgacggcgagtacagatgcctggccgagaacagcctgggcagcgccagacacgcctactacgtgaccgtggaggccgccccctactggctgcacaagccccagagccacctgtacggccccggcgagaccgccagactggactgccaggtgcagggcagaccccagcccgaggtgacctggagaatcaacggcatccccgtggaggagctggccaaggaccagaagtacagaatccagagaggcgccctgatcctgagcaacgtgcagcccagcgacaccatggtgacccagtgcgaggccagaaacagacacggcctgctgctggccaacgcctacatctacgtggtgcagctgcccgccaagatcctgaccgccgacaaccagacctacatggccgtgcagggcagcaccgcctacctgctgtgcaaggccttcggcgcccccgtgcccagcgtgcagtggctggacgaggacggcaccaccgtgctgcaggacgagagattcttcccctacgccaacggcaccctgggcatcagagacctgcaggccaacgacaccggcagatacttctgcctggccgccaacgaccagaacaacgtgaccatcatggccaacctgaaggtgaaggacgccacccagatcacccagggccccagaagcaccatcgagaagaagggcagcagagtgaccttcacctgccaggccagcttcgaccccagcctgcagcccagcatcacctggagaggcgacggcagagacctgcaggagctgggcgacagcgacaagtacttcatcgaggacggcagactggtgatccacagcctggactacagcgaccagggcaactacagctgcgtggccagcaccgagctggacgtggtggagagcagagcccagctgctggtggtgggcagccccggccccgtgcccagactggtgctgagcgacctgcacctgctgacccagagccaggtgagagtgagctggagccccgccgaggaccacaacgcccccatcgagaagtacgacatcgagttcgaggacaaggagatggcccccgagaagtggtacagcctgggcaaggtgcccggcaaccagaccagcaccaccctgaagctgagcccctacgtgcactacaccttcagagtgaccgccatcaacaagtacggccccggcgagcccagccccgtgagcgagaccgtggtgacccccgaggccgcccccgagaagaaccccgtggacgtgaagggcgagggcaacgagaccaccaacatggtgatcacctggaagcccctgagatggatggactggaacgccccccaggtgcagtacagagtgcagtggagaccccagggcaccagaggcccctggcaggagcagatcgtgagcgaccccttcctggtggtgagcaacaccagcaccttcgtgccctacgagatcaaggtgcaggccgtgaacagccagggcaagggccccgagccccaggtgaccatcggctacagcggcgaggactacccccaggccatccccgagctggagggcatcgagatcctgaacagcagcgccgtgctggtgaagtggagacccgtggacctggcccaggtgaagggccacctgagaggctacaacgtgacctactggagagagggcagccagagaaagcacagcaagagacacatccacaaggaccacgtggtggtgcccgccaacaccaccagcgtgatcctgagcggcctgagaccctacagcagctaccacctggaggtgcaggccttcaacggcagaggcagcggccccgccagcgagttcaccttcagcacccccgagggcgtgcccggccaccccgaggccctgcacctggagtgccagagcaacaccagcctgctgctgagatggcagccccccctgagccacaacggcgtgctgaccggctacgtgctgagctaccaccccctggacgagggcggcaagggccagctgagcttcaacctgagagaccccgagctgagaacccacaacctgaccgacctgagcccccacctgagatacagattccagctgcaggccaccaccaaggagggccccggcgaggccatcgtgagagagggcggcaccatggccctgagcggcatcagcgacttcggcaacatcagcgccaccgccggcgagaactacagcgtggtgagctgggtgcccaaggagggccagtgcaacttcagattccacatcctgttcaaggccctgggcgaggagaagggcggcgccagcctgagcccccagtacgtgagctacaaccagagcagctacacccagtgggacctgcagcccgacaccgactacgagatccacctgttcaaggagagaatgttcagacaccagatggccgtgaagaccaacggcaccggcagagtgagactgccccccgccggcttcgccaccgagggctggttcatcggcttcgtgagcgccatcatcctgctgctgctggtgctgctgatcctgtgcttcatcaagagaagcaagggcggcaagtacagcgtgaaggacaaggaggacacccaggtggacagcgaggccagacccatgaaggacgagaccttcggcgagtacagaagcctggagagcgacaacgaggagaaggccttcggcagcagccagcccagcctgaacggcgacatcaagcccctgggcagcgacgacagcctggccgactacggcggcagcgtggacgtgcagttcaacgaggacggcagcttcatcggccagtacagcggcaagaaggagaaggaggccgccggcggcaacgacagcagcggcgccaccagccccatcaaccccgccgtggccctggagtag

SEQ ID NO: 86421 - DNA, 1326 bp, Artificial Sequence
  Description of Artificial Sequence: Synthetic coding sequence
atggtgcccgccctgagatacctggtgggcgcctgcggcagagccagaggcctgttcgccggcggcagccccggcgcctgcggcttcgccagcggcagacccagacccctgtgcggcggcagcagaagcgccagcaccagcagcttcgacatcgtgatcgtgggcggcggcatcgtgggcctggccagcgccagagccctgatcctgagacaccccagcctgagcatcggcgtgctggagaaggagaaggacctggccgtgcaccagaccggccacaacagcggcgtgatccacagcggcatctactacaagcccgagagcctgaaggccaagctgtgcgtgcagggcgccgccctgctgtacgagtactgccagcagaagggcatcagctacaagcagtgcggcaagctgatcgtggccgtggagcaggaggagatccccagactgcaggccctgtacgagaagggcctgcagaacggcgtgcccggcctgagactgatccagcaggaggacatcaagaagaaggagccctactgcagaggcctgatggccatcgactgcccccacaccggcatcgtggactacagacaggtggccctgagcttcgcccaggacttccaggaggccggcggcagcgtgctgaccaacttcgaggtgaagggcatcgagatggccaaggagagccccagcagaagcatcgacggcatgcagtaccccatcgtgatcaagaacaccaagggcgaggagatcagatgccagtacgtggtgacctgcgccggcctgtacagcgacagaatcagcgagctgagcggctgcacccccgaccccagaatcgtgcccttcagaggcgactacctgctgctgaagcccgagaagtgctacctggtgaagggcaacatctaccccgtgcccgacagcagattccccttcctgggcgtgcacttcacccccagaatggacggcagcatctggctgggccccaacgccgtgctggccttcaagagagagggctacagacccttcgacttcagcgccaccgacgtgatggacatcatcatcaacagcggcctgatcaagctggccagccagaacttcagctacggcgtgaccgagatgtacaaggcctgcttcctgggcgccaccgtgaagtacctgcagaagttcatccccgagatcaccatcagcgacatcctgagacaggtggccgtgagaggccccagctggctgtggcagcagcccatgaaggtgagcgacaacaacatctactgcttcctgtggagatgcttcgccctgctgctgaccggcagcgcctgcagcttcaagtag

SEQ ID NO: 86422 - DNA, 1392 bp, Artificial Sequence
  Description of Artificial Sequence: Synthetic coding sequence
atggtgcccgccctgagatacctggtgggcgcctgcggcagagccagaggcctgttcgccggcggcagccccggcgcctgcggcttcgccagcggcagacccagacccctgtgcggcggcagcagaagcgccagcaccagcagcttcgacatcgtgatcgtgggcggcggcatcgtgggcctggccagcgccagagccctgatcctgagacaccccagcctgagcatcggcgtgctggagaaggagaaggacctggccgtgcaccagaccggccacaacagcggcgtgatccacagcggcatctactacaagcccgagagcctgaaggccaagctgtgcgtgcagggcgccgccctgctgtacgagtactgccagcagaagggcatcagctacaagcagtgcggcaagctgatcgtggccgtggagcaggaggagatccccagactgcaggccctgtacgagaagggcctgcagaacggcgtgcccggcctgagactgatccagcaggaggacatcaagaagaaggagccctactgcagaggcctgatggccatcgactgcccccacaccggcatcgtggactacagacaggtggccctgagcttcgcccaggacttccaggaggccggcggcagcgtgctgaccaacttcgaggtgaagggcatcgagatggccaaggagagccccagcagaagcatcgacggcatgcagtaccccatcgtgatcaagaacaccaagggcgaggagatcagatgccagtacgtggtgacctgcgccggcctgtacagcgacagaatcagcgagctgagcggctgcacccccgaccccagaatcgtgcccttcagaggcgactacctgctgctgaagcccgagaagtgctacctggtgaagggcaacatctaccccgtgcccgacagcagattccccttcctgggcgtgcacttcacccccagaatggacggcagcatctggctgggccccaacgccgtgctggccttcaagagagagggctacagacccttcgacttcagcgccaccgacgtgatggacatcatcatcaacagcggcctgatcaagctggccagccagaacttcagctacggcgtgaccgagatgtacaaggcctgcttcctgggcgccaccgtgaagtacctgcagaagttcatccccgagatcaccatcagcgacatcctgagaggccccgccggcgtgagagcccaggccctggacagagacggcaacctggtggaggacttcgtgttcgacgccggcgtgggcgacatcggcaacagaatcctgcacgtgagaaacgcccccagccccgccgccaccagcagcatcgccatcagcggcatgatcgccgacgaggtgcagcagagattcgagctgtag

SEQ ID NO: 86423 - DNA, 1392 bp, Artificial Sequence; identical to SEQ ID NO: 86422
  Description of Artificial Sequence: Synthetic coding sequence

SEQ ID NO: 86424 - DNA, 3060 bp, Artificial Sequence
  Description of Artificial Sequence: Synthetic coding sequence
atgctgtggagagtgctgctgagcaagagaccccccttcccccaccccgagctggacttccaggaggcccccatccccagctgccccggcagactgcccggcagaaagaacagcgtggccctggccgccgcccccagaaaggagcccaccggcgacagagagaagcccctgcccttccccgtgctggcccccttcagcaaccccgagcacagcgcccccgccaaggtggtgagagccgccgtgcccaagcagagaaagggcagcaaggtgggcgacttcggcgacgccatcaactggcccacccccggcgagatcgcccacaagagcgtgcagccccagagccacaagccccagcccaccagaaagctgccccccaagaaggacatgaaggagcaggagaagggcgagggcagcgacagcaaggagagccccaagaccaagagcgacgagagcggcgaggagaagaacggcgacgaggactgccagagaggcggccagaagaagaagggcaacaagcacaagtgggtgcccctgcagatcgacatgaagcccgaggtgcccagagagaagctggccagcagacccaccagaccccccgagcccagacacatccccgccaacagaggcgagatcaagggcagcgagagcgccacctacgtgcccgtggccccccccacccccgcctggcagcccgagatcaagcccgagcccgcctggcacgaccaggacgagaccagcagcgtgaagagcgacggcgccggcggcgccagagccagcttcagaggcagaggcagaggcagaggcagaggcagaggcagaggcagaggcggcaccagaacccacttcgactaccagttcggctacagaaagttcgacggcgtggagggccccagaacccccaagtacatgaacaacatcacctactacttcgacaacgtgagcagcaccgagctgtacagcgtggaccaggagctgctgaaggactacatcaagagacagatcgagtactacttcagcgtggacaacctggagagagacttcttcctgagaagaaagatggacgccgacggcttcctgcccatcaccctgatcgccagcttccacagagtgcaggccctgaccaccgacatcagcctgatcttcgccgccctgaaggacagcaaggtggtggagatcgtggacgagaaggtgagaagaagagaggagcccgagaagtggcccctgccccccatcgtggactacagccagaccgacttcagccagctgctgaactgccccgagttcgtgcccagacagcactaccagaaggagaccgagagcgcccccggcagccccagagccgtgacccccgtgcccaccaagaccgaggaggtgagcaacctgaagaccctgcccaagggcctgagcgccagcctgcccgacctggacagcgagaactggatcgaggtgaagaagagacccagacccagccccgccagacccaagaagagcgaggagagcagattcagccacctgaccagcctgccccagcagctgcccagccagcagctgatgagcaaggaccaggacgagcaggaggagctggacttcctgttcgacgaggagatggagcagatggacggcagaaagaacaccttcaccgcctggagcgacgaggagagcgactacgagatcgacgacagagacgtgaacaagatcctgatcgtgacccagaccccccactacatgagaagacaccccggcggcgacagaaccggcaaccacaccagcagagccaagatgagcgccgagctggccaaggtgatcaacgacggcctgttctactacgagcaggacctgtgggccgagaagttcgagcccgagtacagccagatcaagcaggaggtggagaacttcaagaaggtgaacatgatcagcagagagcagttcgacaccctgacccccgagccccccgtggaccccaaccaggaggtgccccccggcccccccagattccagcaggtgcccaccgacgccctggccaacaagctgttcggcgcccccgagcccagcaccatcgccagaagcctgcccaccaccgtgcccgagagccccaactacagaaacaccagaacccccagaacccccagaaccccccagctgaaggacagcagccagaccagcagattctaccccgtggtgaaggagggcagaaccctggacgccaagatgcccagaaagagaaagaccagacacagcagcaacccccccctggagagccacgtgggctgggtgatggacagcagagagcacagacccagaaccgccagcatcagcagcagccccagcgagggcacccccaccgtgggcagctacggctgcaccccccagagcctgcccaagttccagcaccccagccacgagctgctgaaggagaacggcttcacccagcacgtgtaccacaagtacagaagaagatgcctgaacgagagaaagagactgggcatcggccagagccaggagatgaacaccctgttcagattctggagcttcttcctgagagaccacttcaacaagaagatgtacgaggagttcaagcagctggccctggaggacgccaaggagggctacagatacggcctggagtgcctgttcagatactacagctacggcctggagaagaagttcagactggacatcttcaaggacttccaggaggagaccgtgaaggactacgaggccggccagctgtacggcctggagaagttctgggccttcctgaagtacagcaaggccaagaacctggacatcgaccccaagctgcaggagtacctgggcaagttcagaagactggaggacttcagagtggacccccccatgggcgaggagggcaaccacaagagacacagcgtggtggccggcggcggcggcggcgagggcagaaagagatgccccagccagagcagcagcagacccgccgccatgatcagccagccccccaccccccccaccggccagcccgtgagagaggacgccaagtggaccagccagcacagcaacacccagaccctgggcaagtag

SEQ ID NO: 86425 - DNA, 2451 bp, Artificial Sequence
  Description of Artificial Sequence: Synthetic coding sequence
atggccacccaggtggagcccctgctgcccggcggcgccaccctgctgcaggccgaggagcacggcggcctggtgagaaagaagcccccccccgcccccgagggcaagggcgagcccggccccaacgacgtgagaggcggcgagcccgacggcagcgccagaagacccagacccccctgcgccaagccccacaaggagggcaccggccagcaggagagagagagccccagacccctgcagctgcccggcgccgagggccccgccatcagcgacggcgaggagggcggcggcgagcccggcgccggcggcggcgccgccggcgccgccggcgccggcagaagagacttcgtggaggcccccccccccaaggtgaacccctggaccaagaacgccctgccccccgtgctgaccaccgtgaacggccagagcccccccgagcacagcgcccccgccaaggtggtgagagccgccgtgcccaagcagagaaagggcagcaaggtgggcgacttcggcgacgccatcaactggcccacccccggcgagatcgcccacaagagcgtgcagccccagagccacaagccccagcccaccagaaagctgccccccaagaaggacatgaaggagcaggagaagggcgagggcagcgacagcaaggagagccccaagaccaagagcgacgagagcggcgaggagaagaacggcgacgaggactgccagagaggcggccagaagaagaagggcaacaagcacaagtgggtgcccctgcagatcgacatgaagcccgaggtgcccagagagaagctggccagcagacccaccagaccccccgagcccagacacatccccgccaacagaggcgagatcaagggcagcgagagcgccacctacgtgcccgtggccccccccacccccgcctggcagcccgagatcaagcccgagcccgcctggcacgaccaggacgagaccagcagcgtgaagagcgacggcgccggcggcgccagagccagcttcagaggcagaggcagaggcagaggcagaggcagaggcagaggcagaggcggcaccagaacccacttcgactaccagttcggctacagaaagttcgacggcgtggagggccccagaacccccaagtacatgaacaacatcacctactacttcgacaacgtgagcagcaccgagctgtacagcgtggaccaggagctgctgaaggactacatcaagagacagatcgagtactacttcagcgtggacaacctggagagagacttcttcctgagaagaaagatggacgccgacggcttcctgcccatcaccctgatcgccagcttccacagagtgcaggccctgaccaccgacatcagcctgatcttcgccgccctgaaggacagcaaggtggtggagatcgtggacgagaaggtgagaagaagagaggagcccgagaagtggcccctgccccccatcgtggactacagccagaccgacttcagccagctgctgaactgccccgagttcgtgcccagacagcactaccagaaggagaccgagagcgcccccggcagccccagagccgtgacccccgtgcccaccaagaccgaggaggtgagcaacctgaagaccctgcccaagggcctgagcgccagcctgcccgacctggacagcgagaactggatcgaggtgaagaagagacccagacccagccccgccagacccaagaagagcgaggagagcagattcagccacctgaccagcctgccccagcagctgcccagccagcagctgatgagcaaggaccaggacgagcaggaggagctggacttcctgttcgacgaggagatggagcagatggacggcagaaagaacaccttcaccgcctggagcgacgaggagagcgactacgagatcgacgacagagacgtgaacaagatcctgatcgtgacccagaccccccactacatgagaagacaccccggcggcgacagaaccggcaaccacaccagcagagccaagatgagcgccgagctggccaaggtgatcaacgacggcctgttctactacgagcaggacctgtgggccgagaagttcgagcccgagtacagccagatcaagcaggaggtggagaacttcaagaaggtgaacatgatcagcagagagcagttcgacaccctgacccccgagccccccgtggaccccaaccaggaggtgccccccggcccccccagattccagcaggtgcccaccgacgccctggccaacaagctgttcggcgcccccgagcccagcaccatcgccagaagcctgcccaccaccgtgcccgagagccccaactacagaaacaccagaacccccagaacccccagaaccccccagctgaaggacagcagccagaccagcagattctaccccgtggtgaaggagggcagaaccctggacgccaagatgcccagatag

SEQ ID NO: 86426 - DNA, 282 bp, Artificial Sequence
  Description of Artificial Sequence: Synthetic coding sequence
atgaaggagcaggagaagggcgagggcagcgacagcaaggagagccccaagaccaagagcgacgagagcggcgaggagaagaacggcgacgaggactgccagagaggcggccagaagaagaagggcaacaagcacaagtgggtgcccctgcagatcgacatgaagcccgaggtgcccagagagaagctggccagcagacccaccagaccccccgagcccagacacatccccgccaacagaggcgagatcaagggcagcgagagcgccacctacgtgccctag

SEQ ID NO: 86427 - DNA, 1836 bp, Artificial Sequence
  Description of Artificial Sequence: Synthetic coding sequence
atgaaggagcaggagaagggcgagggcagcgacagcaaggagagccccaagaccaagagcgacgagagcggcgaggagaagaacggcgacgaggactgccagagaggcggccagaagaagaagggcaacaagcacaagtgggtgcccctgcagatcgacatgaagcccgaggtgcccagagagaagctggccagcagacccaccagaccccccgagcccagacacatccccgccaacagaggcgagatcaagggcagcgagagcgccacctacgtgcccgtggccccccccacccccgcctggcagcccgagatcaagcccgagcccgcctggcacgaccaggacgagaccagcagcgtgaagagcgacggcgccggcggcgccagagccagcttcagaggcagaggcagaggcagaggcagaggcagaggcagaggcagaggcggcaccagaacccacttcgactaccagttcggctacagaaagttcgacggcgtggagggccccagaacccccaagtacatgaacaacatcacctactacttcgacaacgtgagcagcaccgagctgtacagcgtggaccaggagctgctgaaggactacatcaagagacagatcgagtactacttcagcgtggacaacctggagagagacttcttcctgagaagaaagatggacgccgacggcttcctgcccatcaccctgatcgccagcttccacagagtgcaggccctgaccaccgacatcagcctgatcttcgccgccctgaaggacagcaaggtggtggagatcgtggacgagaaggtgagaagaagagaggagcccgagaagtggcccctgccccccatcgtggactacagccagaccgacttcagccagctgctgaactgccccgagttcgtgcccagacagcactaccagaaggagaccgagagcgcccccggcagccccagagccgtgacccccgtgcccaccaagaccgaggaggtgagcaacctgaagaccctgcccaagggcctgagcgccagcctgcccgacctggacagcgagaactggatcgaggtgaagaagagacccagacccagccccgccagacccaagaagagcgaggagagcagattcagccacctgaccagcctgccccagcagctgcccagccagcagctgatgagcaaggaccaggacgagcaggaggagctggacttcctgttcgacgaggagatggagcagatggacggcagaaagaacaccttcaccgcctggagcgacgaggagagcgactacgagatcgacgacagagacgtgaacaagatcctgatcgtgacccagaccccccactacatgagaagacaccccggcggcgacagaaccggcaaccacaccagcagagccaagatgagcgccgagctggccaaggtgatcaacgacggcctgttctactacgagcaggacctgtgggccgagaagttcgagcccgagtacagccagatcaagcaggaggtggagaacttcaagaaggtgaacatgatcagcagagagcagttcgacaccctgacccccgagccccccgtggaccccaaccaggaggtgccccccggcccccccagattccagcaggtgcccaccgacgccctggccaacaagctgttcggcgcccccgagcccagcaccatcgccagaagcctgcccaccaccgtgcccgagagccccaactacagaaacaccagaacccccagaacccccagaaccccccagctgaaggacagcagccagaccagcagattctaccccgtggtgaaggagggcagaaccctggacgccaagatgcccagatag

SEQ ID NO: 86428 - DNA, 1749 bp, Artificial Sequence
  Description of Artificial Sequence: Synthetic coding sequence
atggagaccgagagcggcaaccaggagaaggtgatggaggaggagagcaccgagaagaagaaggaggtggagaagaagaagagaagcagagtgaagcaggtgctggccgacatcgccaagcaggtggacttctggttcggcgacgccaacctgcacaaggacagattcctgagagagcagatcgagaagagcagagacggctacgtggacatcagcctgctggtgagcttcaacaagatgaagaagctgaccaccgacggcaagctgatcgccagagccctgagaagcagcgccgtggtggagctggacctggagggcaccagaatcagaagaaagaagcccctgggcgagagacccaaggacgaggacgagagaaccgtgtacgtggagctgctgcccaagaacgtgaaccacagctggatcgagagagtgttcggcaagtgcggcaacgtggtgtacatcagcatcccccactacaagagcaccggcgaccccaagggcttcgccttcgtggagttcgagaccaaggagcaggccgccaaggccatcgagttcctgaacaacccccccgaggaggcccccagaaagcccggcatcttccccaagaccgtgaagaacaagcccatccccgccctgagagtggtggaggagaagaagaagaagaagaagaagaagggcagaatgaagaaggaggacaacatccaggccaaggaggagaacatggacaccagcaacaccagcatcagcaagatgaagagaagcagacccaccagcgagggcagcgacatcgagagcaccgagccccagaagcagtgcagcaagaagaagaagaagagagacagagtggaggccagcagcctgcccgaggtgagaaccggcaagagaaagagaagcagcagcgaggacgccgagagcctggcccccagaagcaaggtgaagaagatcatccagaaggacatcatcaaggaggccagcgaggccagcaaggagaacagagacatcgagatcagcaccgaggaggagaaggacaccggcgacctgaaggacagcagcctgctgaagaccaagagaaagcacaagaagaagcacaaggagagacacaagatgggcgaggaggtgatccccctgagagtgctgagcaagagcgagtggatggacctgaagaaggagtacctggccctgcagaaggccagcatggccagcctgaagaagaccatcagccagatcaagagcgagagcgagatggagaccgacagcggcgtgccccagaacaccggcatgaagaacgagaagaccgccaacagagaggagtgcagaacccaggagaaggtgaacgccaccggcccccagttcgtgagcggcgtgatcgtgaagatcatcagcaccgagcccctgcccggcagaaagcaggtgagagacaccctggccgccatcagcgaggtgctgtacgtggacctgctggagggcgacaccgagtgccacgccagattcaagacccccgaggacgcccaggccgtgatcaacgcctacaccgagatcaacaagaagcactgctggaagctggagatcctgagcggcgaccacgagcagagatactggcagaagatcctggtggacagacaggccaagctgaaccagcccagagagaagaagagaggcaccgagaagctgatcaccaaggccgagaagatcagactggccaagacccagcaggccagcaagcacatcagattcagcgagtacgactag

SEQ ID NO: 86429 - DNA, 1749 bp, Artificial Sequence; identical to SEQ ID NO: 86428
  Description of Artificial Sequence: Synthetic coding sequence

SEQ ID NO: 86430 - DNA, 900 bp, Artificial Sequence
  Description of Artificial Sequence: Synthetic coding sequence
atggagaccgagagcggcaaccaggagaaggtgatggaggaggagagcaccgagaagaagaaggaggtggagaagaagaagagaagcagagtgaagcaggtgctggccgacatcgccaagcaggtggacttctggttcggcgacgccaacctgcacaaggacagattcctgagagagcagatcgagaagagcagagacggctacgtggacatcagcctgctggtgagcttcaacaagatgaagaagctgaccaccgacggcaagctgatcgccagagccctgagaagcagcgccgtggtggagctggacctggagggcaccagaatcagaagaaagaagcccctgggcgagagacccaaggacgaggacgagagaaccgtgtacgtggagctgctgcccaagaacgtgaaccacagctggatcgagagagtgttcggcaagtgcggcaacgtggtgtacatcagcatcccccactacaagagcaccggcgaccccaagggcttcgccttcgtggagttcgagaccaaggagcaggccgccaaggccatcgagttcctgaacaacccccccgaggaggcccccagaaagcccggcatcttccccaagaccgtgaagaacaagcccatccccgccctgagagtggtggaggagaagaagaagaagaagaagaagaagggcagaatgaagaaggaggacaacatccaggccaaggaggagaacatggacaccagcaacaccagcatcagcaagatgaagagaagcagacccaccagcgagggcagcgacatcgagagcaccgagccccagaagcagtgcagcaagaagaagaagaagagagacagagtggaggccagcagcctgcccgaggtgagaaccggcaagagaaagagaagcagctag

SEQ ID NO: 86431 - DNA, 390 bp, Artificial Sequence
  Description of Artificial Sequence: Synthetic coding sequence
atggagaccgagagcggcaaccaggagaaggtgatggaggaggagagcaccgagaagaagaaggaggtggagaagaagaagagaagcagagtgaagcaggtgctggccgacatcgccaagcaggtggacttctggttcggcgacgccaacctgcacaaggacagattcctgagagagcagatcgagaagagcagagacggctacgtggacatcagcctgctggtgagcttcaacaagatgaagaagctgaccaccgacggcaagctgatcgccagagccctgagaagcagcgccgtggtggagctggacctggagggcaccagaatcagaagaaagaagcccctgggcgagagacccaaggacgaggacgagagaaccgtgtacgtgtag

SEQ ID NO: 86432 - DNA, 360 bp, Artificial Sequence
  Description of Artificial Sequence: Synthetic coding sequence
atggagaccgagagcggcaaccaggagaaggtgatggaggaggagagcaccgagaagaagaaggaggtggagaagaagaagagaagcagagtgaagcaggtgctggccgacatcgccaagcaggtggacttctggttcggcgacgccaacctgcacaaggacagattcctgagagagcagatcgagaagagcagagacggctacgtggacatcagcctgctggtgagcttcaacaagatgaagaagctgaccaccgacggcaagctgatcgccagagccctgagaagcagcgccgtggtggagctggacctggagggcaccagaatcagaagaaagaagcccctgggcgagagaccctag

SEQ ID NO: 86433 - DNA, 1770 bp, Artificial Sequence
  Description of Artificial Sequence: Synthetic coding sequence
atgatccccaacatcgagggcatggagaccgagagcggcaaccaggagaaggtgatggaggaggagagcaccgagaagaagaaggaggtggagaagaagaagagaagcagagtgaagcaggtgctggccgacatcgccaagcaggtggacttctggttcggcgacgccaacctgcacaaggacagattcctgagagagcagatcgagaagagcagagacggctacgtggacatcagcctgctggtgagcttcaacaagatgaagaagctgaccaccgacggcaagctgatcgccagagccctgagaagcagcgccgtggtggagctggacctggagggcaccagaatcagaagaaagaagcccctgggcgagagacccaaggacgaggacgagagaaccgtgtacgtggagctgctgcccaagaacgtgaaccacagctggatcgagagagtgttcggcaagtgcggcaacgtggtgtacatcagcatcccccactacaagagcaccggcgaccccaagggcttcgccttcgtggagttcgagaccaaggagcaggccgccaaggccatcgagttcctgaacaacccccccgaggaggcccccagaaagcccggcatcttccccaagaccgtgaagaacaagcccatccccgccctgagagtggtggaggagaagaagaagaagaagaagaagaagggcagaatgaagaaggaggacaacatccaggccaaggaggagaacatggacaccagcaacaccagcatcagcaagatgaagagaagcagacccaccagcgagggcagcgacatcgagagcaccgagccccagaagcagtgcagcaagaagaagaagaagagagacagagtggaggccagcagcctgcccgaggtgagaaccggcaagagaaagagaagcagcagcgaggacgccgagagcctggcccccagaagcaaggtgaagaagatcatccagaaggacatcatcaaggaggccagcgaggccagcaaggagaacagagacatcgagatcagcaccgaggaggagaaggacaccggcgacctgaaggacagcagcctgctgaagaccaagagaaagcacaagaagaagcacaaggagagacacaagatgggcgaggaggtgatccccctgagagtgctgagcaagagcgagtggatggacctgaagaaggagtacctggccctgcagaaggccagcatggccagcctgaagaagaccatcagccagatcaagagcgagagcgagatggagaccgacagcggcgtgccccagaacaccggcatgaagaacgagaagaccgccaacagagaggagtgcagaacccaggagaaggtgaacgccaccggcccccagttcgtgagcggcgtgatcgtgaagatcatcagcaccgagcccctgcccggcagaaagcaggtgagagacaccctggccgccatcagcgaggtgctgtacgtggacctgctggagggcgacaccgagtgccacgccagattcaagacccccgaggacgcccaggccgtgatcaacgcctacaccgagatcaacaagaagcactgctggaagctggagatcctgagcggcgaccacgagcagagatactggcagaagatcctggtggacagacaggccaagctgaaccagcccagagagaagaagagaggcaccgagaagctgatcaccaaggccgagaagatcagactggccaagacccagcaggccagcaagcacatcagattcagcgagtacgactag

SEQ ID NO: 86434 - DNA, 417 bp, Artificial Sequence
  Description of Artificial Sequence: Synthetic coding sequence
atgaagttcaccaccctgctgttcctggccgccgtggccggcgccctggtgtacgccgaggacgccagcagcgacagcaccggcgccgaccccgcccaggaggccggcaccagcaagcccaacgaggagatcagcggccccgccgagcccgccagcccccccgagaccaccaccaccgcccaggagaccagcgccgccgccgtgcagggcaccgccaaggtgaccagcagcagacaggagctgaaccccctgaagagcatcgtggagaagagcatcctgctgaccgagcaggccctggccaaggccggcaagggcatgcacggcggcgtgcccggcggcaagcagttcatcgagaacggcagcgagttcgcccagaagctgctgaagaagttcagcctgctgaagccctgggcctag

SEQ ID NO: 86435 - DNA, 429 bp, Artificial Sequence
  Description of Artificial Sequence: Synthetic coding sequence
atgagattcttcgtgcccctgttcctggtgggcatcctgttccccgccatcctggccaagcagttcaccaagtgcgagctgagccagctgctgaaggacatcgacggctacggcggcatcgccctgcccgagctgatctgcaccatgttccacaccagcggctacgacacccaggccatcgtggagaacaacgagagcaccgagtacggcctgttccagatcagcaacaagctgtggtgcaagagcagccaggtgccccagagcagaaacatctgcgacatcagctgcgacaagttcctggacgacgacatcaccgacgacatcatgtgcgccaagaagatcctggacatcaagggcatcgactactggctggcccacaaggccctgtgcaccgagaagctggagcagtggctgtgcgagaagctgtag

SEQ ID NO: 86436 - DNA, 1644 bp, Artificial Sequence
  Description of Artificial Sequence: Synthetic coding sequence
atgtacagactgatgagcgccgtgaccgccagagccgccgcccccggcggcctggccagcagctgcggcagaagaggcgtgcaccagagagccggcctgccccccctgggccacggctgggtgggcggcctgggcctgggcctgggcctggccctgggcgtgaagctggccggcggcctgagaggcgccgcccccgcccagagccccgccgcccccgaccccgaggccagccccctggccgagcccccccaggagcagagcctggccccctggagcccccagacccccgcccccccctgcagcagatgcttcgccagagccatcgagagcagcagagacctgctgcacagaatcaaggacgaggtgggcgcccccggcatcgtggtgggcgtgagcgtggacggcaaggaggtgtggagcgagggcctgggctacgccgacgtggagaacagagtgccctgcaagcccgagaccgtgatgagaatcgccagcatcagcaagagcctgaccatggtggccctggccaagctgtgggaggccggcaagctggacctggacatccccgtgcagcactacgtgcccgagttccccgagaaggagtacgagggcgagaaggtgagcgtgaccaccagactgctgatcagccacctgagcggcatcagacactacgagaaggacatcaagaaggtgaaggaggagaaggcctacaaggccctgaagatgatgaaggagaacgtggccttcgagcaggagaaggagggcaagagcaacgagaagaacgacttcaccaagttcaagaccgagcaggagaacgaggccaagtgcagaaacagcaagcccggcaagaagaagaacgacttcgagcagggcgagctgtacctgagagagaagttcgagaacagcatcgagagcctgagactgttcaagaacgaccccctgttcttcaagcccggcagccagttcctgtacagcaccttcggctacaccctgctggccgccatcgtggagagagccagcggctgcaagtacctggactacatgcagaagatcttccacgacctggacatgctgaccaccgtgcaggaggagaacgagcccgtgatctacaacagagccagattctacgtgtacaacaagaagaagagactggtgaacaccccctacgtggacaacagctacaagtgggccggcggcggcttcctgagcaccgtgggcgacctgctgaagttcggcaacgccatgctgtacggctaccaggtgggcctgttcaagaacagcaacgagaacctgctgcccggctacctgaagcccgagaccatggtgatgatgtggacccccgtgcccaacaccgagatgagctgggacaaggagggcaagtacgccatggcctggggcgtggtggagagaaagcagacctacggcagctgcagaaagcagagacactacgccagccacaccggcggcgccgtgggcgccagcagcgtgctgctggtgctgcccgaggagctggacaccgagaccatcaacaacaaggtgccccccagaggcatcatcgtgagcatcatctgcaacatgcagagcgtgggcctgaacagcaccgccctgaagatcgccctggagttcgacaaggacagaagcgactag

SEQ ID NO: 86437 - DNA, 1122 bp, Artificial Sequence
  Description of Artificial Sequence: Synthetic coding sequence
atgtacagactgatgagcgccgtgaccgccagagccgccgcccccggcggcctggccagcagctgcggcagaagaggcgtgcaccagagagccggcctgccccccctgggccacggctgggtgggcggcctgggcctgggcctgggcctggccctgggcgtgaagctggccggcggcctgagaggcgccgcccccgcccagagccccgccgcccccgaccccgaggccagccccctggccgagcccccccaggagcagagcctggccccctggagcccccagacccccgcccccccctgcagcagatgcttcgccagagccatcgagagcagcagagacctgctgcacagaatcaaggacgaggtgggcgcccccggcatcgtggtgggcgtgagcgtggacggcaaggaggtgtggagcgagggcctgggctacgccgacgtggagaacagagtgccctgcaagcccgagaccgtgatgagaatcgccagcatcagcaagagcctgaccatggtggccctggccaagctgtgggaggccggcaagctggacctggacatccccgtgcagcactacgtgcccgagttccccgagaaggagtacgagggcgagaaggtgagcgtgaccaccagactgctgatcagccacctgagcggcatcagacactacgagaaggacatcaagaaggtgaaggaggagaaggcctacaaggccctgaagatgatgaaggagaacgtggccttcgagcaggagaaggagggcaagagcaacgagaagaacgacttcaccaagttcaagaccgagcaggagaacgaggccaagtgcagaaacagcaagcccggcaagaagaagaacgacttcgagcagggcgagctgtacctgagagagaagttcgagaacagcatcgagagcctgagactgttcaagaacgaccccctgttcttcaagcccggcagccagttcctgtacagcaccttcggctacaccctgctggccgccatcgtggagagagccagcggctgcaagtacctggactacatgcagaagatcttccacgacctggacatgctgaccaccgtgcaggaggagaacgagcccgtgatctacaacagagccagatag

SEQ ID NO: 86438 - DNA, 5784 bp, Artificial Sequence
  Description of Artificial Sequence: Synthetic coding sequence
atggagctgagctggcacgtggtgttcatcgccctgctgagcttcagctgctggggcagcgactgggagagcgacagaaacttcatcagcaccgccggccccctgaccaacgacctgctgcacaacctgagcggcctgctgggcgaccagagcagcaacttcgtggccggcgacaaggacatgtacgtgtgccaccagcccctgcccaccttcctgcccgagtacttcagcagcctgcacgccagccagatcacccactacaaggtgttcctgagctgggcccagctgctgcccgccggcagcacccagaaccccgacgagaagaccgtgcagtgctacagaagactgctgaaggccctgaagaccgccagactgcagcccatggtgatcctgcaccaccagaccctgcccgccagcaccctgagaagaaccgaggccttcgccgacctgttcgccgactacgccaccttcgccttccacagcttcggcgacctggtgggcatctggttcaccttcagcgacctggaggaggtgatcaaggagctgccccaccaggagagcagagccagccagctgcagaccctgagcgacgcccacagaaaggcctacgagatctaccacgagagctacgccttccagggcggcaagctgagcgtggtgctgagagccgaggacatccccgagctgctgctggagccccccatcagcgccctggcccaggacaccgtggacttcctgagcctggacctgagctacgagtgccagaacgaggccagcctgagacagaagctgagcaagctgcagaccatcgagcccaaggtgaaggtgttcatcttcaacctgaagctgcccgactgccccagcaccatgaagaaccccgccagcctgctgttcagcctgttcgaggccatcaacaaggaccaggtgctgaccatcggcttcgacatcaacgagttcctgagctgcagcagcagcagcaagaagagcatgagctgcagcctgaccggcagcctggccctgcagcccgaccagcagcaggaccacgagaccaccgacagcagccccgccagcgcctaccagagaatctgggaggccttcgccaaccagagcagagccgagagagacgccttcctgcaggacaccttccccgagggcttcctgtggggcgccagcaccggcgccttcaacgtggagggcggctgggccgagggcggcagaggcgtgagcatctgggaccccagaagacccctgaacaccaccgagggccaggccaccctggaggtggccagcgacagctaccacaaggtggccagcgacgtggccctgctgtgcggcctgagagcccaggtgtacaagttcagcatcagctggagcagaatcttccccatgggccacggcagcagccccagcctgcccggcgtggcctactacaacaagctgatcgacagactgcaggacgccggcatcgagcccatggccaccctgttccactgggacctgccccaggccctgcaggaccacggcggctggcagaacgagagcgtggtggacgccttcctggactacgccgccttctgcttcagcaccttcggcgacagagtgaagctgtgggtgaccttccacgagccctgggtgatgagctacgccggctacggcaccggccagcacccccccggcatcagcgaccccggcgtggccagcttcaaggtggcccacctggtgctgaaggcccacgccagaacctggcaccactacaacagccaccacagaccccagcagcagggccacgtgggcatcgtgctgaacagcgactgggccgagcccctgagccccgagagacccgaggacctgagagccagcgagagattcctgcacttcatgctgggctggttcgcccaccccgtgttcgtggacggcgactaccccgccaccctgagaacccagatccagcagatgaacagacagtgcagccaccccgtggcccagctgcccgagttcaccgaggccgagaagcagctgctgaagggcagcgccgacttcctgggcctgagccactacaccagcagactgatcagcaacgccccccagaacacctgcatccccagctacgacaccatcggcggcttcagccagcacgtgaaccacgtgtggccccagaccagcagcagctggatcagagtggtgccctggggcatcagaagactgctgcagttcgtgagcctggagtacaccagaggcaaggtgcccatctacctggccggcaacggcatgcccatcggcgagagcgagaacctgttcgacgacagcctgagagtggactacttcaaccagtacatcaacgaggtgctgaaggccatcaaggaggacagcgtggacgtgagaagctacatcgccagaagcctgatcgacggcttcgagggccccagcggctacagccagagattcggcctgcaccacgtgaacttcagcgacagcagcaagagcagaacccccagaaagagcgcctacttcttcaccagcatcatcgagaagaacggcttcctgaccaagggcgccaagagactgctgccccccaacaccgtgaacctgcccagcaaggtgagagccttcaccttccccagcgaggtgcccagcaaggccaaggtggtgtgggagaagttcagcagccagcccaagttcgagagagacctgttctaccacggcaccttcagagacgacttcctgtggggcgtgagcagcagcgcctaccagatcgagggcgcctgggacgccgacggcaagggccccagcatctgggacaacttcacccacacccccggcagcaacgtgaaggacaacgccaccggcgacatcgcctgcgacagctaccaccagctggacgccgacctgaacatgctgagagccctgaaggtgaaggcctacagattcagcatcagctggagcagaatcttccccaccggcagaaacagcagcatcaacagccacggcgtggactactacaacagactgatcaacggcctggtggccagcaacatcttccccatggtgaccctgttccactgggacctgccccaggccctgcaggacatcggcggctgggagaaccccgccctgatcgacctgttcgacagctacgccgacttctgcttccagaccttcggcgacagagtgaagttctggatgaccttcaacgagcccatgtacctggcctggctgggctacggcagcggcgagttcccccccggcgtgaaggaccccggctgggccccctacagaatcgcccacgccgtgatcaaggcccacgccagagtgtaccacacctacgacgagaagtacagacaggagcagaagggcgtgatcagcctgagcctgagcacccactgggccgagcccaagagccccggcgtgcccagagacgtggaggccgccgacagaatgctgcagttcagcctgggctggttcgcccaccccatcttcagaaacggcgactaccccgacaccatgaagtggaaggtgggcaacagaagcgagctgcagcacctggccaccagcagactgcccagcttcaccgaggaggagaagagattcatcagagccaccgccgacgtgttctgcctgaacacctactacagcagaatcgtgcagcacaagacccccagactgaacccccccagctacgaggacgaccaggagatggccgaggaggaggaccccagctggcccagcaccgccatgaacagagccgccccctggggcaccagaagactgctgaactggatcaaggaggagtacggcgacatccccatctacatcaccgagaacggcgtgggcctgaccaaccccaacaccgaggacaccgacagaatcttctaccacaagacctacatcaacgaggccctgaaggcctacagactggacggcatcgacctgagaggctacgtggcctggagcctgatggacaacttcgagtggctgaacggctacaccgtgaagttcggcctgtaccacgtggacttcaacaacaccaacagacccagaaccgccagagccagcgccagatactacaccgaggtgatcaccaacaacggcatgcccctggccagagaggacgagttcctgtacggcagattccccgagggcttcatctggagcgccgccagcgccgcctaccagatcgagggcgcctggagagccgacggcaagggcctgagcatctgggacaccttcagccacacccccctgagagtggagaacgacgccatcggcgacgtggcctgcgacagctaccacaagatcgccgaggacctggtgaccctgcagaacctgggcgtgagccactacagattcagcatcagctggagcagaatcctgcccgacggcaccaccagatacatcaacgaggccggcctgaactactacgtgagactgatcgacaccctgctggccgccagcatccagccccaggtgaccatctaccactgggacctgccccagaccctgcaggacgtgggcggctgggagaacgagaccatcgtgcagagattcaaggagtacgccgacgtgctgttccagagactgggcgacaaggtgaagttctggatcaccctgaacgagcccttcgtgatcgcctaccagggctacggctacggcaccgccgcccccggcgtgagcaacagacccggcaccgccccctacatcgtgggccacaacctgatcaaggcccacgccgaggcctggcacctgtacaacgacgtgtacagagccagccagggcggcgtgatcagcatcaccatcagcagcgactgggccgagcccagagaccccagcaaccaggaggacgtggaggccgccagaagatacgtgcagttcatgggcggctggttcgcccaccccatcttcaagaacggcgactacaacgaggtgatgaagaccagaatcagagacagaagcctggccgccggcctgaacaagagcagactgcccgagttcaccgagagcgagaagagaagaatcaacggcacctacgacttcttcggcttcaaccactacaccaccgtgctggcctacaacctgaactacgccaccgccatcagcagcttcgacgccgacagaggcgtggccagcatcgccgacagaagctggcccgacagcggcagcttctggctgaagatgacccccttcggcttcagaagaatcctgaactggctgaaggaggagtacaacgacccccccatctacgtgaccgagaacggcgtgagccagagagaggagaccgacctgaacgacaccgccagaatctactacctgagaacctacatcaacgaggccctgaaggccgtgcaggacaaggtggacctgagaggctacaccgtgtggagcgccatggacaacttcgagtgggccaccggcttcagcgagagattcggcctgcacttcgtgaactacagcgaccccagcctgcccagaatccccaaggccagcgccaagttctacgccagcgtggtgagatgcaacggcttccccgaccccgccaccggcccccacgcctgcctgcaccagcccgacgccggccccaccatcagccccgtgagacaggaggaggtgcagttcctgggcctgatgctgggcaccaccgaggcccagaccgccctgtacgtgctgttcagcctggtgctgctgggcgtgtgcggcctggccttcctgagctacaagtactgcaagagaagcaagcagggcaagacccagagaagccagcaggagctgagccccgtgagcagcttctag

SEQ ID NO: 86439 - DNA, 3012 bp, Artificial Sequence
  Description of Artificial Sequence: Synthetic coding sequence
aaggtggcccacctggtgctgaaggcccacgccagaacctggcaccactacaacagccaccacagaccccagcagcagggccacgtgggcatcgtgctgaacagcgactgggccgagcccctgagccccgagagacccgaggacctgagagccagcgagagattcctgcacttcatgctgggctggttcgcccaccccgtgttcgtggacggcgactaccccgccaccctgagaacccagatccagcagatgaacagacagtgcagccaccccgtggcccagctgcccgagttcaccgaggccgagaagcagctgctgaagggcagcgccgacttcctgggcctgagccactacaccagcagactgatcagcaacgccccccagaacacctgcatccccagctacgacaccatcggcggcttcagccagcacgtgaaccacgtgtggccccagaccagcagcagctggatcagagtggtgccctggggcatcagaagactgctgcagttcgtgagcctggagtacaccagaggcaaggtgcccatctacctggccggcaacggcatgcccatcggcgagagcgagaacctgttcgacgacagcctgagagtggactacttcaaccagtacatcaacgaggtgctgaaggccatcaaggaggacagcgtggacgtgagaagctacatcgccagaagcctgatcgacggcttcgagggccccagcggctacagccagagattcggcctgcaccacgtgaacttcagcgacagcagcaagagcagaacccccagaaagagcgcctacttcttcaccagcatcatcgagaagaacggcttcctgaccaagggcgccaagagactgctgccccccaacaccgtgaacctgcccagcaaggtgagagccttcaccttccccagcgaggtgcccagcaaggccaaggtggtgtgggagaagttcagcagccagcccaagttcgagagagacctgttctaccacggcaccttcagagacgacttcctgtggggcgtgagcagcagcgcctaccagatcgagggcgcctgggacgccgacggcaagggccccagcatctgggacaacttcacccacacccccggcagcaacgtgaaggacaacgccaccggcgacatcgcctgcgacagctaccaccagctggacgccgacctgaacatgctgagagccctgaaggtgaaggcctacagattcagcatcagctggagcagaatcttccccaccggcagaaacagcagcatcaacagccacggcgtggactactacaacagactgatcaacggcctggtggccagcaacatcttccccatggtgaccctgttccactgggacctgccccaggccctgcaggacatcggcggctgggagaaccccgccctgatcgacctgttcgacagctacgccgacttctgcttccagaccttcggcgacagagtgaagttctggatgaccttcaacgagcccatgtacctggcctggctgggctacggcagcggcgagttcccccccggcgtgaaggaccccggctgggccccctacagaatcgcccacgccgtgatcaaggcccacgccagagtgtaccacacctacgacgagaagtacagacaggagcagaagggcgtgatcagcctgagcctgagcacccactgggccgagcccaagagccccggcgtgcccagagacgtggaggccgccgacagaatgctgcagttcagcctgggctggttcgcccaccccatcttcagaaacggcgactaccccgacaccatgaagtggaaggtgggcaacagaagcgagctgcagcacctggccaccagcagactgcccagcttcaccgaggaggagaagagattcatcagagccaccgccgacgtgttctgcctgaacacctactacagcagaatcgtgcagcacaagacccccagactgaacccccccagctacgaggacgaccaggagatggccgaggaggaggaccccagctggcccagcaccgccatgaacagagccgccccctggggcaccagaagactgctgaactggatcaaggaggagtacggcgacatccccatctacatcaccgagaacggcgtgggcctgaccaaccccaacaccgaggacaccgacagaatcttctaccacaagacctacatcaacgaggccctgaaggcctacagactggacggcatcgacctgagaggctacgtggcctggagcctgatggacaacttcgagtggctgaacggctacaccgtgaagttcggcctgtaccacgtggacttcaacaacaccaacagacccagaaccgccagagccagcgccagatactacaccgaggtgatcaccaacaacggcatgcccctggccagagaggacgagttcctgtacggcagattccccgagggcttcatctggagcgccgccagcgccgcctaccagatcgagggcgcctggagagccgacggcaagggcctgagcatctgggacaccttcagccacacccccctgagagtggagaacgacgccatcggcgacgtggcctgcgacagctaccacaagatcgccgaggacctggtgaccctgcagaacctgggcgtgagccactacagattcagcatcagctggagcagaatcctgcccgacggcaccaccagatacatcaacgaggccggcctgaactactacgtgagactgatcgacaccctgctggccgccagcatccagccccaggtgaccatctaccactgggacctgccccagaccctgcaggacgtgggcggctgggagaacgagaccatcgtgcagagattcaaggagtacgccgacgtgctgttccagagactgggcgacaaggtgaagttctggatcaccctgaacgagcccttcgtgatcgcctaccagggctacggctacggcaccgccgcccccgtgcacggcagactggtgtgcaccagctacttccaggagtggagactgcagtag

SEQ ID NO: 86440 - DNA, 1005 bp, Artificial Sequence
  Description of Artificial Sequence: Synthetic coding sequence
atggccaccctgaaggagaagctgatcgcccccgtggccgaggaggaggccaccgtgcccaacaacaagatcaccgtggtgggcgtgggccaggtgggcatggcctgcgccatcagcatcctgggcaagagcctggccgacgagctggccctggtggacgtgctggaggacaagctgaagggcgagatgatggacctgcagcacggcagcctgttcctgcagacccccaagatcgtggccgacaaggactacagcgtgaccgccaacagcaagatcgtggtggtgaccgccggcgtgagacagcaggagggcgagagcagactgaacctggtgcagagaaacgtgaacgtgttcaagttcatcatcccccagatcgtgaagtacagccccgactgcatcatcatcgtggtgagcaaccccgtggacatcctgacctacgtgacctggaagctgagcggcctgcccaagcacagagtgatcggcagcggctgcaacctggacagcgccagattcagatacctgatggccgagaagctgggcatccaccccagcagctgccacggctggatcctgggcgagcacggcgacagcagcgtggccgtgtggagcggcgtgaacgtggccggcgtgagcctgcaggagctgaaccccgagatgggcaccgacaacgacagcgagaactggaaggaggtgcacaagatggtggtggagagcgcctacgaggtgatcaagctgaagggctacaccaactgggccatcggcctgagcgtggccgacctgatcgagagcatgctgaagaacctgagcagaatccaccccgtgagcaccatggtgaagggcatgtacggcatcgagaacgaggtgttcctgagcctgccctgcatcctgaacgccagaggcctgaccagcgtgatcaaccagaagctgaaggacgacgaggtggcccagctgaagaagagcgccgacaccctgtgggacatccagaaggacctgaaggacctgtag

SEQ ID NO: 86441 - DNA, 699 bp, Artificial Sequence
  Description of Artificial Sequence: Synthetic coding sequence
atggccaccctgaaggagaagctgatcgcccccgtggccgaggaggaggccaccgtgcccaacaacaagatcaccgtggtgggcgtgggccaggtgggcatggcctgcgccatcagcatcctgggcaagagcctggccgacgagctggccctggtggacgtgctggaggacaagctgaagggcgagatgatggacctgcagcacggcagcctgttcctgcagacccccaagatcgtggccgacaaggactacagcgtgaccgccaacagcaagatcgtggtggtgaccgccggcgtgagacagcaggagggcgagagcagactgaacctggtgcagagaaacgtgaacgtgttcaagttcatcatcccccagatcgtgaagtacagccccgactgcatcatcatcgtggtgagcaaccccgtggacatcctgacctacgtgacctggaagctgagcggcctgcccaagcacagagtgatcggcagcggctgcaacctggacagcgccagattcagatacctgatggccgagaagctgggcatccaccccagcagctgccacggctggatcctgggcgagcacggcgacagcagcgtggccgtgtggagcggcgtgaacgtggccggcgtgagcctgcaggagctgaaccccgagatgggcaccgacaacgacagcgagaactggaaggaggtgcactag

SEQ ID NO: 86442 - DNA, 1005 bp, Artificial Sequence; identical to SEQ ID NO: 86440
  Description of Artificial Sequence: Synthetic coding sequence

SEQ ID NO: 86443 - DNA, 414 bp, Artificial Sequence
  Description of Artificial Sequence: Synthetic coding sequence
atggccaccctgaaggagaagctgatcgcccccgtggccgaggaggaggccaccgtgcccaacaacaagatcaccgtggtgggcgtgggccaggtgggcatggcctgcgccatcagcatcctgggcaagagcctggccgacgagctggccctggtggacgtgctggaggacaagctgaagggcgagatgatggacctgcagcacggcagcctgttcctgcagacccccaagatcgtggccgacaaggactacagcgtgaccgccaacagcaagatcgtggtggtgaccgccggcgtgagacagcaggagggcgagagcagactgaacctggtgcagagaaacgtgaacgtgttcaagttcatcatcccccagatcgtgaagtacagccccgactgcatcatcatcgtggtgtag

SEQ ID NO: 86444 - DNA, 309 bp, Artificial Sequence
  Description of Artificial Sequence: Synthetic coding sequence
atggccaccctgaaggagaagctgatcgcccccgtggccgaggaggaggccaccgtgcccaacaacaagatcaccgtggtgggcgtgggccaggtgggcatggcctgcgccatcagcatcctgggcaagagcctggccgacgagctggccctggtggacgtgctggaggacaagctgaagggcgagatgatggacctgcagcacggcagcctgttcctgcagacccccaagatcgtggccgacaaggactacagcgtgaccgccaacagcaagatcgtggtggtgaccgccggcgtgagacagcagtag

SEQ ID NO: 86445 - DNA, 999 bp, Artificial Sequence
  Description of Artificial Sequence: Synthetic coding sequence
atgagcaccgtgaaggagcagctgatcgagaagctgatcgaggacgacgagaacagccagtgcaagatcaccatcgtgggcaccggcgccgtgggcatggcctgcgccatcagcatcctgctgaaggacctggccgacgagctggccctggtggacgtggccctggacaagctgaagggcgagatgatggacctgcagcacggcagcctgttcttcagcaccagcaagatcaccagcggcaaggactacagcgtgagcgccaacagcagaatcgtgatcgtgaccgccggcgccagacagcaggagggcgagaccagactggccctggtgcagagaaacgtggccatcatgaagagcatcatccccgccatcgtgcactacagccccgactgcaagatcctggtggtgagcaaccccgtggacatcctgacctacatcgtgtggaagatcagcggcctgcccgtgaccagagtgatcggcagcggctgcaacctggacagcgccagattcagatacctgatcggcgagaagctgggcgtgcaccccaccagctgccacggctggatcatcggcgagcacggcgacagcagcgtgcccctgtggagcggcgtgaacgtggccggcgtggccctgaagaccctggaccccaagctgggcaccgacagcgacaaggagcactggaagaacatccacaagcaggtgatccagagcgcctacgagatcatcaagctgaagggctacaccagctgggccatcggcctgagcgtgatggacctggtgggcagcatcctgaagaacctgagaagagtgcaccccgtgagcaccatggtgaagggcctgtacggcatcaaggaggagctgttcctgagcatcccctgcgtgctgggcagaaacggcgtgagcgacgtggtgaagatcaacctgaacagcgaggaggaggccctgttcaagaagagcgccgagaccctgtggaacatccagaaggacctgatcttctag

SEQ ID NO: 86446 - DNA, 999 bp, Artificial Sequence; identical to SEQ ID NO: 86445
  Description of Artificial Sequence: Synthetic coding sequence

SEQ ID NO: 86447 - DNA, 1524 bp, Artificial Sequence
  Description of Artificial Sequence: Synthetic coding sequence
atggccagactgctgagaagcgccacctgggagctgttcccctggagaggctactgcagccagaaggccaagggcgagctgtgcagagacttcgtggaggccctgaaggccgtggtgggcggcagccacgtgagcaccgccgccgtggtgagagagcagcacggcagagacgagagcgtgcacagatgcgagccccccgacgccgtggtgtggccccagaacgtggagcaggtgagcagactggccgccctgtgctacagacagggcgtgcccatcatccccttcggcaccggcaccggcctggagggcggcgtgtgcgccgtgcagggcggcgtgtgcgtgaacctgacccacatggacagaatcctggagctgaaccaggaggacttcagcgtggtggtggagcccggcgtgaccagaaaggccctgaacgcccacctgagagacagcggcctgtggttccccgtggaccccggcgccgacgccagcctgtgcggcatggccgccaccggcgccagcggcaccaacgccgtgagatacggcaccatgagagacaacgtgctgaacctggaggtggtgctgcccgacggcagactgctgcacaccgccggcagaggcagacacttcagattcggcttctggcccgagatcccccaccacaccgcctggtacagcccctgcgtgagcctgggcagaagaaagagcgccgccggctacaacctgaccggcctgttcgtgggcagcgagggcaccctgggcctgatcaccgccaccaccctgagactgcaccccgcccccgaggccaccgtggccgccacctgcgccttccccagcgtgcaggccgccgtggacagcaccgtgcacatcctgcaggccgccgtgcccgtggccagaatcgagttcctggacgaggtgatgatggacgcctgcaacagatacagcaagctgaactgcctggtggcccccaccctgttcctggagttccacggcagccagcaggccctggaggagcagctgcagagaaccgaggagatcgtgcagcagaacggcgccagcgacttcagctgggccaaggaggccgaggagagaagcagactgtggaccgccagacacaacgcctggtacgccgccctggccaccagacccggctgcaagggctacagcaccgacgtgtgcgtgcccatcagcagactgcccgagatcgtggtgcagaccaaggaggacctgaacgccagcggcctgaccggcagcatcgtgggccacgtgggcgacggcaacttccactgcatcctgctggtgaaccccgacgacgccgaggagctgggcagagtgaaggccttcgccgagcagctgggcagaagagccctggccctgcacggcacctgcaccggcgagcacggcatcggcatgggcaagagacagctgctgcaggaggaggtgggcgccgtgggcgtggagaccatgagacagctgaaggccgtgctggacccccagggcctgatgaaccccggcaaggtgctgtag

SEQ ID NO: 86448 - DNA, 1455 bp, Artificial Sequence
  Description of Artificial Sequence: Synthetic coding sequence
atggccagactgctgagaagcgccacctgggagctgttcccctggagaggctactgcagccagaaggccaagggcgagctgtgcagagacttcgtggaggccctgaaggccgtggtgggcggcagccacgtgagcaccgccgccgtggtgagagagcagcacggcagagacgagagcgtgcacagatgcgagccccccgacgccgtggtgtggccccagaacgtggagcaggtgagcagactggccgccctgtgctacagacagggcgtgcccatcatccccttcggcaccggcaccggcctggagggcggcgtgtgcgccgtgcagggcggcgtgtgcgtgaacctgacccacatggacagaatcctggagctgaaccaggaggacttcagcgtggtggtggagcccggcgtgaccagaaaggccctgaacgcccacctgagagacagcggcctgtggttccccgtggaccccggcgccgacgccagcctgtgcggcatggccgccaccggcgccagcggcaccaacgccgtgagatacggcaccatgagagacaacgtgctgaacctggaggtggtgctgcccgacggcagactgctgcacaccgccggcagaggcagacacttcagaaagagcgccgccggctacaacctgaccggcctgttcgtgggcagcgagggcaccctgggcctgatcaccgccaccaccctgagactgcaccccgcccccgaggccaccgtggccgccacctgcgccttccccagcgtgcaggccgccgtggacagcaccgtgcacatcctgcaggccgccgtgcccgtggccagaatcgagttcctggacgaggtgatgatggacgcctgcaacagatacagcaagctgaactgcctggtggcccccaccctgttcctggagttccacggcagccagcaggccctggaggagcagctgcagagaaccgaggagatcgtgcagcagaacggcgccagcgacttcagctgggccaaggaggccgaggagagaagcagactgtggaccgccagacacaacgcctggtacgccgccctggccaccagacccggctgcaagggctacagcaccgacgtgtgcgtgcccatcagcagactgcccgagatcgtggtgcagaccaaggaggacctgaacgccagcggcctgaccggcagcatcgtgggccacgtgggcgacggcaacttccactgcatcctgctggtgaaccccgacgacgccgaggagctgggcagagtgaaggccttcgccgagcagctgggcagaagagccctggccctgcacggcacctgcaccggcgagcacggcatcggcatgggcaagagacagctgctgcaggaggaggtgggcgccgtgggcgtggagaccatgagacagctgaaggccgtgctggacccccagggcctgatgaaccccggcaaggtgctgtag

SEQ ID NO: 86449 - DNA, 2139 bp, Artificial Sequence
  Description of Artificial Sequence: Synthetic coding sequence
atgagagtgctgctgcacctgcccgccctgctggccagcctgatcctgctgcaggccgccgccagcaccaccagagcccagaccaccagaaccagcgccatcagcgacaccgtgagccaggccaaggtgcaggtgaacaaggccttcctggacagcagaaccagactgaagaccgccatgagcagcgagacccccaccagcagacagctgagcgagtacctgaagcacgccaagggcagaaccagaaccgccatcagaaacggccaggtgtgggaggagagcctgaagagactgagacagaaggccagcctgaccaacgtgaccgaccccagcctggacctgaccagcctgagcctggaggtgggctgcggcgcccccgcccccgtggtgagatgcgacccctgcagcccctacagaaccatcaccggcgactgcaacaacagaagaaagcccgccctgggcgccgccaacagagccctggccagatggctgcccgccgagtacgaggacggcctgagcctgcccttcggctggacccccggcaagaccagaaacggcttccccctgcccctggccagagaggtgagcaacaagatcgtgggctacctgaacgaggagggcgtgctggaccagaacagaagcctgctgttcatgcagtggggccagatcgtggaccacgacctggacttcgcccccgacaccgagctgggcagcagcgagtacagcaaggcccagtgcgacgagtactgcatccagggcgacaactgcttccccatcatgttcccccccaacgaccccaaggccggcacccagggcaagtgcatgcccttcttcagagccggcttcgtgtgccccacccccccctacaagagcctggccagagagcagatcaacgccctgaccagcttcctggacgccagcttcgtgtacagcagcgagcccagcctggccagcagactgagaaacctgagcagccccctgggcctgatggccgtgaaccaggaggtgagcgaccacggcctgccctacctgccctacgacagcaagaagcccagcccctgcgagttcatcaacaccaccgccagagtgccctgcttcctggccggcgacagcagagccagcgagcacatcctgctggccaccagccacaccctgttcctgagagagcacaacagactggccagagagctgaagagactgaacccccagtgggacggcgagaagctgtaccaggaggccagaaagatcctgggcgccttcgtgcagatcatcaccttcagagactacctgcccatcctgctgggcgaccacatgcagaagtggatccccccctaccagggctacagcgagagcgtggaccccagaatcagcaacgtgttcaccttcgccttcagattcggccacctggaggtgcccagcagcatgttcagactggacgagaactaccagccctggggccccgagcccgagctgcccctgcacaccctgttcttcaacacctggagaatggtgaaggacggcggcatcgaccccctggtgagaggcctgctggccaagaagagcaagctgatgaagcagaacaagatgatgaccggcgagctgagaaacaagctgttccagcccacccacagaatccacggcttcgacctggccgccatcaacacccagagatgcagagaccacggccagcccggctacaacagctggagagccttctgcgacctgagccagccccagaccctggaggagctgaacaccgtgctgaagagcaagatgctggccaagaagctgctgggcctgtacggcacccccgacaacatcgacatctggatcggcgccatcgccgagcccctggtggagagaggcagagtgggccccctgctggcctgcctgctgggcaagcagttccagcagatcagagacggcgacagattctggtgggagaaccccggcgtgttcaccaacgagcagaaggacagcctgcagaagatgagcttcagcagactggtgtgcgacaacaccagaatcaccaaggtgcccagagaccccttctgggccaacagctacccctacgacttcgtggactgcagcgccatcgacaagctggacctgagcccctgggccagcgtgaagaactag

SEQ ID NO: 86450 - DNA, 1374 bp, Artificial Sequence
  Description of Artificial Sequence: Synthetic coding sequence
tgcttccccgtgcagttcccccccaacgaccccaaggccggcacccagggcaagtgcatgcccttcttcagagccggcttcgtgtgccccacccccccctacaagagcctggccagagagcagatcaacgccctgaccagcttcctggacgccagcttcgtgtacagcagcgagcccagcctggccagcagactgagaaacctgagcagccccctgggcctgatggccgtgaaccaggaggtgagcgaccacggcctgccctacctgccctacgacagcaagaagcccagcccctgcgagttcatcaacaccaccgccagagtgccctgcttcctggccggcgacagcagagccagcgagcacatcctgctggccaccagccacaccctgttcctgagagagcacaacagactggccagagagctgaagagactgaacccccagtgggacggcgagaagctgtaccaggaggccagaaagatcctgggcgccttcgtgcagatcatcaccttcagagactacctgcccatcctgctgggcgaccacatgcagaagtggatccccccctaccagggctacagcgagagcgtggaccccagaatcagcaacgtgttcaccttcgccttcagattcggccacctggaggtgcccagcagcatgttcagactggacgagaactaccagccctggggccccgagcccgagctgcccctgcacaccctgttcttcaacacctggagaatggtgaaggacggcggcatcgaccccctggtgagaggcctgctggccaagaagagcaagctgatgaagcagaacaagatgatgaccggcgagctgagaaacaagctgttccagcccacccacagaatccacggcttcgacctggccgccatcaacacccagagatgcagagaccacggccagcccggctacaacagctggagagccttctgcgacctgagccagccccagaccctggaggagctgaacaccgtgctgaagagcaagatgctggccaagaagctgctgggcctgtacggcacccccgacaacatcgacatctggatcggcgccatcgccgagcccctggtggagagaggcagagtgggccccctgctggcctgcctgctgggcaagcagttccagcagatcagagacggcgacagattctggtgggagaaccccggcgtgttcaccaacgagcagaaggacagcctgcagaagatgagcttcagcagactggtgtgcgacaacaccagaatcaccaaggtgcccagagaccccttctgggccaacagctacccctacgacttcgtggactgcagcgccatcgacaagctggacctgagcccctgggccagcgtgaagaactag

SEQ ID NO: 86451 - DNA, 1890 bp, Artificial Sequence
  Description of Artificial Sequence: Synthetic coding sequence
atgagagtgctgctgcacctgcccgccctgctggccagcctgatcctgctgcaggccgccgccagcaccaccagagaccccagcctggacctgaccagcctgagcctggaggtgggctgcggcgcccccgcccccgtggtgagatgcgacccctgcagcccctacagaaccatcaccggcgactgcaacaacagaagaaagcccgccctgggcgccgccaacagagccctggccagatggctgcccgccgagtacgaggacggcctgagcctgcccttcggctggacccccggcaagaccagaaacggcttccccctgcccctggccagagaggtgagcaacaagatcgtgggctacctgaacgaggagggcgtgctggaccagaacagaagcctgctgttcatgcagtggggccagatcgtggaccacgacctggacttcgcccccgacaccgagctgggcagcagcgagtacagcaaggcccagtgcgacgagtactgcatccagggcgacaactgcttccccatcatgttcccccccaacgaccccaaggccggcacccagggcaagtgcatgcccttcttcagagccggcttcgtgtgccccacccccccctacaagagcctggccagagagcagatcaacgccctgaccagcttcctggacgccagcttcgtgtacagcagcgagcccagcctggccagcagactgagaaacctgagcagccccctgggcctgatggccgtgaaccaggaggtgagcgaccacggcctgccctacctgccctacgacagcaagaagcccagcccctgcgagttcatcaacaccaccgccagagtgccctgcttcctggccggcgacagcagagccagcgagcacatcctgctggccaccagccacaccctgttcctgagagagcacaacagactggccagagagctgaagagactgaacccccagtgggacggcgagaagctgtaccaggaggccagaaagatcctgggcgccttcgtgcagatcatcaccttcagagactacctgcccatcctgctgggcgaccacatgcagaagtggatccccccctaccagggctacagcgagagcgtggaccccagaatcagcaacgtgttcaccttcgccttcagattcggccacctggaggtgcccagcagcatgttcagactggacgagaactaccagccctggggccccgagcccgagctgcccctgcacaccctgttcttcaacacctggagaatggtgaaggacggcggcatcgaccccctggtgagaggcctgctggccaagaagagcaagctgatgaagcagaacaagatgatgaccggcgagctgagaaacaagctgttccagcccacccacagaatccacggcttcgacctggccgccatcaacacccagagatgcagagaccacggccagcccggctacaacagctggagagccttctgcgacctgagccagccccagaccctggaggagctgaacaccgtgctgaagagcaagatgctggccaagaagctgctgggcctgtacggcacccccgacaacatcgacatctggatcggcgccatcgccgagcccctggtggagagaggcagagtgggccccctgctggcctgcctgctgggcaagcagttccagcagatcagagacggcgacagattctggtgggagaaccccggcgtgttcaccaacgagcagaaggacagcctgcagaagatgagcttcagcagactggtgtgcgacaacaccagaatcaccaaggtgcccagagaccccttctgggccaacagctacccctacgacttcgtggactgcagcgccatcgacaagctggacctgagcccctgggccagcgtgaagaactag

SEQ ID NO: 86452 - DNA, 1962 bp, Artificial Sequence
  Description of Artificial Sequence: Synthetic coding sequence
atgagcagcgagacccccaccagcagacagctgagcgagtacctgaagcacgccaagggcagaaccagaaccgccatcagaaacggccaggtgtgggaggagagcctgaagagactgagacagaaggccagcctgaccaacgtgaccgaccccagcctggacctgaccagcctgagcctggaggtgggctgcggcgcccccgcccccgtggtgagatgcgacccctgcagcccctacagaaccatcaccggcgactgcaacaacagaagaaagcccgccctgggcgccgccaacagagccctggccagatggctgcccgccgagtacgaggacggcctgagcctgcccttcggctggacccccggcaagaccagaaacggcttccccctgcccctggccagagaggtgagcaacaagatcgtgggctacctgaacgaggagggcgtgctggaccagaacagaagcctgctgttcatgcagtggggccagatcgtggaccacgacctggacttcgcccccgacaccgagctgggcagcagcgagtacagcaaggcccagtgcgacgagtactgcatccagggcgacaactgcttccccatcatgttcccccccaacgaccccaaggccggcacccagggcaagtgcatgcccttcttcagagccggcttcgtgtgccccacccccccctacaagagcctggccagagagcagatcaacgccctgaccagcttcctggacgccagcttcgtgtacagcagcgagcccagcctggccagcagactgagaaacctgagcagccccctgggcctgatggccgtgaaccaggaggtgagcgaccacggcctgccctacctgccctacgacagcaagaagcccagcccctgcgagttcatcaacaccaccgccagagtgccctgcttcctggccggcgacagcagagccagcgagcacatcctgctggccaccagccacaccctgttcctgagagagcacaacagactggccagagagctgaagagactgaacccccagtgggacggcgagaagctgtaccaggaggccagaaagatcctgggcgccttcgtgcagatcatcaccttcagagactacctgcccatcctgctgggcgaccacatgcagaagtggatccccccctaccagggctacagcgagagcgtggaccccagaatcagcaacgtgttcaccttcgccttcagattcggccacctggaggtgcccagcagcatgttcagactggacgagaactaccagccctggggccccgagcccgagctgcccctgcacaccctgttcttcaacacctggagaatggtgaaggacggcggcatcgaccccctggtgagaggcctgctggccaagaagagcaagctgatgaagcagaacaagatgatgaccggcgagctgagaaacaagctgttccagcccacccacagaatccacggcttcgacctggccgccatcaacacccagagatgcagagaccacggccagcccggctacaacagctggagagccttctgcgacctgagccagccccagaccctggaggagctgaacaccgtgctgaagagcaagatgctggccaagaagctgctgggcctgtacggcacccccgacaacatcgacatctggatcggcgccatcgccgagcccctggtggagagaggcagagtgggccccctgctggcctgcctgctgggcaagcagttccagcagatcagagacggcgacagattctggtgggagaaccccggcgtgttcaccaacgagcagaaggacagcctgcagaagatgagcttcagcagactggtgtgcgacaacaccagaatcaccaaggtgcccagagaccccttctgggccaacagctacccctacgacttcgtggactgcagcgccatcgacaagctggacctgagcccctgggccagcgtgaagaactag

SEQ ID NO: 86453 - DNA, 1323 bp, Artificial Sequence
  Description of Artificial Sequence: Synthetic coding sequence
atgggcgacctggagctgctgctgcccggcgaggccgaggtgctggtgagaggcctgagaagcttccccctgagagagatgggcagcgagggctggaaccagcagcacgagaacctggagaagctgaacatgcaggccatcctggacgccaccgtgagccagggcgagcccatccaggagctgctggtgacccacggcaaggtgcccaccctggtggaggagctgatcgccgtggagatgtggaagcagaaggtgttccccgtgttctgcagagtggaggacttcaagccccagaacaccttccccatctacatggtggtgcaccacgaggccagcatcatcaacctgctggagaccgtgttcttccacaaggaggtgtgcgagagcgccgaggacaccgtgctggacctggtggactactgccacagaaagctgaccctgctggtggcccagagcggctgcggcggcccccccgagggcgagggcagccaggacagcaaccccatgcaggagctgcagaagcaggccgagctgatggagttcgagatcgccctgaaggccctgagcgtgctgagatacatcaccgactgcgtggacagcctgagcctgagcaccctgagcagaatgctgagcacccacaacctgccctgcctgctggtggagctgctggagcacagcccctggagcagaagagagggcggcaagctgcagcagttcgagggcagcagatggcacaccgtggcccccagcgagcagcagaagctgagcaagctggacggccaggtgtggatcgccctgtacaacctgctgctgagccccgaggcccaggccagatactgcctgaccagcttcgccaagggcagactgctgaagctgagagccttcctgaccgacaccctgctggaccagctgcccaacctggcccacctgcagagcttcctggcccacctgaccctgaccgagacccagccccccaagaaggacctggtgctggagcagatccccgagatctgggagagactggagagagagaacagaggcaagtggcaggccatcgccaagcaccagctgcagcacgtgttcagccccagcgagcaggacctgagactgcaggccagaagatgggccgagacctacagactggacgtgctggaggccgtggcccccgagagacccagatgcgcctactgcagcgccgaggccagcaagagatgcagcagatgccagaacgagtggtactgctgcagagagtgccaggtgaagcactgggagaagcacggcaagacctgcgtgctggccgcccagggcgacagagccaagtag

SEQ ID NO: 86454 - DNA, 2001 bp, Artificial Sequence
  Description of Artificial Sequence: Synthetic coding sequence
atgagaaaggtgagaggcccccccgtgagctgcatcaagagagacagccccatccagtgcatccaggccatcgccgagaacagagccgacgccgtgaccctggacggcggcttcatctacgaggccggcctggccccctacaagctgagacccgtggccgccgaggtgtacggcaccgagagacagcccagaacccactactacgccgtggccgtggtgaagaagggcggcagcttccagctgaacgagctgcagggcctgaagagctgccacaccggcctgagaagaaccgccggctggaacgtgcccatcggcaccctgagacccttcctgaactggaccggcccccccgagcccatcgaggccgccgtggccagattcttcagcgccagctgcgtgcccggcgccgacaagggccagttccccaacctgtgcagactgtgcgccggcaccggcgagaacaagtgcgccttcagcagccaggagccctacttcagctacagcggcgccttcaagtgcctgagagacggcgccggcgacgtggccttcatcagagagagcaccgtgttcgaggacctgagcgacgaggccgagagagacgagtacgagctgctgtgccccgacaacaccagaaagcccgtggacaagttcaaggactgccacctggccagagtgcccagccacgccgtggtggccagaagcgtgaacggcaaggaggacgccatctggaacctgctgagacaggcccaggagaagttcggcaaggacaagagccccaagttccagctgttcggcagccccagcggccagaaggacctgctgttcaaggacagcgccatcggcttcagcagagtgccccccagaatcgacagcggcctgtacctgggcagcggctacttcaccgccatccagaacctgagaaagagcgaggaggaggtggccgccagaagagccagagtggtgtggtgcgccgtgggcgagcaggagctgagaaagtgcaaccagtggagcggcctgagcgagggcagcgtgacctgcagcagcgccagcaccaccgaggactgcatcgccctggtgctgaagggcgaggccgacgccatgagcctggacggcggctacgtgtacaccgccggcaagtgcggcctggtgcccgtgctggccgagaactacaagagccagcagagcagcgaccccgaccccaactgcgtggacagacccgtggagggctacctggccgtggccgtggtgagaagaagcgacaccagcctgacctggaacagcgtgaagggcaagaagagctgccacaccgccgtggacagaaccgccggctggaacatccccatgggcctgctgttcaaccagaccggcagctgcaagttcgacgagtacttcagccagagctgcgcccccggcagcgaccccagaagcaacctgtgcgccctgtgcatcggcgacgagcagggcgagaacaagtgcgtgcccaacagcaacgagagatactacggctacaccggcgccttcagatgcctggccgagaacgccggcgacgtggccttcgtgaaggacgtgaccgtgctgcagaacaccgacggcaacaacaacgaggcctgggccaaggacctgaagctggccgacttcgccctgctgtgcctggacggcaagagaaagcccgtgaccgaggccagaagctgccacctggccatggcccccaaccacgccgtggtgagcagaatggacaaggtggagagactgaagcaggtgctgctgcaccagcaggccaagttcggcagaaacggcagcgactgccccgacaagttctgcctgttccagagcgagaccaagaacctgctgttcaacgacaacaccgagtgcctggccagactgcacggcaagaccacctacgagaagtacctgggcccccagtacgtggccggcatcaccaacctgaagaagtgcagcaccagccccctgctggaggcctgcgagttcctgagaaagtag

SEQ ID NO: 86455 - DNA, 453 bp, Artificial Sequence
  Description of Artificial Sequence: Synthetic coding sequence
atgaagctggtgttcctggtgctgctgttcctgggcgccctgggcctgtgcctggccggcagaagaagaagcgtgcagtggtgcgccgtgagccagcccgaggccaccaagtgcttccagtggcagagaaacatgagaaaggtgagaggcccccccgtgagctgcatcaagagagacagccccatccagtgcatccaggccatcgccgagaacagagccgacgccgtgaccctggacggcggcttcatctacgaggccggcctggccccctacaagctgagacccgtggccgccgaggtgtacggcaccgagagacagcccgccgtgttccccgtgcagatcaaggacagcagccccacctgcgtggcctgcgtgagaggccagggcaagaccaacgtgcccagcccccccagaaacagaaccagcgccaccctggtgcccagcagcgtgtag

SEQ ID NO: 86456 - DNA, 846 bp, Artificial Sequence
  Description of Artificial Sequence: Synthetic coding sequence
atgaccagcaaggaggacggcaaggccgcccccggcgaggagagaagaagaagccccctggaccacctgcccccccccgccaacagcaacaagcccctgacccccttcagcatcgaggacatcctgaacaagcccagcgtgagaagaagctacagcctgtgcggcgccgcccacctgctggccgccgccgacaagcacgcccagggcggcctgcccctggccggcagagccctgctgagccagaccagccccctgtgcgccctggaggagctggccagcaagaccttcaagggcctggaggtgagcgtgctgcaggccgccgagggcagagacggcatgaccatcttcggccagagacagacccccaagaagagaagaaagagcagaaccgccttcaccaaccaccagatctacgagctggagaagagattcctgtaccagaagtacctgagccccgccgacagagaccagatcgcccagcagctgggcctgaccaacgcccaggtgatcacctggttccagaacagaagagccaagctgaagagagacctggaggagatgaaggccgacgtggagagcgccaagaagctgggccccagcggccagatggacatcgtggccctggccgagctggagcagaacagcgaggccaccgccggcggcggcggcggctgcggcagagccaagagcagacccggcagccccgtgctgccccccggcgcccccaaggcccccggcgccggcgccctgcagctgagccccgccagccccctgaccgaccagcccgccagcagccaggactgcagcgaggacgaggaggacgaggagatcgacgtggacgactag

SEQ ID NO: 86457 - DNA, 597 bp, Artificial Sequence
  Description of Artificial Sequence: Synthetic coding sequence
atgaacagcggcagagagcccagaacccccagaaccctgctgagcatcgccgacatcctggcccccagaatggtgcccagagcccccagcgccccccagctgcccgagagcggccccggccccaccagccccctgtgcgccctggaggagctgaccagcaagaccttcagaggcctggacgccagagccctgcagcccagcgagggcagagccggccccgacgccctgggccccggccccttcggcagaaagagaagaaagagcagaaccgccttcaccgcccagcaggtgctggagctggagagaagattcgtgttccagaagtacctggcccccagcgagagagacggcctggccaccagactgggcctggccaacgcccaggtggtgacctggttccagaacagaagagccaagctgaagagagacgtggaggagatgagagccgacgtggccagcctgagagccctgagccccgaggtgctgtgcagcctggccctgcccgagggcgcccccgaccccggcctgtgcctgggccccgccggccccgacagcagaccccacctgagcgacgaggagatccaggtggacgactag

SEQ ID NO: 86458 - DNA, 585 bp, Artificial Sequence
  Description of Artificial Sequence: Synthetic coding sequence
atgggcaagagaaccagcctggaggtgagcctgggcgagctgggcggcgagaagtgcagaggcggcagaagaagcttcccccccctggccgccagcagacccgccagacccggcggctggagatgggccagaagagacctgtgcaagaccgccagcagagccgagaacaacagccaggcctgcagaccccagagaagagccggccccgacgccctgggccccggccccttcggcagaaagagaagaaagagcagaaccgccttcaccgcccagcaggtgctggagctggagagaagattcgtgttccagaagtacctggcccccagcgagagagacggcctggccaccagactgggcctggccaacgcccaggtggtgacctggttccagaacagaagagccaagctgaagagagacgtggaggagatgagagccgacgtggccagcctgagagccctgagccccgaggtgctgtgcagcctggccctgcccgagggcgcccccgaccccggcctgtgcctgggccccgccggccccgacagcagaccccacctgagcgacgaggagatccaggtggacgactag

SEQ ID NO: 86459 - DNA, 1398 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggacgaggacggcgacgacctgctgcaccaccaccacgtgagcggcagcagaagatag

SEQ ID NO: 86460 - DNA, 1905 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgagggcagccactgcagcagcagcggcgaccccgccgagtacaacctgagaagcagaaccgtgctgtgcggcacctgcggccagcccgccgacaaggccagcgccagcggcagcggcgcccaggtgggcggccccatcagcagcggcagcagcgccagcagcgtgaccgtgaccagaagctacagaagcgtgggcggcagcggcggcggcagcttcggcgacaacctggtgaccagaagctacctgctgggcaacagcagccccagaacccagagcccccagaactgcagcatcatgtag

SEQ ID NO: 86461 - DNA, 1719 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacgtgagcggcagcagaagatag

SEQ ID NO: 86462 - DNA, 1476 bp, Artificial Sequence
  Description of Artificial Sequence: Synthetic coding sequence
atgcagcccctgctgtgcctgggcaacctggaggacgccagagagagaaccggcaccctgctggcccagcaccccgcctggggcagaaccagagccaagcccggcagccccctgaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacgtgagcggcagcagaagatag

SEQ ID NO: 86463 - DNA, 1845 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacggcagccactgcagcagcagcggcgaccccgccgagtacaacctgagaagcagaaccgtgctgtgcggcacctgcggccagcccgccgacaaggccagcgccagcggcagcggcgcccagagcccccagaactgcagcatcatgtag

SEQ ID NO: 86464 - DNA, 1995 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacggcagccactgcagcagcagcggcgaccccgccgagtacaacctgagaagcagaaccgtgctgtgcggcacctgcggccagcccgccgacaaggccagcgccagcggcagcggcgcccaggtgggcggccccatcagcagcggcagcagcgccagcagcgtgaccgtgaccagaagctacagaagcgtgggcggcagcggcggcggcagcttcggcgacaacctggtgaccagaagctacctgctgggcaacagcagccccagaacccagagcccccagaactgcagcatcatgtag

SEQ ID NO: 86465 - DNA, 1719 bp, Artificial Sequence; identical to SEQ ID NO: 86461
  Description of Artificial Sequence: Synthetic coding sequence

SEQ ID NO: 86466 - DNA, 1476 bp, Artificial Sequence; identical to SEQ ID NO: 86462
  Description of Artificial Sequence: Synthetic coding sequence

SEQ ID NO: 86467 - DNA, 1464 bp, Artificial Sequence
  Description of Artificial Sequence: Synthetic coding sequence
atggagacccccagccagagaagagccaccagaagcggcgcccaggccagcagcacccccctgagccccaccagaatcaccagactgcaggagaaggaggacctgcaggagctgaacgacagactggccgtgtacatcgacagagtgagaagcctggagaccgagaacgccggcctgagactgagaatcaccgagagcgaggaggtggtgagcagagaggtgagcggcatcaaggccgcctacgaggccgagctgggcgacgccagaaagaccctggacagcgtggccaaggagagagccagactgcagctggagctgagcaaggtgagagaggagttcaaggagctgaaggccagaaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacgtgagcggcagcagaagatag

SEQ ID NO: 86468 - DNA, 1725 bp, Artificial Sequence
  Description of Artificial Sequence: Synthetic coding sequence
atgggcaacagcgagggctgcaacaccaagaaggagggcgacctgatcgccgcccaggccagactgaaggacctggaggccctgctgaacagcaaggaggccgccctgagcaccgccctgagcgagaagagaaccctggagggcgagctgcacgacctgagaggccaggtggccaagctggaggccgccctgggcgaggccaagaagcagctgcaggacgagatgctgagaagagtggacgccgagaacagactgcagaccatgaaggaggagctggacttccagaagaacatctacagcgaggagctgagagagaccaagagaagacacgagaccagactggtggagatcgacaacggcaagcagagagagttcgagagcagactggccgacgccctgcaggagctgagagcccagcacgaggaccaggtggagcagtacaagaaggagctggagaagacctacagcgccaagctggacaacgccagacagagcgccgagagaaacagcaacctggtgggcgccgcccacgaggagctgcagcagagcagaatcagaatcgacagcctgagcgcccagctgagccagctgcagaagcagctggccgccaaggaggccaagctgagagacctggaggacagcctggccagagagagagacaccagcagaagactgctggccgagaaggagagagagatggccgagatgagagccagaatgcagcagcagctggacgagtaccaggagctgctggacatcaagctggccctggacatggagatccacgcctacagaaagctgctggagggcgaggaggagagactgagactgagccccagccccaccagccagagaagcagaggcagagccagcagccacagcagccagacccagggcggcggcagcgtgaccaagaagagaaagctggagagcaccgagagcagaagcagcttcagccagcacgccagaaccagcggcagagtggccgtggaggaggtggacgaggagggcaagttcgtgagactgagaaacaagagcaacgaggaccagagcatgggcaactggcagatcaagagacagaacggcgacgaccccctgctgacctacagattcccccccaagttcaccctgaaggccggccaggtggtgaccatctgggccgccggcgccggcgccacccacagcccccccaccgacctggtgtggaaggcccagaacacctggggctgcggcaacagcctgagaaccgccctgatcaacagcaccggcgaggaggtggccatgagaaagctggtgagaagcgtgaccgtggtggaggacgacgaggacgaggacggcgacgacctgctgcaccaccaccacggcagccactgcagcagcagcggcgaccccgccgagtacaacctgagaagcagaaccgtgctgtgcggcacctgcggccagcccgccgacaaggccagcgccagcggcagcggcgcccaggtgggcggccccatcagcagcggcagcagcgccagcagcgtgaccgtgaccagaagctacagaagcgtgggcggcagcggcggcggcagcttcggcgacaacctggtgaccagaagctacctgctgggcaacagcagccccagaacccagagcccccagaactgcagcatcatccaggagatgggcatgagatgggaggtggaggagggcagaagaaaggtgagcctgagctgcctgccctag

SEQ ID NO: 86469 - DNA, 1848 bp, Artificial Sequence
  Description of Artificial Sequence: Synthetic coding sequence
atgcccagcagaaagttcgccgacggcgaggtggtgagaggcagatggcccggcagcagcctgtactacgaggtggagatcctgagccacgacagcaccagccagctgtacaccgtgaagtacaaggacggcaccgagctggagctgaaggagaacgacatcaagcccctgaccagcttcagacagagaaagggcggcagcaccagcagcagccccagcagaagaagaggcagcagaagcagaagcagaagcagaagccccggcagaccccccaagagcgccagaagaagcgccagcgccagccaccaggccgacatcaaggaggccagaagagaggtggaggtgaagctgacccccctgatcctgaagcccttcggcaacagcatcagcagatacaacggcgagcccgagcacatcgagagaaacgacgccccccacaagaacacccaggagaagttcagcctgagccaggagagcagctacatcgccacccagtacagcctgagacccagaagagaggaggtgaagctgaaggagatcgacagcaaggaggagaagtacgtggccaaggagctggccgtgagaaccttcgaggtgacccccatcagagccaaggacctggagttcggcggcgtgcccggcgtgttcctgatcatgttcggcctgcccgtgttcctgttcctgctgctgctgatgtgcaagcagaaggaccccagcctgctgaacttccccccccccctgcccgccctgtacgagctgtgggagaccagagtgttcggcgtgtacctgctgtggttcctgatccaggtgctgttctacctgctgcccatcggcaaggtggtggagggcacccccctgatcgacggcagaagactgaagtacagactgaacggcttctacgccttcatcctgaccagcgccgtgatcggcaccagcctgttccagggcgtggagttccactacgtgtacagccacttcctgcagttcgccctggccgccaccgtgttctgcgtggtgctgagcgtgtacctgtacatgagaagcctgaaggcccccagaaacgacctgagccccgccagcagcggcaacgccgtgtacgacttcttcatcggcagagagctgaaccccagaatcggcaccttcgacctgaagtacttctgcgagctgagacccggcctgatcggctgggtggtgatcaacctggtgatgctgctggccgagatgaagatccaggacagagccgtgcccagcctggccatgatcctggtgaacagcttccagctgctgtacgtggtggacgccctgtggaacgaggaggccctgctgaccaccatggacatcatccacgacggcttcggcttcatgctggccttcggcgacctggtgtgggtgcccttcatctacagcttccaggccttctacctggtgagccaccccaacgaggtgagctggcccatggccagcctgatcatcgtgctgaagctgtgcggctacgtgatcttcagaggcgccaacagccagaagaacgccttcagaaagaaccccagcgaccccaagctggcccacctgaagaccatccacaccagcaccggcaagaacctgctggtgagcggctggtggggcttcgtgagacaccccaactacctgggcgacctgatcatggccctggcctggagcctgccctgcggcttcaaccacatcctgccctacttctacatcatctacttcaccatgctgctggtgcacagagaggccagagacgagtaccactgcaagaagaagtacggcgtggcctgggagaagtactgccagagagtgccctacagaatcttcccctacatctactag

SEQ ID NO: 86470 - DNA, 1848 bp, Artificial Sequence; identical to SEQ ID NO: 86469
  Description of Artificial Sequence: Synthetic coding sequence

SEQ ID NO: 86471 - DNA, 156 bp, Artificial Sequence
  Description of Artificial Sequence: Synthetic coding sequence
atgcccagcagaaagttcgccgacggcgaggtggtgagaggcagatggcccggcagcagcctgtactacgaggtggagatcctgagccacgacagcaccagccagctgtacaccgtgaagtacaaggacggcaccgagctggagctgaaggagtag

SEQ ID NO: 86472 - DNA, 387 bp, Artificial Sequence
  Description of Artificial Sequence: Synthetic coding sequence
atcggcagagagctgaaccccagaatcggcaccttcgacctgaagtacttctgcgagctgagacccggcctgatcggctgggtggtgatcaacctggtgatgctgctggccgagatgaagatccaggacagagccgtgcccagcctggccatgatcctggtgaacagcttccagctgctgtacgtggtggacgccctgtggaacgaggaggccctgctgaccaccatggacatcatccacgacggcttcggcttcatgctggccttcggcgacctggtgtgggtgcccttcatctacagcttccaggccttctacctggtgagccaccccaacgaggtgagctggcccatggccagcctgatcatcgtgctgaagagagagtactag

SEQ ID NO: 86473 - DNA, 642 bp, Artificial Sequence
  Description of Artificial Sequence: Synthetic coding sequence
atgcccagcagaaagttcgccgacggcgaggtggtgagaggcagatggcccggcagcagcctgtactacgaggtggagatcctgagccacgacagcaccagccagctgtacaccgtgaagtacaaggacggcaccgagctggagctgaaggagaacgacatcaagcccctgaccagcttcagacagagaaagggcggcagcaccagcagcagccccagcagaagaagaggcagcagaagcagaagcagaagcagaagccccggcagaccccccaagagcgccagaagaagcgccagcgccagccaccaggccgacatcaaggaggccagaagagaggtggaggtgaagctgacccccctgatcctgaagcccttcggcaacagcatcagcagatacaacggcgagcccgagcacatcgagagaaacgacgccccccacaagaacacccaggagaagttcagcctgagccaggagagcagctacatcgccacccagtacagcctgagacccagaagagaggaggtgaagctgaaggagatcgacagcaaggaggagaagtacgtggccaaggagctggccgtgagaaccttcgaggtgacccccatcagagccaaggacctggagttcggcggcgtgccctag

SEQ ID NO: 86474 - DNA, 324 bp, Artificial Sequence
  Description of Artificial Sequence: Synthetic coding sequence
tgaagcaccagcctgaagatgtacttctacttctacatcgacctgaagaccatccacaccagcaccggcaagaacctgctggtgagcggctggtggggcttcgtgagacaccccaactacctgggcgacctgatcatggccctggcctggagcctgccctgcggcttcaaccacatcctgccctacttctacatcatctacttcaccatgctgctggtgcacagagaggccagagacgagtaccactgcaagaagaagtacggcgtggcctgggagaagtactgccagagagtgccctacagaatcttcccctacatctactag

SEQ ID NO: 86475 - DNA, 1761 bp, Artificial Sequence
  Description of Artificial Sequence: Synthetic coding sequence
atggccaccgccacccccgtgccccccagaatgggcagcagagccggcggccccaccacccccctgagccccaccagactgagcagactgcaggagaaggaggagctgagagagctgaacgacagactggccgtgtacatcgacaaggtgagaagcctggagaccgagaacagcgccctgcagctgcaggtgaccgagagagaggaggtgagaggcagagagctgaccggcctgaaggccctgtacgagaccgagctggccgacgccagaagagccctggacgacaccgccagagagagagccaagctgcagatcgagctgggcaagtgcaaggccgagcacgaccagctgctgctgaactacgccaagaaggagagcgacctgaacggcgcccagatcaagctgagagagtacgaggccgccctgaacagcaaggacgccgccctggccaccgccctgggcgacaagaagagcctggagggcgacctggaggacctgaaggaccagatcgcccagctggaggccagcctggccgccgccaagaagcagctggccgacgagaccctgctgaaggtggacctggagaacagatgccagagcctgaccgaggacctggagttcagaaagagcatgtacgaggaggagatcaacgagaccagaagaaagcacgagaccagactggtggaggtggacagcggcagacagatcgagtacgagtacaagctggcccaggccctgcacgagatgagagagcagcacgacgcccaggtgagactgtacaaggaggagctggagcagacctaccacgccaagctggagaacgccagactgagcagcgagatgaacaccagcaccgtgaacagcgccagagaggagctgatggagagcagaatgagaatcgagagcctgagcagccagctgagcaacctgcagaaggagagcagagcctgcctggagagaatccaggagctggaggacctgctggccaaggagaaggacaacagcagaagaatgctgaccgacaaggagagagagatggccgagatcagagaccagatgcagcagcagctgaacgactacgagcagctgctggacgtgaagctggccctggacatggagatcagcgcctacagaaagctgctggagggcgaggaggagagactgaagctgagccccagccccagcagcagagtgaccgtgagcagagccagcagcagcagaagcgtgagaaccaccagaggcaagagaaagagagtggacgtggaggagagcgaggccagcagcagcgtgagcatcagccacagcgccagcgccaccggcaacgtgtgcatcgaggagatcgacgtggacggcaagttcatcagactgaagaacaccagcgagcaggaccagcccatgggcggctgggagatgatcagaaagatcggcgacaccagcgtgagctacaagtacaccagcagatacgtgctgaaggccggccagaccgtgaccatctgggccgccaacgccggcgtgaccgccagcccccccaccgacctgatctggaagaaccagaacagctggggcaccggcgaggacgtgaaggtgatcctgaagaacagccagggcgaggaggtggcccagagaagcaccgtgttcaagaccaccatccccgaggaggaggaggaggaggaggaggccgccggcgtggtggtggaggaggagctgttccaccagcagggcacccccagagccagcaacagaagctgcgccatcatgtag

SEQ ID NO: 86476 - DNA, 1803 bp, Artificial Sequence
  Description of Artificial Sequence: Synthetic coding sequence
atggccacccccctgcccggcagagccggcggccccgccacccccctgagccccaccagactgagcagactgcaggagaaggaggagctgagagagctgaacgacagactggcccactacatcgacagagtgagagccctggagctggagaacgacagactgctgctgaagatcagcgagaaggaggaggtgaccaccagagaggtgagcggcatcaaggccctgtacgagagcgagctggccgacgccagaagagtgctggacgagaccgccagagagagagccagactgcagatcgagatcggcaagctgagagccgagctggacgaggtgaacaagagcgccaagaagagagagggcgagctgaccgtggcccagggcagagtgaaggacctggagagcctgttccacagaagcgaggtggagctggccgccgccctgagcgacaagagaggcctggagagcgacgtggccgagctgagagcccagctggccaaggccgaggacggccacgccgtggccaagaagcagctggagaaggagaccctgatgagagtggacctggagaacagatgccagagcctgcaggaggagctggacttcagaaagagcgtgttcgaggaggaggtgagagagaccagaagaagacacgagagaagactggtggaggtggacagcagcagacagcaggagtacgacttcaagatggcccaggccctggaggagctgagaagccagcacgacgagcaggtgagactgtacaagctggagctggagcagacctaccaggccaagctggacagcgccaagctgagcagcgaccagaacgacaaggccgccagcgccgccagagaggagctgaaggaggccagaatgagactggagagcctgagctaccagctgagcggcctgcagaagcaggccagcgccgccgaggacagaatcagagagctggaggaggccatggccggcgagagagacaagttcagaaagatgctggacgccaaggagcaggagatgaccgagatgagagacgtgatgcagcagcagctggccgagtaccaggagctgctggacgtgaagctggccctggacatggagatcaacgcctacagaaagctgctggagggcgaggaggagagactgaagctgagccccagccccagcagcagagtgaccgtgagcagagccaccagcagcagcagcggcagcctgagcgccaccggcagactgggcagaagcaagagaaagagactggaggtggaggagcccctgggcagcggccccagcgtgctgggcaccggcaccggcggcagcggcggcttccacctggcccagcaggccagcgccagcggcagcgtgagcatcgaggagatcgacctggagggcaagttcgtgcagctgaagaacaacagcgacaaggaccagagcctgggcaactggagaatcaagagacaggtgctggagggcgaggagatcgcctacaagttcacccccaagtacatcctgagagccggccagatggtgaccgtgtgggccgccggcgccggcgtggcccacagcccccccagcaccctggtgtggaagggccagagcagctggggcaccggcgagagcttcagaaccgtgctggtgaacgccgacggcgaggaggtggccatgagaaccgtgaagaagagcagcgtgatgagagagaacgagaacggcgaggaggaggaggaggaggccgagttcggcgaggaggacctgttccaccagcagggcgaccccagaaccaccagcagaggctgctacgtgatgtag

SEQ ID NO: 86477 - DNA, 1803 bp, Artificial Sequence; identical to SEQ ID NO: 86476
  Description of Artificial Sequence: Synthetic coding sequence

SEQ ID NO: 86478 - DNA, 651 bp, Artificial Sequence
  Description of Artificial Sequence: Synthetic coding sequence
atgctgatcggcggcaacatcgaggtgcacgtgaaccccggcgacggcaccggcctgagaaaggccctgctgcacgcccccaccggcacctgcagcgacggccaggcccacagcatcagcctggtgagaaacagaagaatcatcaccgtgcagctggacgagaacaaccccgtggagatgaagctgggcaccctggtggagagcagaaccatcaacgtgagcaacctgtacgtgggcggcatccccgagggcgagggcaccagcctgctgaccatgagaagaagcttccacggctgcatcaagaacctgatcttcaacctggagctgctggacttcaacagcgccgtgatgagcaagagcacctggacccccgccggctgccagaagggcctgagctggctgcccatgcagagaaccaagctgctgcccgagcccagagccttccccgtgggcgccgccagcttcaccatcagccaggtgcagagcgccaaggagggcctgggccagagagagctgaagtggggcctggccgtgaaggtgcccgccaaggccggcgccggcgccggcgccggcgccgtgctgaagatcagagccggcaccggcagagagagagtgccccaggccacccagatgaccagacccaacccctag

SEQ ID NO: 86479 - DNA, 9228 bp, Artificial Sequence
  Description of Artificial Sequence: Synthetic coding sequence
atgagaggcggcgtgctgctggtgctgctgctgtgcgtggccgcccagtgcagacagagaggcctgttccccgccatcctgaacctggccagcaacgcccacatcagcaccaacgccacctgcggcgagaagggccccgagatgttctgcaagctggtggagcacgtgcccggcagacccgtgagaaacccccagtgcagaatctgcgacggcaacagcgccaaccccagagagagacaccccatcagccacgccatcgacggcaccaacaactggtggcagagccccagcatccagaacggcagagagtaccactgggtgaccatcaccctggacctgagacaggtgttccaggtggcctacgtgatcatcaaggccgccaacgcccccagacccggcaactggatcctggagagaagcctggacggcaccaccttcagcccctggcagtactacgccgtgagcgacagcgagtgcctgagcagatacaacatcacccccagaagaggcccccccacctacagagccgacgacgaggtgatctgcaccagctactacagcagactggtgcccctggagcacggcgagatccacaccagcctgatcaacggcagacccagcgccgacgacctgagccccaagctgctggagttcaccagcgccagatacatcagactgagactgcagagaatcagaaccctgaacgccgacctgatgaccctgagccacagagagcccaaggagctggaccccatcgtgaccagaagatactactacagcatcaaggacatcagcgtgggcggcatgtgcatctgctacggccacgccagcagctgcccctgggacgagaccaccaagaagctgcagtgccagtgcgagcacaacacctgcggcgagagctgcaacagatgctgccccggctaccaccagcagccctggagacccggcaccgtgagcagcggcaacacctgcgaggcctgcaactgccacaacaaggccaaggactgctactacgacgagagcgtggccaagcagaagaagagcctgaacaccgccggccagttcagaggcggcggcgtgtgcatcaactgcctgcagaacaccatgggcatcaactgcgagacctgcatcgacggctactacagaccccacaaggtgagcccctacgaggacgagccctgcagaccctgcaactgcgaccccgtgggcagcctgagcagcgtgtgcatcaaggacgacctgcacagcgacctgcacaacggcaagcagcccggccagtgcccctgcaaggagggctacaccggcgagaagtgcgacagatgccagctgggctacaaggactaccccacctgcgtgagctgcggctgcaaccccgtgggcagcgccagcgacgagccctgcaccggcccctgcgtgtgcaaggagaacgtggagggcaaggcctgcgacagatgcaagcccggcttctacaacctgaaggagaagaaccccagaggctgcagcgagtgcttctgcttcggcgtgagcgacgtgtgcagcagcctgagctggcccgtgggccaggtgaacagcatgagcggctggctggtgaccgacctgatcagccccagaaagatccccagccagcaggacgccctgggcggcagacaccaggtgagcatcaacaacaccgccgtgatgcagagactggcccccaagtactactgggccgcccccgaggcctacctgggcaacaagctgaccgccttcggcggcttcctgaagtacaccgtgagctacgacatccccgtggagaccgtggacagcaacctgatgagccacgccgacgtgatcatcaagggcaacggcctgaccctgagcacccaggccgagggcctgagcctgcagccctacgaggagtacctgaacgtggtgagactggtgcccgagaacttccaggacttccacagcaagagacagatcgacagagaccagctgatgaccgtgctggccaacgtgacccacctgctgatcagagccaactacaacagcgccaagatggccctgtacagactggagagcgtgagcctggacatcgccagcagcaacgccatcgacctggtggtggccgccgacgtggagcactgcgagtgcccccagggctacaccggcaccagctgcgagagctgcctgagcggctactacagagtggacggcatcctgttcggcggcatctgccagccctgcgagtgccacggccacgccgccgagtgcaacgtgcacggcgtgtgcatcgcctgcgcccacaacaccaccggcgtgcactgcgagcagtgcctgcccggcttctacggcgagcccagcagaggcacccccggcgactgccagccctgcgcctgccccctgaccatcgccagcaacaacttcagccccacctgccacctgaacgacggcgacgaggtggtgtgcgactggtgcgcccccggctacagcggcgcctggtgcgagagatgcgccgacggctactacggcaaccccaccgtgcccggcgagagctgcgtgccctgcgactgcagcggcaacgtggaccccagcgaggccggccactgcgacagcgtgaccggcgagtgcctgaagtgcctgggcaacaccgacggcgcccactgcgagagatgcgccgacggcttctacggcgacgccgtgaccgccaagaactgcagagcctgcgagtgccacgtgaagggcagccacagcgccgtgtgccacctggagaccggcctgtgcgactgcaagcccaacgtgaccggccagcagtgcgaccagtgcctgcacggctactacggcctggacagcggccacggctgcagaccctgcaactgcagcgtggccggcagcgtgagcgacggctgcaccgacgagggccagtgccactgcgtgcccggcgtggccggcaagagatgcgacagatgcgcccacggcttctacgcctaccaggacggcagctgcaccccctgcgactgcccccacacccagaacacctgcgaccccgagaccggcgagtgcgtgtgccccccccacacccagggcgtgaagtgcgaggagtgcgaggacggccactggggctacgacgccgaggtgggctgccaggcctgcaactgcagcctggtgggcagcacccaccacagatgcgacgtggtgaccggccactgccagtgcaagagcaagttcggcggcagagcctgcgaccagtgcagcctgggctacagagacttccccgactgcgtgccctgcgactgcgacctgagaggcaccagcggcgacgcctgcaacctggagcagggcctgtgcggctgcgtggaggagaccggcgcctgcccctgcaaggagaacgtgttcggcccccagtgcaacgagtgcagagagggcaccttcgccctgagagccgacaaccccctgggctgcagcccctgcttctgcagcggcctgagccacctgtgcagcgagctggaggactacgtgagaacccccgtgaccctgggcagcgaccagcccctgctgagagtggtgagccagagcaacctgagaggcaccaccgagggcgtgtactaccaggcccccgacttcctgctggacgccgccaccgtgagacagcacatcagagccgagcccttctactggagactgccccagcagttccagggcgaccagctgatggcctacggcggcaagctgaagtacagcgtggccttctacagcctggacggcgtgggcaccagcaacttcgagccccaggtgctgatcaagggcggcagaatcagaaagcaggtgatctacatggacgcccccgcccccgagaacggcgtgagacaggagcaggaggtggccatgagagagaacttctggaagtacttcaacagcgtgagcgagaagcccgtgaccagagaggacttcatgagcgtgctgagcgacatcgagtacatcctgatcaaggccagctacggccagggcctgcagcagagcagaatcagcgacatcagcatggaggtgggcagaaaggccgagaagctgcaccccgaggaggaggtggccagcctgctggagaactgcgtgtgcccccccggcaccgtgggcttcagctgccaggactgcgcccccggctaccacagaggcaagctgcccgccggcagcgacagaggccccagacccctggtggccccctgcgtgccctgcagctgcaacaaccacagcgacacctgcgaccccaacaccggcaagtgcctgaactgcggcgacaacaccgccggcgaccactgcgacgtgtgcaccagcggctactacggcaaggtgaccggcagcgccagcgactgcgccctgtgcgcctgcccccacagcccccccgccagcttcagccccacctgcgtgctggagggcgaccacgacttcagatgcgacgcctgcctgctgggctacgagggcaagcactgcgagagatgcagcagcagctactacggcaacccccagacccccggcggcagctgccagaagtgcgactgcaacccccacggcagcgtgcacggcgactgcgacagaaccagcggccagtgcgtgtgcagactgggcgccagcggcctgagatgcgacgagtgcgagcccagacacatcctgatggagaccgactgcgtgagctgcgacgacgagtgcgtgggcgtgctgctgaacgacctggacgagatcggcgacgccgtgctgagcctgaacctgaccggcatcatccccgtgccctacggcatcctgagcaacctggagaacaccaccaagtacctgcaggagagcctgctgaaggagaacatgcagaaggacctgggcaagatcaagctggagggcgtggccgaggagaccgacaacctgcagaagaagctgaccagaatgctggccagcacccagaaggtgaacagagccaccgagagaatcttcaaggagagccaggacctggccatcgccatcgagagactgcagatgagcatcaccgagatcatggagaagaccaccctgaaccagaccctggacgaggacttcctgctgcccaacagcaccctgcagaacatgcagcagaacggcaccagcctgctggagatcatgcagatcagagacttcacccagctgcaccagaacgccaccctggagctgaaggccgccgaggacctgctgagccagatccaggagaactaccagaagcccctggaggagctggaggtgctgaaggaggccgccagccacgtgctgagcaagcacaacaacgagctgaaggccgccgaggccctggtgagagaggccgaggccaagatgcaggagagcaaccacctgctgctgatggtgaacgccaacctgagagagttcagcgacaagaagctgcacgtgcaggaggagcagaacctgaccagcgagctgatcgtgcagggcagaggcctgatcgacgccgccgccgcccagaccgacgccgtgcaggacgccctggagcacctggaggaccaccaggacaagctgctgctgtggagcgccaagatcagacaccacatcgacgacctggtgatgcacatgagccagagaaacgccgtggacctggtgtacagagccgaggaccacgccgccgagttccagagactggccgacgtgctgtacagcggcctggagaacatcagaaacgtgagcctgaacgccaccagcgccgcctacgtgcactacaacatccagagcctgatcgaggagagcgaggagctggccagagacgcccacagaaccgtgaccgagaccagcctgctgagcgagagcctggtgagcaacggcaaggccgccgtgcagagaagcagcagattcctgaaggagggcaacaacctgagcagaaagctgcccggcatcgccctggagctgagcgagctgagaaacaagaccaacagattccaggagaacgccgtggagatcaccagacagaccaacgagagcctgctgatcctgagagccatccccaagggcatcagagacaagggcgccaagaccaaggagctggccaccagcgccagccagagcgccgtgagcaccctgagagacgtggccggcctgagccaggagctgctgaacaccagcgccagcctgagcagagtgaacaccaccctgagagagacccaccagctgctgcaggacagcaccatggccaccctgctggccggcagaaaggtgaaggacgtggagatccaggccaacctgctgttcgacagactgaagcccctgaagatgctggaggagaacctgagcagaaacctgagcgagatcaagctgctgatcagccaggccagaaagcaggccgccagcatcaaggtggccgtgagcgccgacagagactgcatcagagcctaccagccccagatcagcagcaccaactacaacaccctgaccctgaacgtgaagacccaggagcccgacaacctgctgttctacctgggcagcagcaccgccagcgacttcctggccgtggagatgagaagaggcagagtggccttcctgtgggacctgggcagcggcagcaccagactggagttccccgacttccccatcgacgacaacagatggcacagcatccacgtggccagattcggcaacatcggcagcctgagcgtgaaggagatgagcagcaaccagaagagccccaccaagaccagcaagagccccggcaccgccaacgtgctggacgtgaacaacagcaccctgatgttcgtgggcggcctgggcggccagatcaagaagagccccgccgtgaaggtgacccacttcaagggctgcctgggcgaggccttcctgaacggcaagagcatcggcctgtggaactacatcgagagagagggcaagtgcagaggctgcttcggcagcagccagaacgaggaccccagcttccacttcgacggcagcggctacagcgtggtggagaagagcctgcccgccaccgtgacccagatcatcatgctgttcaacaccttcagccccaacggcctgctgctgtacctgggcagctacggcaccaaggacttcctgagcatcgagctgttcagaggcagagtgaaggtgatgaccgacctgggcagcggccccatcaccctgctgaccgacagaagatacaacaacggcacctggtacaagatcgccttccagagaaacagaaagcagggcgtgctggccgtgatcgacgcctacaacaccagcaacaaggagaccaagcagggcgagacccccggcgccagcagcgacctgaacagactggacaaggaccccatctacgtgggcggcctgcccagaagcagagtggtgagaagaggcgtgaccaccaagagcttcgtgggctgcatcaagaacctggagatcagcagaagcaccttcgacctgctgagaaacagctacggcgtgagaaagggctgcctgctggagcccatcagaagcgtgagcttcctgaagggcggctacatcgagctgccccccaagagcctgagccccgagagcgagtggctggtgaccttcgccaccaccaacagcagcggcatcatcctggccgccctgggcggcgacgtggagaagagaggcgacagagaggaggcccacgtgcccttcttcagcgtgatgctgatcggcggcaacatcgaggtgcacgtgaaccccggcgacggcaccggcctgagaaaggccctgctgcacgcccccaccggcacctgcagcgacggccaggcccacagcatcagcctggtgagaaacagaagaatcatcaccgtgcagctggacgagaacaaccccgtggagatgaagctgggcaccctggtggagagcagaaccatcaacgtgagcaacctgtacgtgggcggcatccccgagggcgagggcaccagcctgctgaccatgagaagaagcttccacggctgcatcaagaacctgatcttcaacctggagctgctggacttcaacagcgccgtgggccacgagcaggtggacctggacacctgctggctgagcgagagacccaagctggcccccgacgccgaggacagcaagctgctgcccgagcccagagccttccccgagcagtgcgtggtggacgccgccctggagtacgtgcccggcgcccaccagttcggcctgacccagaacagccacttcatcctgcccttcaaccagagcgccgtgagaaagaagctgagcgtggagctgagcatcagaaccttcgccagcagcggcctgatctactacatggcccaccagaaccaggccgactacgccgtgctgcagctgcacggcggcagactgcacttcatgttcgacctgggcaagggcagaaccaaggtgagccaccccgccctgctgagcgacggcaagtggcacaccgtgaagaccgactacgtgaagagaaagggcttcatcaccgtggacggcagagagagccccatggtgaccgtggtgggcgacggcaccatgctggacgtggagggcctgttctacctgggcggcctgcccagccagtaccaggccagaaagatcggcaacatcacccacagcatccccgcctgcatcggcgacgtgaccgtgaacagcaagcagctggacaaggacagccccgtgagcgccttcaccgtgaacagatgctacgccgtggcccaggagggcacctacttcgacggcagcggctacgccgccctggtgaaggagggctacaaggtgcagagcgacgtgaacatcaccctggagttcagaaccagcagccagaacggcgtgctgctgggcatcagcaccgccaaggtggacgccatcggcctggagctggtggacggcaaggtgctgttccacgtgaacaacggcgccggcagaatcaccgccgcctacgagcccaagaccgccaccgtgctgtgcgacggcaagtggcacaccctgcaggccaacaagagcaagcacagaatcaccctgatcgtggacggcaacgccgtgggcgccgagagcccccacacccagagcaccagcgtggacaccaacaaccccatctacgtgggcggctaccccgccggcgtgaagcagaagtgcctgagaagccagaccagcttcagaggctgcctgagaaagctggccctgatcaagagcccccaggtgcagagcttcgacttcagcagagccttcgagctgcacggcgtgttcctgcacagctgccccggcaccgagagctag

SEQ ID NO: 86480 - DNA, 9366 bp, Artificial Sequence
  Description of Artificial Sequence: Synthetic coding sequence
atgcccggcgccgccggcgtgctgctgctgctgctgctgagcggcggcctgggcggcgtgcaggcccagagaccccagcagcagagacagagccaggcccaccagcagagaggcctgttccccgccgtgctgaacctggccagcaacgccctgatcaccaccaacgccacctgcggcgagaagggccccgagatgtactgcaagctggtggagcacgtgcccggccagcccgtgagaaacccccagtgcagaatctgcaaccagaacagcagcaaccccaaccagagacaccccatcaccaacgccatcgacggcaagaacacctggtggcagagccccagcatcaagaacggcatcgagtaccactacgtgaccatcaccctggacctgcagcaggtgttccagatcgcctacgtgatcgtgaaggccgccaacagccccagacccggcaactggatcctggagagaagcctggacgacgtggagtacaagccctggcagtaccacgccgtgaccgacaccgagtgcctgaccctgtacaacatctaccccagaaccggcccccccagctacgccaaggacgacgaggtgatctgcaccagcttctacagcaagatccaccccctggagaacggcgagatccacatcagcctgatcaacggcagacccagcgccgacgaccccagccccgagctgctggagttcaccagcgccagatacatcagactgagattccagagaatcagaaccctgaacgccgacctgatgatgttcgcccacaaggaccccagagagatcgaccccatcgtgaccagaagatactactacagcgtgaaggacatcagcgtgggcggcatgtgcatctgctacggccacgccagagcctgccccctggaccccgccaccaacaagagcagatgcgagtgcgagcacaacacctgcggcgacagctgcgaccagtgctgccccggcttccaccagaagccctggagagccggcaccttcctgaccaagaccgagtgcgaggcctgcaactgccacggcaaggccgaggagtgctactacgacgagaacgtggccagaagaaacctgagcctgaacatcagaggcaagtacatcggcggcggcgtgtgcatcaactgcacccagaacaccgccggcatcaactgcgagacctgcaccgacggcttcttcagacccaagggcgtgagccccaactaccccagaccctgccagccctgccactgcgaccccatcggcagcctgaacgaggtgtgcgtgaaggacgagaagcacgccagaagaggcctggcccccggcagctgccactgcaagaccggcttcggcggcgtgagctgcgacagatgcgccagaggctacaccggctaccccgactgcaaggcctgcaactgcagcggcctgggcagcaagaacgaggacccctgcttcggcccctgcatctgcaaggagaacgtggagggcggcgactgcagcagatgcaagagcggcttcttcaacctgcaggaggacaactggaagggctgcgacgagtgcttctgcagcggcgtgagcaacagatgccagagcagctactggacctacggcaagatccaggacatgagcggctggtacctgaccgacctgcccggcagaatcagagtggccccccagcaggacgacctggacagcccccagcagatcagcatcagcaacgccgaggccagacaggccctgccccacagctactactggagcgcccccgccccctacctgggcaacaagctgcccgccgtgggcggccagctgaccttcaccatcagctacgacctggaggaggaggaggaggacaccgagagagtgctgcagctgatgatcatcctggagggcaacgacctgagcatcagcaccgcccaggacgaggtgtacctgcaccccagcgaggagcacaccaacgtgctgctgctgaaggaggagagcttcaccatccacggcacccacttccccgtgagaagaaaggagttcatgaccgtgctggccaacctgaagagagtgctgctgcagatcacctacagcttcggcatggacgccatcttcagactgagcagcgtgaacctggagagcgccgtgagctaccccaccgacggcagcatcgccgccgccgtggaggtgtgccagtgcccccccggctacaccggcagcagctgcgagagctgctggcccagacacagaagagtgaacggcaccatcttcggcggcatctgcgagccctgccagtgcttcggccacgccgagagctgcgacgacgtgaccggcgagtgcctgaactgcaaggaccacaccggcggcccctactgcgacaagtgcctgcccggcttctacggcgagcccaccaagggcaccagcgaggactgccagccctgcgcctgccccctgaacatccccagcaacaacttcagccccacctgccacctggacagaagcctgggcctgatctgcgacggctgccccgtgggctacaccggccccagatgcgagagatgcgccgagggctacttcggccagcccagcgtgcccggcggcagctgccagccctgccagtgcaacgacaacctggacttcagcatccccggcagctgcgacagcctgagcggcagctgcctgatctgcaagcccggcaccaccggcagatactgcgagctgtgcgccgacggctacttcggcgacgccgtggacgccaagaactgccagccctgcagatgcaacgccggcggcagcttcagcgaggtgtgccacagccagaccggccagtgcgagtgcagagccaacgtgcagggccagagatgcgacaagtgcaaggccggcaccttcggcctgcagagcgccagaggctgcgtgccctgcaactgcaacagcttcggcagcaagagcttcgactgcgaggagagcggccagtgctggtgccagcccggcgtgaccggcaagaagtgcgacagatgcgcccacggctacttcaacttccaggagggcggctgcaccgcctgcgagtgcagccacctgggcaacaactgcgaccccaagaccggcagatgcatctgcccccccaacaccatcggcgagaagtgcagcaagtgcgcccccaacacctggggccacagcatcaccaccggctgcaaggcctgcaactgcagcaccgtgggcagcctggacttccagtgcaacgtgaacaccggccagtgcaactgccaccccaagttcagcggcgccaagtgcaccgagtgcagcagaggccactggaactaccccagatgcaacctgtgcgactgcttcctgcccggcaccgacgccaccacctgcgacagcgagaccaagaagtgcagctgcagcgaccagaccggccagtgcacctgcaaggtgaacgtggagggcatccactgcgacagatgcagacccggcaagttcggcctggacgccaagaaccccctgggctgcagcagctgctactgcttcggcaccaccacccagtgcagcgaggccaagggcctgatcagaacctgggtgaccctgaaggccgagcagaccatcctgcccctggtggacgaggccctgcagcacaccaccaccaagggcatcgtgttccagcaccccgagatcgtggcccacatggacctgatgagagaggacctgcacctggagcccttctactggaagctgcccgagcagttcgagggcaagaagctgatggcctacggcggcaagctgaagtacgccatctacttcgaggccagagaggagaccggcttcagcacctacaacccccaggtgatcatcagaggcggcacccccacccacgccagaatcatcgtgagacacatggccgcccccctgatcggccagctgaccagacacgagatcgagatgaccgagaaggagtggaagtactacggcgacgaccccagagtgcacagaaccgtgaccagagaggacttcctggacatcctgtacgacatccactacatcctgatcaaggccacctacggcaacttcatgagacagagcagaatcagcgagatcagcatggaggtggccgagcagggcagaggcaccaccatgaccccccccgccgacctgatcgagaagtgcgactgccccctgggctacagcggcctgagctgcgaggcctgcctgcccggcttctacagactgagaagccagcccggcggcagaacccccggccccaccctgggcacctgcgtgccctgccagtgcaacggccacagcagcctgtgcgaccccgagaccagcatctgccagaactgccagcaccacaccgccggcgacttctgcgagagatgcgccctgggctactacggcatcgtgaagggcctgcccaacgactgccagcagtgcgcctgccccctgatcagcagcagcaacaacttcagccccagctgcgtggccgagggcctggacgactacagatgcaccgcctgccccagaggctacgagggccagtactgcgagagatgcgcccccggctacaccggcagccccggcaaccccggcggcagctgccaggagtgcgagtgcgacccctacggcagcctgcccgtgccctgcgaccccgtgaccggcttctgcacctgcagacccggcgccaccggcagaaagtgcgacggctgcaagcactggcacgccagagagggctgggagtgcgtgttctgcggcgacgagtgcaccggcctgctgctgggcgacctggccagactggagcagatggtgatgagcatcaacctgaccggccccctgcccgccccctacaagatgctgtacggcctggagaacatgacccaggagctgaagcacctgctgagcccccagagagcccccgagagactgatccagctggccgagggcaacctgaacaccctggtgaccgagatgaacgagctgctgaccagagccaccaaggtgaccgccgacggcgagcagaccggccaggacgccgagagaaccaacaccagagccaagagcctgggcgagttcatcaaggagctggccagagacgccgaggccgtgaacgagaaggccatcaagctgaacgagaccctgggcaccagagacgaggccttcgagagaaacctggagggcctgcagaaggagatcgaccagatgatcaaggagctgagaagaaagaacctggagacccagaaggagatcgccgaggacgagctggtggccgccgaggccctgctgaagaaggtgaagaagctgttcggcgagagcagaggcgagaacgaggagatggagaaggacctgagagagaagctggccgactacaagaacaaggtggacgacgcctgggacctgctgagagaggccaccgacaagatcagagaggccaacagactgttcgccgtgaaccagaagaacatgaccgccctggagaagaagaaggaggccgtggagagcggcaagagacagatcgagaacaccctgaaggagggcaacgacatcctggacgaggccaacagactggccgacgagatcaacagcatcatcgactacgtggaggacatccagaccaagctgccccccatgagcgaggagctgaacgacaagatcgacgacctgagccaggagatcaaggacagaaagctggccgagaaggtgagccaggccgagagccacgccgcccagctgaacgacagcagcgccgtgctggacggcatcctggacgaggccaagaacatcagcttcaacgccaccgccgccttcaaggcctacagcaacatcaaggactacatcgacgaggccgagaaggtggccaaggaggccaaggacctggcccacgaggccaccaagctggccaccggccccagaggcctgctgaaggaggacgccaagggctgcctgcagaagagcttcagaatcctgaacgaggccaagaagctggccaacgacgtgaaggagaacgaggaccacctgaacggcctgaagaccagaatcgagaacgccgacgccagaaacggcgacctgctgagaaccctgaacgacaccctgggcaagctgagcgccatccccaacgacaccgccgccaagctgcaggccgtgaaggacaaggccagacaggccaacgacaccgccaaggacgtgctggcccagatcaccgagctgcaccagaacctggacggcctgaagaagaactacaacaagctggccgacagcgtggccaagaccaacgccgtggtgaaggaccccagcaagaacaccgtggccgacgccgacgccaccgtgaagaacctggagcaggaggccgacagactgatcgacaagctgaagcccatcaaggagctggaggacaacctgaagaagaacatcagcgagatcaaggagctgatcaaccaggccagaaagcaggccaacagcatcaaggtgagcgtgagcagcggcggcgactgcatcagaacctacaagcccgagatcaagaagggcagctacaacaacatcgtggtgaacgtgaagaccgccgtggccgacaacctgctgttctacctgggcagcgccaagttcatcgacttcctggccatcgagatgagaaagggcaaggtgagcttcctgtgggacgtgggcagcggcgtgggcagagtggagtaccccgacctgaccatcgacgacagctactggtacagaatcgtggccagcagaaccggcagaaacggcaccatcagcgtgagagccctggacggccccaaggccagcatcgtgcccagcacccaccacagcaccagcccccccggctacaccatcctggacgtggacgccaacgccatgctgttcgtgggcggcctgaccggcaagctgaagaaggccgacgccgtgagagtgatcaccttcaccggctgcatgggcgagacctacttcgacaacaagcccatcggcctgtggaacttcagagagaaggagggcgactgcaagggctgcaccgtgagcccccaggtggaggacagcgagggcaccatccagttcgacggcgagggctacgccctggtgagcagacccatcagatggtaccccaacatcagcaccgtgatgttcaagttcagaaccttcagcagcagcgccctgctgatgtacctggccaccagagacctgagagacttcatgagcgtggagctgaccgacggccacatcaaggtgagctacgacctgggcagcggcatggccagcgtggtgagcaaccagaaccacaacgacggcaagtggaagagcttcaccctgagcagaatccagaagcaggccaacatcagcatcgtggacatcgacaccaaccaggaggagaacatcgccaccagcagcagcggcaacaacttcggcctggacctgaaggccgacgacaagatctacttcggcggcctgcccaccctgagaaacctgagcatgaaggccagacccgaggtgaacctgaagaagtacagcggctgcctgaaggacatcgagatcagcagaaccccctacaacatcctgagcagccccgactacgtgggcgtgaccaagggctgcagcctggagaacgtgtacaccgtgagcttccccaagcccggcttcgtggagctgagccccgtgcccatcgacgtgggcaccgagatcaacctgagcttcagcaccaagaacgagagcggcatcatcctgctgggcagcggcggcacccccgccccccccagaagaaagagaagacagaccggccaggcctactacgccatcctgctgaacagaggcagactggaggtgcacctgagcaccggcgccagaaccatgagaaagatcgtgatcagacccgagcccaacctgttccacgacggcagagagcacagcgtgcacgtggagagaaccagaggcatcttcaccgtgcaggtggacgagaacagaagatacatgcagaacctgaccgtggagcagcccatcgaggtgaagaagctgttcgtgggcggcgccccccccgagttccagcccagccccctgagaaacatcccccccttcgagggctgcatctggaacctggtgatcaacagcgtgcccatggacttcgccagacccgtgagcttcaagaacgccgacatcggcagatgcgcccaccagaagctgagagaggacgaggacggcgccgcccccgccgagatcgtgatccagcccgagcccgtgcccacccccgccttccccacccccacccccgtgctgacccacggcccctgcgccgccgagagcgagcccgccctgctgatcggcagcaagcagttcggcctgagcagaaacagccacatcgccatcgccttcgacgacaccaaggtgaagaacagactgaccatcgagctggaggtgagaaccgaggccgagagcggcctgctgttctacatggccagaatcaaccacgccgacttcgccaccgtgcagctgagaaacggcctgccctacttcagctacgacctgggcagcggcgacacccacaccatgatccccaccaagatcaacgacggccagtggcacaagatcaagatcatgagaagcaagcaggagggcatcctgtacgtggacggcgccagcaacagaaccatcagccccaagaaggccgacatcctggacgtggtgggcatgctgtacgtgggcggcctgcccatcaactacaccaccagaagaatcggccccgtgacctacagcatcgacggctgcgtgagaaacctgcacatggccgaggcccccgccgacctggagcagcccaccagcagcttccacgtgggcacctgcttcgccaacgcccagagaggcacctacttcgacggcaccggcttcgccaaggccgtgggcggcttcaaggtgggcctggacctgctggtggagttcgagttcagaaccaccaccaccaccggcgtgctgctgggcatcagcagccagaagatggacggcatgggcatcgagatgatcgacgagaagctgatgttccacgtggacaacggcgccggcagattcaccgccgtgtacgacgccggcgtgcccggccacctgtgcgacggccagtggcacaaggtgaccgccaacaagatcaagcacagaatcgagctgaccgtggacggcaaccaggtggaggcccagagccccaaccccgccagcaccagcgccgacaccaacgaccccgtgttcgtgggcggcttccccgacgacctgaagcagttcggcctgaccaccagcatccccttcagaggctgcatcagaagcctgaagctgaccaagggcaccggcaagcccctggaggtgaacttcgccaaggccctggagctgagaggcgtgcagcccgtgagctgccccgccaactag

SEQ ID NO: 86481 - DNA, 9369 bp, Artificial Sequence
  Description of Artificial Sequence: Synthetic coding sequence
atgcccggcgccgccggcgtgctgctgctgctgctgctgagcggcggcctgggcggcgtgcaggcccagagaccccagcagcagagacagagccaggcccaccagcagagaggcctgttccccgccgtgctgaacctggccagcaacgccctgatcaccaccaacgccacctgcggcgagaagggccccgagatgtactgcaagctggtggagcacgtgcccggccagcccgtgagaaacccccagtgcagaatctgcaaccagaacagcagcaaccccaaccagagacaccccatcaccaacgccatcgacggcaagaacacctggtggcagagccccagcatcaagaacggcatcgagtaccactacgtgaccatcaccctggacctgcagcaggtgttccagatcgcctacgtgatcgtgaaggccgccaacagccccagacccggcaactggatcctggagagaagcctggacgacgtggagtacaagccctggcagtaccacgccgtgaccgacaccgagtgcctgaccctgtacaacatctaccccagaaccggcccccccagctacgccaaggacgacgaggtgatctgcaccagcttctacagcaagatccaccccctggagaacggcgagatccacatcagcctgatcaacggcagacccagcgccgacgaccccagccccgagctgctggagttcaccagcgccagatacatcagactgagattccagagaatcagaaccctgaacgccgacctgatgatgttcgcccacaaggaccccagagagatcgaccccatcgtgaccagaagatactactacagcgtgaaggacatcagcgtgggcggcatgtgcatctgctacggccacgccagagcctgccccctggaccccgccaccaacaagagcagatgcgagtgcgagcacaacacctgcggcgacagctgcgaccagtgctgccccggcttccaccagaagccctggagagccggcaccttcctgaccaagaccgagtgcgaggcctgcaactgccacggcaaggccgaggagtgctactacgacgagaacgtggccagaagaaacctgagcctgaacatcagaggcaagtacatcggcggcggcgtgtgcatcaactgcacccagaacaccgccggcatcaactgcgagacctgcaccgacggcttcttcagacccaagggcgtgagccccaactaccccagaccctgccagccctgccactgcgaccccatcggcagcctgaacgaggtgtgcgtgaaggacgagaagcacgccagaagaggcctggcccccggcagctgccactgcaagaccggcttcggcggcgtgagctgcgacagatgcgccagaggctacaccggctaccccgactgcaaggcctgcaactgcagcggcctgggcagcaagaacgaggacccctgcttcggcccctgcatctgcaaggagaacgtggagggcggcgactgcagcagatgcaagagcggcttcttcaacctgcaggaggacaactggaagggctgcgacgagtgcttctgcagcggcgtgagcaacagatgccagagcagctactggacctacggcaagatccaggacatgagcggctggtacctgaccgacctgcccggcagaatcagagtggccccccagcaggacgacctggacagcccccagcagatcagcatcagcaacgccgaggccagacaggccctgccccacagctactactggagcgcccccgccccctacctgggcaacaagctgcccgccgtgggcggccagctgaccttcaccatcagctacgacctggaggaggaggaggaggacaccgagagagtgctgcagctgatgatcatcctggagggcaacgacctgagcatcagcaccgcccaggacgaggtgtacctgcaccccagcgaggagcacaccaacgtgctgctgctgaaggaggagagcttcaccatccacggcacccacttccccgtgagaagaaaggagttcatgaccgtgctggccaacctgaagagagtgctgctgcagatcacctacagcttcggcatggacgccatcttcagactgagcagcgtgaacctggagagcgccgtgagctaccccaccgacggcagcatcgccgccgccgtggaggtgtgccagtgcccccccggctacaccggcagcagctgcgagagctgctggcccagacacagaagagtgaacggcaccatcttcggcggcatctgcgagccctgccagtgcttcggccacgccgagagctgcgacgacgtgaccggcgagtgcctgaactgcaaggaccacaccggcggcccctactgcgacaagtgcctgcccggcttctacggcgagcccaccaagggcaccagcgaggactgccagccctgcgcctgccccctgaacatccccagcaacaacttcagccccacctgccacctggacagaagcctgggcctgatctgcgacggctgccccgtgggctacaccggccccagatgcgagagatgcgccgagggctacttcggccagcccagcgtgcccggcggcagctgccagccctgccagtgcaacgacaacctggacttcagcatccccggcagctgcgacagcctgagcggcagctgcctgatctgcaagcccggcaccaccggcagatactgcgagctgtgcgccgacggctacttcggcgacgccgtggacgccaagaactgccagccctgcagatgcaacgccggcggcagcttcagcgaggtgtgccacagccagaccggccagtgcgagtgcagagccaacgtgcagggccagagatgcgacaagtgcaaggccggcaccttcggcctgcagagcgccagaggctgcgtgccctgcaactgcaacagcttcggcagcaagagcttcgactgcgaggagagcggccagtgctggtgccagcccggcgtgaccggcaagaagtgcgacagatgcgcccacggctacttcaacttccaggagggcggctgcaccgcctgcgagtgcagccacctgggcaacaactgcgaccccaagaccggcagatgcatctgcccccccaacaccatcggcgagaagtgcagcaagtgcgcccccaacacctggggccacagcatcaccaccggctgcaaggcctgcaactgcagcaccgtgggcagcctggacttccagtgcaacgtgaacaccggccagtgcaactgccaccccaagttcagcggcgccaagtgcaccgagtgcagcagaggccactggaactaccccagatgcaacctgtgcgactgcttcctgcccggcaccgacgccaccacctgcgacagcgagaccaagaagtgcagctgcagcgaccagaccggccagtgcacctgcaaggtgaacgtggagggcatccactgcgacagatgcagacccggcaagttcggcctggacgccaagaaccccctgggctgcagcagctgctactgcttcggcaccaccacccagtgcagcgaggccaagggcctgatcagaacctgggtgaccctgaaggccgagcagaccatcctgcccctggtggacgaggccctgcagcacaccaccaccaagggcatcgtgttccagcaccccgagatcgtggcccacatggacctgatgagagaggacctgcacctggagcccttctactggaagctgcccgagcagttcgagggcaagaagctgatggcctacggcggcaagctgaagtacgccatctacttcgaggccagagaggagaccggcttcagcacctacaacccccaggtgatcatcagaggcggcacccccacccacgccagaatcatcgtgagacacatggccgcccccctgatcggccagctgaccagacacgagatcgagatgaccgagaaggagtggaagtactacggcgacgaccccagagtgcacagaaccgtgaccagagaggacttcctggacatcctgtacgacatccactacatcctgatcaaggccacctacggcaacttcatgagacagagcagaatcagcgagatcagcatggaggtggccgagcagggcagaggcaccaccatgaccccccccgccgacctgatcgagaagtgcgactgccccctgggctacagcggcctgagctgcgaggcctgcctgcccggcttctacagactgagaagccagcccggcggcagaacccccggccccaccctgggcacctgcgtgccctgccagtgcaacggccacagcagcctgtgcgaccccgagaccagcatctgccagaactgccagcaccacaccgccggcgacttctgcgagagatgcgccctgggctactacggcatcgtgaagggcctgcccaacgactgccagcagtgcgcctgccccctgatcagcagcagcaacaacttcagccccagctgcgtggccgagggcctggacgactacagatgcaccgcctgccccagaggctacgagggccagtactgcgagagatgcgcccccggctacaccggcagccccggcaaccccggcggcagctgccaggagtgcgagtgcgacccctacggcagcctgcccgtgccctgcgaccccgtgaccggcttctgcacctgcagacccggcgccaccggcagaaagtgcgacggctgcaagcactggcacgccagagagggctgggagtgcgtgttctgcggcgacgagtgcaccggcctgctgctgggcgacctggccagactggagcagatggtgatgagcatcaacctgaccggccccctgcccgccccctacaagatgctgtacggcctggagaacatgacccaggagctgaagcacctgctgagcccccagagagcccccgagagactgatccagctggccgagggcaacctgaacaccctggtgaccgagatgaacgagctgctgaccagagccaccaaggtgaccgccgacggcgagcagaccggccaggacgccgagagaaccaacaccagagccaagagcctgggcgagttcatcaaggagctggccagagacgccgaggccgtgaacgagaaggccatcaagctgaacgagaccctgggcaccagagacgaggccttcgagagaaacctggagggcctgcagaaggagatcgaccagatgatcaaggagctgagaagaaagaacctggagacccagaaggagatcgccgaggacgagctggtggccgccgaggccctgctgaagaaggtgaagaagctgttcggcgagagcagaggcgagaacgaggagatggagaaggacctgagagagaagctggccgactacaagaacaaggtggacgacgcctgggacctgctgagagaggccaccgacaagatcagagaggccaacagactgttcgccgtgaaccagaagaacatgaccgccctggagaagaagaaggaggccgtggagagcggcaagagacagatcgagaacaccctgaaggagggcaacgacatcctggacgaggccaacagactggccgacgagatcaacagcatcatcgactacgtggaggacatccagaccaagctgccccccatgagcgaggagctgaacgacaagatcgacgacctgagccaggagatcaaggacagaaagctggccgagaaggtgagccaggccgagagccacgccgcccagctgaacgacagcagcgccgtgctggacggcatcctggacgaggccaagaacatcagcttcaacgccaccgccgccttcaaggcctacagcaacatcaaggactacatcgacgaggccgagaaggtggccaaggaggccaaggacctggcccacgaggccaccaagctggccaccggccccagaggcctgctgaaggaggacgccaagggctgcctgcagaagagcttcagaatcctgaacgaggccaagaagctggccaacgacgtgaaggagaacgaggaccacctgaacggcctgaagaccagaatcgagaacgccgacgccagaaacggcgacctgctgagaaccctgaacgacaccctgggcaagctgagcgccatccccaacgacaccgccgccaagctgcaggccgtgaaggacaaggccagacaggccaacgacaccgccaaggacgtgctggcccagatcaccgagctgcaccagaacctggacggcctgaagaagaactacaacaagctggccgacagcgtggccaagaccaacgccgtggtgaaggaccccagcaagaacaagatcgtggccgacgccgacgccaccgtgaagaacctggagcaggaggccgacagactgatcgacaagctgaagcccatcaaggagctggaggacaacctgaagaagaacatcagcgagatcaaggagctgatcaaccaggccagaaagcaggccaacagcatcaaggtgagcgtgagcagcggcggcgactgcatcagaacctacaagcccgagatcaagaagggcagctacaacaacatcgtggtgaacgtgaagaccgccgtggccgacaacctgctgttctacctgggcagcgccaagttcatcgacttcctggccatcgagatgagaaagggcaaggtgagcttcctgtgggacgtgggcagcggcgtgggcagagtggagtaccccgacctgaccatcgacgacagctactggtacagaatcgtggccagcagaaccggcagaaacggcaccatcagcgtgagagccctggacggccccaaggccagcatcgtgcccagcacccaccacagcaccagcccccccggctacaccatcctggacgtggacgccaacgccatgctgttcgtgggcggcctgaccggcaagctgaagaaggccgacgccgtgagagtgatcaccttcaccggctgcatgggcgagacctacttcgacaacaagcccatcggcctgtggaacttcagagagaaggagggcgactgcaagggctgcaccgtgagcccccaggtggaggacagcgagggcaccatccagttcgacggcgagggctacgccctggtgagcagacccatcagatggtaccccaacatcagcaccgtgatgttcaagttcagaaccttcagcagcagcgccctgctgatgtacctggccaccagagacctgagagacttcatgagcgtggagctgaccgacggccacatcaaggtgagctacgacctgggcagcggcatggccagcgtggtgagcaaccagaaccacaacgacggcaagtggaagagcttcaccctgagcagaatccagaagcaggccaacatcagcatcgtggacatcgacaccaaccaggaggagaacatcgccaccagcagcagcggcaacaacttcggcctggacctgaaggccgacgacaagatctacttcggcggcctgcccaccctgagaaacctgagactgttcaacagacccgaggtgaacctgaagaagtacagcggctgcctgaaggacatcgagatcagcagaaccccctacaacatcctgagcagccccgactacgtgggcgtgaccaagggctgcagcctggagaacgtgtacaccgtgagcttccccaagcccggcttcgtggagctgagccccgtgcccatcgacgtgggcaccgagatcaacctgagcttcagcaccaagaacgagagcggcatcatcctgctgggcagcggcggcacccccgccccccccagaagaaagagaagacagaccggccaggcctactacgccatcctgctgaacagaggcagactggaggtgcacctgagcaccggcgccagaaccatgagaaagatcgtgatcagacccgagcccaacctgttccacgacggcagagagcacagcgtgcacgtggagagaaccagaggcatcttcaccgtgcaggtggacgagaacagaagatacatgcagaacctgaccgtggagcagcccatcgaggtgaagaagctgttcgtgggcggcgccccccccgagttccagcccagccccctgagaaacatcccccccttcgagggctgcatctggaacctggtgatcaacagcgtgcccatggacttcgccagacccgtgagcttcaagaacgccgacatcggcagatgcgcccaccagaagctgagagaggacgaggacggcgccgcccccgccgagatcgtgatccagcccgagcccgtgcccacccccgccttccccacccccacccccgtgctgacccacggcccctgcgccgccgagagcgagcccgccctgctgatcggcagcaagcagttcggcctgagcagaaacagccacatcgccatcgccttcgacgacaccaaggtgaagaacagactgaccatcgagctggaggtgagaaccgaggccgagagcggcctgctgttctacatggccagaatcaaccacgccgacttcgccaccgtgcagctgagaaacggcctgccctacttcagctacgacctgggcagcggcgacacccacaccatgatccccaccaagatcaacgacggccagtggcacaagatcaagatcatgagaagcaagcaggagggcatcctgtacgtggacggcgccagcaacagaaccatcagccccaagaaggccgacatcctggacgtggtgggcatgctgtacgtgggcggcctgcccatcaactacaccaccagaagaatcggccccgtgacctacagcatcgacggctgcgtgagaaacctgcacatggccgaggcccccgccgacctggagcagcccaccagcagcttccacgtgggcacctgcttcgccaacgcccagagaggcacctacttcgacggcaccggcttcgccaaggccgtgggcggcttcaaggtgggcctggacctgctggtggagttcgagttcagaaccaccaccaccaccggcgtgctgctgggcatcagcagccagaagatggacggcatgggcatcgagatgatcgacgagaagctgatgttccacgtggacaacggcgccggcagattcaccgccgtgtacgacgccggcgtgcccggccacctgtgcgacggccagtggcacaaggtgaccgccaacaagatcaagcacagaatcgagctgaccgtggacggcaaccaggtggaggcccagagccccaaccccgccagcaccagcgccgacaccaacgaccccgtgttcgtgggcggcttccccgacgacctgaagcagttcggcctgaccaccagcatccccttcagaggctgcatcagaagcctgaagctgaccaagggcaccggcaagcccctggaggtgaacttcgccaaggccctggagctgagaggcgtgcagcccgtgagctgccccgccaactag

SEQ ID NO: 86482 - DNA, 9369 bp, Artificial Sequence
  Description of Artificial Sequence: Synthetic coding sequence
atgcccggcgccgccggcgtgctgctgctgctgctgctgagcggcggcctgggcggcgtgcaggcccagagaccccagcagcagagacagagccaggcccaccagcagagaggcctgttccccgccgtgctgaacctggccagcaacgccctgatcaccaccaacgccacctgcggcgagaagggccccgagatgtactgcaagctggtggagcacgtgcccggccagcccgtgagaaacccccagtgcagaatctgcaaccagaacagcagcaaccccaaccagagacaccccatcaccaacgccatcgacggcaagaacacctggtggcagagccccagcatcaagaacggcatcgagtaccactacgtgaccatcaccctggacctgcagcaggtgttccagatcgcctacgtgatcgtgaaggccgccaacagccccagacccggcaactggatcctggagagaagcctggacgacgtggagtacaagccctggcagtaccacgccgtgaccgacaccgagtgcctgaccctgtacaacatctaccccagaaccggcccccccagctacgccaaggacgacgaggtgatctgcaccagcttctacagcaagatccaccccctggagaacggcgagatccacatcagcctgatcaacggcagacccagcgccgacgaccccagccccgagctgctggagttcaccagcgccagatacatcagactgagattccagagaatcagaaccctgaacgccgacctgatgatgttcgcccacaaggaccccagagagatcgaccccatcgtgaccagaagatactactacagcgtgaaggacatcagcgtgggcggcatgtgcatctgctacggccacgccagagcctgccccctggaccccgccaccaacaagagcagatgcgagtgcgagcacaacacctgcggcgacagctgcgaccagtgctgccccggcttccaccagaagccctggagagccggcaccttcctgaccaagaccgagtgcgaggcctgcaactgccacggcaaggccgaggagtgctactacgacgagaacgtggccagaagaaacctgagcctgaacatcagaggcaagtacatcggcggcggcgtgtgcatcaactgcacccagaacaccgccggcatcaactgcgagacctgcaccgacggcttcttcagacccaagggcgtgagccccaactaccccagaccctgccagccctgccactgcgaccccatcggcagcctgaacgaggtgtgcgtgaaggacgagaagcacgccagaagaggcctggcccccggcagctgccactgcaagaccggcttcggcggcgtgagctgcgacagatgcgccagaggctacaccggctaccccgactgcaaggcctgcaactgcagcggcctgggcagcaagaacgaggacccctgcttcggcccctgcatctgcaaggagaacgtggagggcggcgactgcagcagatgcaagagcggcttcttcaacctgcaggaggacaactggaagggctgcgacgagtgcttctgcagcggcgtgagcaacagatgccagagcagctactggacctacggcaagatccaggacatgagcggctggtacctgaccgacctgcccggcagaatcagagtggccccccagcaggacgacctggacagcccccagcagatcagcatcagcaacgccgaggccagacaggccctgccccacagctactactggagcgcccccgccccctacctgggcaacaagctgcccgccgtgggcggccagctgaccttcaccatcagctacgacctggaggaggaggaggaggacaccgagagagtgctgcagctgatgatcatcctggagggcaacgacctgagcatcagcaccgcccaggacgaggtgtacctgcaccccagcgaggagcacaccaacgtgctgctgctgaaggaggagagcttcaccatccacggcacccacttccccgtgagaagaaaggagttcatgaccgtgctggccaacctgaagagagtgctgctgcagatcacctacagcttcggcatggacgccatcttcagactgagcagcgtgaacctggagagcgccgtgagctaccccaccgacggcagcatcgccgccgccgtggaggtgtgccagtgcccccccggctacaccggcagcagctgcgagagctgctggcccagacacagaagagtgaacggcaccatcttcggcggcatctgcgagccctgccagtgcttcggccacgccgagagctgcgacgacgtgaccggcgagtgcctgaactgcaaggaccacaccggcggcccctactgcgacaagtgcctgcccggcttctacggcgagcccaccaagggcaccagcgaggactgccagccctgcgcctgccccctgaacatccccagcaacaacttcagccccacctgccacctggacagaagcctgggcctgatctgcgacggctgccccgtgggctacaccggccccagatgcgagagatgcgccgagggctacttcggccagcccagcgtgcccggcggcagctgccagccctgccagtgcaacgacaacctggacttcagcatccccggcagctgcgacagcctgagcggcagctgcctgatctgcaagcccggcaccaccggcagatactgcgagctgtgcgccgacggctacttcggcgacgccgtggacgccaagaactgccagccctgcagatgcaacgccggcggcagcttcagcgaggtgtgccacagccagaccggccagtgcgagtgcagagccaacgtgcagggccagagatgcgacaagtgcaaggccggcaccttcggcctgcagagcgccagaggctgcgtgccctgcaactgcaacagcttcggcagcaagagcttcgactgcgaggagagcggccagtgctggtgccagcccggcgtgaccggcaagaagtgcgacagatgcgcccacggctacttcaacttccaggagggcggctgcaccgcctgcgagtgcagccacctgggcaacaactgcgaccccaagaccggcagatgcatctgcccccccaacaccatcggcgagaagtgcagcaagtgcgcccccaacacctggggccacagcatcaccaccggctgcaaggcctgcaactgcagcaccgtgggcagcctggacttccagtgcaacgtgaacaccggccagtgcaactgccaccccaagttcagcggcgccaagtgcaccgagtgcagcagaggccactggaactaccccagatgcaacctgtgcgactgcttcctgcccggcaccgacgccaccacctgcgacagcgagaccaagaagtgcagctgcagcgaccagaccggccagtgcacctgcaaggtgaacgtggagggcatccactgcgacagatgcagacccggcaagttcggcctggacgccaagaaccccctgggctgcagcagctgctactgcttcggcaccaccacccagtgcagcgaggccaagggcctgatcagaacctgggtgaccctgaaggccgagcagaccatcctgcccctggtggacgaggccctgcagcacaccaccaccaagggcatcgtgttccagcaccccgagatcgtggcccacatggacctgatgagagaggacctgcacctggagcccttctactggaagctgcccgagcagttcgagggcaagaagctgatggcctacggcggcaagctgaagtacgccatctacttcgaggccagagaggagaccggcttcagcacctacaacccccaggtgatcatcagaggcggcacccccacccacgccagaatcatcgtgagacacatggccgcccccctgatcggccagctgaccagacacgagatcgagatgaccgagaaggagtggaagtactacggcgacgaccccagagtgcacagaaccgtgaccagagaggacttcctggacatcctgtacgacatccactacatcctgatcaaggccacctacggcaacttcatgagacagagcagaatcagcgagatcagcatggaggtggccgagcagggcagaggcaccaccatgaccccccccgccgacctgatcgagaagtgcgactgccccctgggctacagcggcctgagctgcgaggcctgcctgcccggcttctacagactgagaagccagcccggcggcagaacccccggccccaccctgggcacctgcgtgccctgccagtgcaacggccacagcagcctgtgcgaccccgagaccagcatctgccagaactgccagcaccacaccgccggcgacttctgcgagagatgcgccctgggctactacggcatcgtgaagggcctgcccaacgactgccagcagtgcgcctgccccctgatcagcagcagcaacaacttcagccccagctgcgtggccgagggcctggacgactacagatgcaccgcctgccccagaggctacgagggccagtactgcgagagatgcgcccccggctacaccggcagccccggcaaccccggcggcagctgccaggagtgcgagtgcgacccctacggcagcctgcccgtgccctgcgaccccgtgaccggcttctgcacctgcagacccggcgccaccggcagaaagtgcgacggctgcaagcactggcacgccagagagggctgggagtgcgtgttctgcggcgacgagtgcaccggcctgctgctgggcgacctggccagactggagcagatggtgatgagcatcaacctgaccggccccctgcccgccccctacaagatgctgtacggcctggagaacatgacccaggagctgaagcacctgctgagcccccagagagcccccgagagactgatccagctggccgagggcaacctgaacaccctggtgaccgagatgaacgagctgctgaccagagccaccaaggtgaccgccgacggcgagcagaccggccaggacgccgagagaaccaacaccagagccaagagcctgggcgagttcatcaaggagctggccagagacgccgaggccgtgaacgagaaggccatcaagctgaacgagaccctgggcaccagagacgaggccttcgagagaaacctggagggcctgcagaaggagatcgaccagatgatcaaggagctgagaagaaagaacctggagacccagaaggagatcgccgaggacgagctggtggccgccgaggccctgctgaagaaggtgaagaagctgttcggcgagagcagaggcgagaacgaggagatggagaaggacctgagagagaagctggccgactacaagaacaaggtggacgacgcctgggacctgctgagagaggccaccgacaagatcagagaggccaacagactgttcgccgtgaaccagaagaacatgaccgccctggagaagaagaaggaggccgtggagagcggcaagagacagatcgagaacaccctgaaggagggcaacgacatcctggacgaggccaacagactggccgacgagatcaacagcatcatcgactacgtggaggacatccagaccaagctgccccccatgagcgaggagctgaacgacaagatcgacgacctgagccaggagatcaaggacagaaagctggccgagaaggtgagccaggccgagagccacgccgcccagctgaacgacagcagcgccgtgctggacggcatcctggacgaggccaagaacatcagcttcaacgccaccgccgccttcaaggcctacagcaacatcaaggactacatcgacgaggccgagaaggtggccaaggaggccaaggacctggcccacgaggccaccaagctggccaccggccccagaggcctgctgaaggaggacgccaagggctgcctgcagaagagcttcagaatcctgaacgaggccaagaagctggccaacgacgtgaaggagaacgaggaccacctgaacggcctgaagaccagaatcgagaacgccgacgccagaaacggcgacctgctgagaaccctgaacgacaccctgggcaagctgagcgccatccccaacgacaccgccgccaagctgcaggccgtgaaggacaaggccagacaggccaacgacaccgccaaggacgtgctggcccagatcaccgagctgcaccagaacctggacggcctgaagaagaactacaacaagctggccgacagcgtggccaagaccaacgccgtggtgaaggaccccagcaagaacaagatcatcgccgacgccgacgccaccgtgaagaacctggagcaggaggccgacagactgatcgacaagctgaagcccatcaaggagctggaggacaacctgaagaagaacatcagcgagatcaaggagctgatcaaccaggccagaaagcaggccaacagcatcaaggtgagcgtgagcagcggcggcgactgcatcagaacctacaagcccgagatcaagaagggcagctacaacaacatcgtggtgaacgtgaagaccgccgtggccgacaacctgctgttctacctgggcagcgccaagttcatcgacttcctggccatcgagatgagaaagggcaaggtgagcttcctgtgggacgtgggcagcggcgtgggcagagtggagtaccccgacctgaccatcgacgacagctactggtacagaatcgtggccagcagaaccggcagaaacggcaccatcagcgtgagagccctggacggccccaaggccagcatcgtgcccagcacccaccacagcaccagcccccccggctacaccatcctggacgtggacgccaacgccatgctgttcgtgggcggcctgaccggcaagctgaagaaggccgacgccgtgagagtgatcaccttcaccggctgcatgggcgagacctacttcgacaacaagcccatcggcctgtggaacttcagagagaaggagggcgactgcaagggctgcaccgtgagcccccaggtggaggacagcgagggcaccatccagttcgacggcgagggctacgccctggtgagcagacccatcagatggtaccccaacatcagcaccgtgatgttcaagttcagaaccttcagcagcagcgccctgctgatgtacctggccaccagagacctgagagacttcatgagcgtggagctgaccgacggccacatcaaggtgagctacgacctgggcagcggcatggccagcgtggtgagcaaccagaaccacaacgacggcaagtggaagagcttcaccctgagcagaatccagaagcaggccaacatcagcatcgtggacatcgacaccaaccaggaggagaacatcgccaccagcagcagcggcaacaacttcggcctggacctgaaggccgacgacaagatctacttcggcggcctgcccaccctgagaaacctgagcatgaaggccagacccgaggtgaacctgaagaagtacagcggctgcctgaaggacatcgagatcagcagaaccccctacaacatcctgagcagccccgactacgtgggcgtgaccaagggctgcagcctggagaacgtgtacaccgtgagcttccccaagcccggcttcgtggagctgagccccgtgcccatcgacgtgggcaccgagatcaacctgagcttcagcaccaagaacgagagcggcatcatcctgctgggcagcggcggcacccccgccccccccagaagaaagagaagacagaccggccaggcctactacgccatcctgctgaacagaggcagactggaggtgcacctgagcaccggcgccagaaccatgagaaagatcgtgatcagacccgagcccaacctgttccacgacggcagagagcacagcgtgcacgtggagagaaccagaggcatcttcaccgtgcaggtggacgagaacagaagatacatgcagaacctgaccgtggagcagcccatcgaggtgaagaagctgttcgtgggcggcgccccccccgagttccagcccagccccctgagaaacatcccccccttcgagggctgcatctggaacctggtgatcaacagcgtgcccatggacttcgccagacccgtgagcttcaagaacgccgacatcggcagatgcgcccaccagaagctgagagaggacgaggacggcgccgcccccgccgagatcgtgatccagcccgagcccgtgcccacccccgccttccccacccccacccccgtgctgacccacggcccctgcgccgccgagagcgagcccgccctgctgatcggcagcaagcagttcggcctgagcagaaacagccacatcgccatcgccttcgacgacaccaaggtgaagaacagactgaccatcgagctggaggtgagaaccgaggccgagagcggcctgctgttctacatggccagaatcaaccacgccgacttcgccaccgtgcagctgagaaacggcctgccctacttcagctacgacctgggcagcggcgacacccacaccatgatccccaccaagatcaacgacggccagtggcacaagatcaagatcatgagaagcaagcaggagggcatcctgtacgtggacggcgccagcaacagaaccatcagccccaagaaggccgacatcctggacgtggtgggcatgctgtacgtgggcggcctgcccatcaactacaccaccagaagaatcggccccgtgacctacagcatcgacggctgcgtgagaaacctgcacatggccgaggcccccgccgacctggagcagcccaccagcagcttccacgtgggcacctgcttcgccaacgcccagagaggcacctacttcgacggcaccggcttcgccaaggccgtgggcggcttcaaggtgggcctggacctgctggtggagttcgagttcagaaccaccaccaccaccggcgtgctgctgggcatcagcagccagaagatggacggcatgggcatcgagatgatcgacgagaagctgatgttccacgtggacaacggcgccggcagattcaccgccgtgtacgacgccggcgtgcccggccacctgtgcgacggccagtggcacaaggtgaccgccaacaagatcaagcacagaatcgagctgaccgtggacggcaaccaggtggaggcccagagccccaaccccgccagcaccagcgccgacaccaacgaccccgtgttcgtgggcggcttccccgacgacctgaagcagttcggcctgaccaccagcatccccttcagaggctgcatcagaagcctgaagctgaccaagggcaccggcaagcccctggaggtgaacttcgccaaggccctggagctgagaggcgtgcagcccgtgagctgccccgccaactag

SEQ ID NO: 86483 - DNA, 3387 bp, Artificial Sequence
  Description of Artificial Sequence: Synthetic coding sequence
aagaagctggccaacgacgtgaaggagaacgaggaccacctgaacggcctgaagaccagaatcgagaacgccgacgccagaaacggcgacctgctgagaaccctgaacgacaccctgggcaagctgagcgccatccccaacgacaccgccgccaagctgcaggccgtgaaggacaaggccagacaggccaacgacaccgccaaggacgtgctggcccagatcaccgagctgcaccagaacctggacggcctgaagaagaactacaacaagctggccgacagcgtggccaagaccaacgccgtggtgaaggaccccagcaagaacaccgtggccgacgccgacgccaccgtgaagaacctggagcaggaggccgacagactgatcgacaagctgaagcccatcaaggagctggaggacaacctgaagaagaacatcagcgagatcaaggagctgatcaaccaggccagaaagcaggccaacagcatcaaggtgagcgtgagcagcggcggcgactgcatcagaacctacaagcccgagatcaagaagggcagctacaacaacatcgtggtgaacgtgaagaccgccgtggccgacaacctgctgttctacctgggcagcgccaagttcatcgacttcctggccatcgagatgagaaagggcaaggtgagcttcctgtgggacgtgggcagcggcgtgggcagagtggagtaccccgacctgaccatcgacgacagctactggtacagaatcgtggccagcagaaccggcagaaacggcaccatcagcgtgagagccctggacggccccaaggccagcatcgtgcccagcacccaccacagcaccagcccccccggctacaccatcctggacgtggacgccaacgccatgctgttcgtgggcggcctgaccggcaagctgaagaaggccgacgccgtgagagtgatcaccttcaccggctgcatgggcgagacctacttcgacaacaagcccatcggcctgtggaacttcagagagaaggagggcgactgcaagggctgcaccgtgagcccccaggtggaggacagcgagggcaccatccagttcgacggcgagggctacgccctggtgagcagacccatcagatggtaccccaacatcagcaccgtgatgttcaagttcagaaccttcagcagcagcgccctgctgatgtacctggccaccagagacctgagagacttcatgagcgtggagctgaccgacggccacatcaaggtgagctacgacctgggcagcggcatggccagcgtggtgagcaaccagaaccacaacgacggcaagtggaagagcttcaccctgagcagaatccagaagcaggccaacatcagcatcgtggacatcgacaccaaccaggaggagaacatcgccaccagcagcagcggcaacaacttcggcctggacctgaaggccgacgacaagatctacttcggcggcctgcccaccctgagaaacctgagcatgaaggccagacccgaggtgaacctgaagaagtacagcggctgcctgaaggacatcgagatcagcagaaccccctacaacatcctgagcagccccgactacgtgggcgtgaccaagggctgcagcctggagaacgtgtacaccgtgagcttccccaagcccggcttcgtggagctgagccccgtgcccatcgacgtgggcaccgagatcaacctgagcttcagcaccaagaacgagagcggcatcatcctgctgggcagcggcggcacccccgccccccccagaagaaagagaagacagaccggccaggcctactacgccatcctgctgaacagaggcagactggaggtgcacctgagcaccggcgccagaaccatgagaaagatcgtgatcagacccgagcccaacctgttccacgacggcagagagcacagcgtgcacgtggagagaaccagaggcatcttcaccgtgcaggtggacgagaacagaagatacatgcagaacctgaccgtggagcagcccatcgaggtgaagaagctgttcgtgggcggcgccccccccgagttccagcccagccccctgagaaacatcccccccttcgagggctgcatctggaacctggtgatcaacagcgtgcccatggacttcgccagacccgtgagcttcaagaacgccgacatcggcagatgcgcccaccagaagctgagagaggacgaggacggcgccgcccccgccgagatcgtgatccagcccgagcccgtgcccacccccgccttccccacccccacccccgtgctgacccacggcccctgcgccgccgagagcgagcccgccctgctgatcggcagcaagcagttcggcctgagcagaaacagccacatcgccatcgccttcgacgacaccaaggtgaagaacagactgaccatcgagctggaggtgagaaccgaggccgagagcggcctgctgttctacatggccagaatcaaccacgccgacttcgccaccgtgcagctgagaaacggcctgccctacttcagctacgacctgggcagcggcgacacccacaccatgatccccaccaagatcaacgacggccagtggcacaagatcaagatcatgagaagcaagcaggagggcatcctgtacgtggacggcgccagcaacagaaccatcagccccaagaaggccgacatcctggacgtggtgggcatgctgtacgtgggcggcctgcccatcaactacaccaccagaagaatcggccccgtgacctacagcatcgacggctgcgtgagaaacctgcacatggccgaggcccccgccgacctggagcagcccaccagcagcttccacgtgggcacctgcttcgccaacgcccagagaggcacctacttcgacggcaccggcttcgccaaggccgtgggcggcttcaaggtgggcctggacctgctggtggagttcgagttcagaaccaccaccaccaccggcgtgctgctgggcatcagcagccagaagatggacggcatgggcatcgagatgatcgacgagaagctgatgttccacgtggacaacggcgccggcagattcaccgccgtgtacgacgccggcgtgcccggccacctgtgcgacggccagtggcacaaggtgaccgccaacaagatcaagcacagaatcgagctgaccgtggacggcaaccaggtggaggcccagagccccaaccccgccagcaccagcgccgacaccaacgaccccgtgttcgtgggcggcttccccgacgacctgaagcagttcggcctgaccaccagcatccccttcagaggctgcatcagaagcctgaagctgaccaagggcaccgccagccactggagactgatcctgcccagaccctggaactag

SEQ ID NO: 86484 - DNA, 5175 bp, Artificial Sequence
  Description of Artificial Sequence: Synthetic coding sequence
atgccccccgccgtgagaagaagcgcctgcagcatgggctggctgtggatcttcggcgccgccctgggccagtgcctgggctacagcagccagcagcagagagtgcccttcctgcagccccccggccagagccagctgcaggccagctacgtggagttcagacccagccagggctgcagccccggctactacagagaccacaagggcctgtacaccggcagatgcgtgccctgcaactgcaacggccacagcaaccagtgccaggacggcagcggcatctgcgtgaactgccagcacaacaccgccggcgagcactgcgagagatgccaggagggctactacggcaacgccgtgcacggcagctgcagagcctgcccctgcccccacaccaacagcttcgccaccggctgcgtggtgaacggcggcgacgtgagatgcagctgcaaggccggctacaccggcacccagtgcgagagatgcgcccccggctacttcggcaacccccagaagttcggcggcagctgccagccctgcagctgcaacagcaacggccagctgggcagctgccaccccctgaccggcgactgcatcaaccaggagcccaaggacagcagccccgccgaggagtgcgacgactgcgacagctgcgtgatgaccctgctgaacgacctggccaccatgggcgagcagctgagactggtgaagagccagctgcagggcctgagcgccagcgccggcctgctggagcagatgagacacatggagacccaggccaaggacctgagaaaccagctgctgaactacagaagcgccatcagcaaccacggcagcaagatcgagggcctggagagagagctgaccgacctgaaccaggagttcgagaccctgcaggagaaggcccaggtgaacagcagaaaggcccagaccctgaacaacaacgtgaacagagccacccagagcgccaaggagctggacgtgaagatcaagaacgtgatcagaaacgtgcacatcctgctgaagcagatcagcggcaccgacggcgagggcaacaacgtgcccagcggcgacttcagcagagagtgggccgaggcccagagaatgatgagagagctgagaaacagaaacttcggcaagcacctgagagaggccgaggccgacaagagagagagccagctgctgctgaacagaatcagaacctggcagaagacccaccagggcgagaacaacggcctggccaacagcatcagagacagcctgaacgagtacgaggccaagctgagcgacctgagagccagactgcaggaggccgccgcccaggccaagcaggccaacggcctgaaccaggagaacgagagagccctgggcgccatccagagacaggtgaaggagatcaacagcctgcagagcgacttcaccaagtacctgaccaccgccgacagcagcctgctgcagaccaacatcgccctgcagctgatggagaagagccagaaggagtacgagaagctggccgccagcctgaacgaggccagacaggagctgagcgacaaggtgagagagctgagcagaagcgccggcaagaccagcctggtggaggaggccgagaagcacgccagaagcctgcaggagctggccaagcagctggaggagatcaagagaaacgccagcggcgacgagctggtgagatgcgccgtggacgccgccaccgcctacgagaacatcctgaacgccatcaaggccgccgaggacgccgccaacagagccgccagcgccagcgagagcgccctgcagaccgtgatcaaggaggacctgcccagaaaggccaagaccctgagcagcaacagcgacaagctgctgaacgaggccaagatgacccagaagaagctgaagcaggaggtgagccccgccctgaacaacctgcagcagaccctgaacatcgtgaccgtgcagaaggaggtgatcgacaccaacctgaccaccctgagagacggcctgcacggcatccagagaggcgacatcgacgccatgatcagcagcgccaagagcatggtgagaaaggccaacgacatcaccgacgaggtgctggacggcctgaaccccatccagaccgacgtggagagaatcaaggacacctacggcagaacccagaacgaggacttcaagaaggccctgaccgacgccgacaacagcgtgaacaagctgaccaacaagctgcccgacctgtggagaaagatcgagagcatcaaccagcagctgctgcccctgggcaacatcagcgacaacatggacagaatcagagagctgatccagcaggccagagacgccgccagcaaggtggccgtgcccatgagattcaacggcaagagcggcgtggaggtgagactgcccaacgacctggaggacctgaagggctacaccagcctgagcctgttcctgcagagacccaacagcagagagaacggcggcaccgagaacatgttcgtgatgtacctgggcaacaaggacgccagcagagactacatcggcatggccgtggtggacggccagctgacctgcgtgtacaacctgggcgacagagaggccgagctgcaggtggaccagatcctgaccaagagcgagaccaaggaggccgtgatggacagagtgaagttccagagaatctaccagttcgccagactgaactacaccaagggcgccaccagcagcaagcccgagacccccggcgtgtacgacatggacggcagaaacagcaacaccctgctgaacctggaccccgagaacgtggtgttctacgtgggcggctacccccccgacttcaagctgcccagcagactgagcttccccccctacaagggctgcatcgagctggacgacctgaacgagaacgtgctgagcctgtacaacttcaagaagaccttcaacctgaacaccaccgaggtggagccctgcagaagaagaaaggaggagagcgacaagaactacttcgagggcaccggctacgccagagtgcccacccagccccacgcccccatccccaccttcggccagaccatccagaccaccgtggacagaggcctgctgttcttcgccgagaacggcgacagattcatcagcctgaacatcgaggacggcaagctgatggtgagatacaagctgaacagcgagctgcccaaggagagaggcgtgggcgacgccatcaacaacggcagagaccacagcatccagatcaagatcggcaagctgcagaagagaatgtggatcaacgtggacgtgcagaacaccatcatcgacggcgaggtgttcgacttcagcacctactacctgggcggcatccccatcgccatcagagagagattcaacatcagcacccccgccttcagaggctgcatgaagaacctgaagaagaccagcggcgtggtgagactgaacgacaccgtgggcgtgaccaagaagtgcagcgaggactggaagctggtgagaagcgccagcttcagcagaggcggccagctgagcttcaccgacctgggcctgccccccaccgaccacctgcaggccagcttcggcttccagaccttccagcccagcggcatcctgctggaccaccagacctggaccagaaacctgcaggtgaccctggaggacggctacatcgagctgagcaccagcgacagcggcagccccatcttcaagagcccccagacctacatggacggcctgctgcactacgtgagcgtgatcagcgacaacagcggcctgagactgctgatcgacgaccagctgctgagaaacagcaagagactgaagcacatcagcagcagcagacagagcctgagactgggcggcagcaacttcgagggctgcatcagcaacgtgttcgtgcagagactgagcctgagccccgaggtgctggacctgaccagcaacagcctgaagagagacgtgagcctgggcggctgcagcctgaacaagccccccttcctgatgctgctgaagggcagcaccagattcaacaagaccaagaccttcagaatcaaccagctgctgcaggacacccccgtggccagccccagaagcgtgaaggtgtggcaggacgcctgcagccccctgcccaagacccaggccaaccacggcgccctgcagttcggcgacatccccaccagccacctgctgttcaagctgccccaggagctgctgaagcccagaagccagttcgccgtggacatgcagaccaccagcagcagaggcctggtgttccacaccggcaccaagaacagcttcatggccctgtacctgagcaagggcagactggtgttcgccctgggcaccgacggcaagaagctgagaatcaagagcaaggagaagtgcaacgacggcaagtggcacaccgtggtgttcggccacgacggcgagaagggcagactggtggtggacggcctgagagccagagagggcagcctgcccggcaacagcaccatcagcatcagagcccccgtgtacctgggcagcccccccagcggcaagcccaagagcctgcccaccaacagcttcgtgggctgcctgaagaacttccagctggacagcaagcccctgtacacccccagcagcagcttcggcgtgagcagctgcctgggcggccccctggagaagggcatctacttcagcgaggagggcggccacgtggtgctggcccacagcgtgctgctgggccccgagttcaagctggtgttcagcatcagacccagaagcctgaccggcatcctgatccacatcggcagccagcccggcaagcacctgtgcgtgtacctggaggccggcaaggtgaccgccagcatggacagcggcgccggcggcaccagcaccagcgtgacccccaagcagagcctgtgcgacggccagtggcacagcgtggccgtgaccatcaagcagcacatcctgcacctggagctggacaccgacagcagctacaccgccggccagatccccttcccccccgccagcacccaggagcccctgcacctgggcggcgcccccgccaacctgaccaccctgagaatccccgtgtggaagagcttcttcggctgcctgagaaacatccacgtgaaccacatccccgtgcccgtgaccgaggccctggaggtgcagggccccgtgagcctgaacggctgccccgaccagtag

SEQ ID NO: 86485 - DNA, 10002 bp, Artificial Sequence
  Description of Artificial Sequence: Synthetic coding sequence
atggccgccgccgccagacccagaggcagagccctgggccccgtgctgccccccacccccctgctgctgctggtgctgagagtgctgcccgcctgcggcgccaccgccagagaccccggcgccgccgccggcctgagcctgcaccccacctacttcaacctggccgaggccgccagaatctgggccaccgccacctgcggcgagagaggccccggcgagggcagaccccagcccgagctgtactgcaagctggtgggcggccccaccgcccccggcagcggccacaccatccagggccagttctgcgactactgcaacagcgaggaccccagaaaggcccaccccgtgaccaacgccatcgacggcagcgagagatggtggcagagcccccccctgagcagcggcacccagtacaacagagtgaacctgaccctggacctgggccagctgttccacgtggcctacatcctgatcaagttcgccaacagccccagacccgacctgtgggtgctggagagaagcgtggacttcggcagcacctacagcccctggcagtacttcgcccacagcaaggtggactgcctgaaggagttcggcagagaggccaacatggccgtgaccagagacgacgacgtgctgtgcgtgaccgagtacagcagaatcgtgcccctggagaacggcgaggtggtggtgagcctgatcaacggcagacccggcgccaagaacttcaccttcagccacaccctgagagagttcaccaaggccaccaacatcagactgagattcctgagaaccaacaccctgctgggccacctgatcagcaaggcccagagagaccccaccgtgaccagaagatactactacagcatcaaggacatcagcatcggcggccagtgcgtgtgcaacggccacgccgaggtgtgcaacatcaacaaccccgagaagctgttcagatgcgagtgccagcaccacacctgcggcgagacctgcgacagatgctgcaccggctacaaccagagaagatggagacccgccgcctgggagcagagccacgagtgcgaggcctgcaactgccacggccacgccagcaactgctactacgaccccgacgtggagagacagcaggccagcctgaacacccagggcatctacgccggcggcggcgtgtgcatcaactgccagcacaacaccgccggcgtgaactgcgagcagtgcgccaagggctactacagaccctacggcgtgcccgtggacgcccccgacggctgcatcccctgcagctgcgaccccgagcacgccgacggctgcgagcagggcagcggcagatgccactgcaagcccaacttccacggcgacaactgcgagaagtgcgccatcggctactacaacttccccttctgcctgagaatccccatcttccccgtgagcacccccagcagcgaggaccccgtggccggcgacatcaagggctgcgactgcaacctggagggcgtgctgcccgagatctgcgacgcccacggcagatgcctgtgcagacccggcgtggagggccccagatgcgacacctgcagaagcggcttctacagcttccccatctgccaggcctgctggtgcagcgccctgggcagctaccagatgccctgcagcagcgtgaccggccagtgcgagtgcagacccggcgtgaccggccagagatgcgacagatgcctgagcggcgcctacgacttcccccactgccagggcagcagcagcgcctgcgaccccgccggcaccatcaacagcaacctgggctactgccagtgcaagctgcacgtggagggccccacctgcagcagatgcaagctgctgtactggaacctggacaaggagaaccccagcggctgcagcgagtgcaagtgccacaaggccggcaccgtgagcggcaccggcgagtgcagacagggcgacggcgactgccactgcaagagccacgtgggcggcgacagctgcgacacctgcgaggacggctacttcgccctggagaagagcaactacttcggctgccagggctgccagtgcgacatcggcggcgccctgagcagcatgtgcagcggccccagcggcgtgtgccagtgcagagagcacgtggtgggcaaggtgtgccagagacccgagaacaactactacttccccgacctgcaccacatgaagtacgagatcgaggacggcagcacccccaacggcagagacctgagattcggcttcgaccccctggccttccccgagttcagctggagaggctacgcccagatgaccagcgtgcagaacgacgtgagaatcaccctgaacgtgggcaagagcagcggcagcctgttcagagtgatcctgagatacgtgaaccccggcaccgaggccgtgagcggccacatcaccatctaccccagctggggcgccgcccagagcaaggagatcatcttcctgcccagcaaggagcccgccttcgtgaccgtgcccggcaacggcttcgccgaccccttcagcatcacccccggcatctgggtggcctgcatcaaggccgagggcgtgctgctggactacctggtgctgctgcccagagactactacgaggccagcgtgctgcagctgcccgtgaccgagccctgcgcctacgccggccccccccaggagaactgcctgctgtaccagcacctgcccgtgaccagattcccctgcaccctggcctgcgaggccagacacttcctgctggacggcgagcccagacccgtggccgtgagacagcccacccccgcccaccccgtgatggtggacctgagcggcagagaggtggagctgcacctgagactgagaatcccccaggtgggccactacgtggtggtggtggagtacagcaccgaggccgcccagctgttcgtggtggacgtgaacgtgaagagcagcggcagcgtgctggccggccaggtgaacatctacagctgcaactacagcgtgctgtgcagaagcgccgtgatcgaccacatgagcagaatcgccatgtacgagctgctggccgacgccgacatccagctgaagggccacatggccagattcctgctgcaccaggtgtgcatcatccccatcgaggagttcagcgccgagtacgtgagaccccaggtgcactgcatcgccagctacggcagattcgtgaaccagagcgccacctgcgtgagcctggcccacgagaccccccccaccgccctgatcctggacgtgctgagcggcagacccttcccccacctgccccagcagagcagccccagcgtggacgtgctgcccggcgtgaccctgaaggccccccagaaccaggtgaccctgagaggcagagtgccccacctgggcagatacgtgttcgtgatccacttctaccaggccgcccaccccaccttccccgcccaggtgagcgtggacggcggctggcccagagccggcagcttccacgccagcttctgcccccacgtgctgggctgcagagaccaggtgatcgccgagggccagatcgagttcgacatcagcgagcccgaggtggccgccaccgtgaaggtgcccgagggcaagagcctggtgctggtgagagtgctggtggtgcccgccgagaactacgactaccagatcctgcacaagaagagcatggacaagagcctggagttcatcaccaactgcggcaagaacagcttctacctggacccccagaccgccagcagattctgcaagaacagcgccagaagcctggtggccttctaccacaagggcgccctgccctgcgagtgccaccccaccggcgccaccggcccccactgcagccccgagggcggccagtgcccctgccagcccaacgtgatcggcagacagtgcaccagatgcgccaccggccactacggcttccccagatgcaagccctgcagctgcggcagaagactgtgcgaggagatgaccggccagtgcagatgcccccccagaaccgtgagaccccagtgcgaggtgtgcgagacccacagcttcagcttccaccccatggccggctgcgagggctgcaactgcagcagaagaggcaccatcgaggccgccatgcccgagtgcgacagagacagcggccagtgcagatgcaagcccagaatcaccggcagacagtgcgacagatgcgccagcggcttctacagattccccgagtgcgtgccctgcaactgcaacagagacggcaccgagcccggcgtgtgcgaccccggcaccggcgcctgcctgtgcaaggagaacgtggagggcaccgagtgcaacgtgtgcagagagggcagcttccacctggaccccgccaacctgaagggctgcaccagctgcttctgcttcggcgtgaacaaccagtgccacagcagccacaagagaagaaccaagttcgtggacatgctgggctggcacctggagaccgccgacagagtggacatccccgtgagcttcaaccccggcagcaacagcatggtggccgacctgcaggagctgcccgccaccatccacagcgccagctgggtggcccccaccagctacctgggcgacaaggtgagcagctacggcggctacctgacctaccaggccaagagcttcggcctgcccggcgacatggtgctgctggagaagaagcccgacgtgcagctgaccggccagcacatgagcatcatctacgaggagaccaacacccccagacccgacagactgcaccacggcagagtgcacgtggtggagggcaacttcagacacgccagcagcagagcccccgtgagcagagaggagctgatgaccgtgctgagcagactggccgacgtgagaatccagggcctgtacttcaccgagacccagagactgaccctgagcgaggtgggcctggaggaggccagcgacaccggcagcggcagaatcgccctggccgtggagatctgcgcctgcccccccgcctacgccggcgacagctgccagggctgcagccccggctactacagagaccacaagggcctgtacaccggcagatgcgtgccctgcaactgcaacggccacagcaaccagtgccaggacggcagcggcatctgcgtgaactgccagcacaacaccgccggcgagcactgcgagagatgccaggagggctactacggcaacgccgtgcacggcagctgcagagcctgcccctgcccccacaccaacagcttcgccaccggctgcgtggtgaacggcggcgacgtgagatgcagctgcaaggccggctacaccggcacccagtgcgagagatgcgcccccggctacttcggcaacccccagaagttcggcggcagctgccagccctgcagctgcaacagcaacggccagctgggcagctgccaccccctgaccggcgactgcatcaaccaggagcccaaggacagcagccccgccgaggagtgcgacgactgcgacagctgcgtgatgaccctgctgaacgacctggccaccatgggcgagcagctgagactggtgaagagccagctgcagggcctgagcgccagcgccggcctgctggagcagatgagacacatggagacccaggccaaggacctgagaaaccagctgctgaactacagaagcgccatcagcaaccacggcagcaagatcgagggcctggagagagagctgaccgacctgaaccaggagttcgagaccctgcaggagaaggcccaggtgaacagcagaaaggcccagaccctgaacaacaacgtgaacagagccacccagagcgccaaggagctggacgtgaagatcaagaacgtgatcagaaacgtgcacatcctgctgaagcagatcagcggcaccgacggcgagggcaacaacgtgcccagcggcgacttcagcagagagtgggccgaggcccagagaatgatgagagagctgagaaacagaaacttcggcaagcacctgagagaggccgaggccgacaagagagagagccagctgctgctgaacagaatcagaacctggcagaagacccaccagggcgagaacaacggcctggccaacagcatcagagacagcctgaacgagtacgaggccaagctgagcgacctgagagccagactgcaggaggccgccgcccaggccaagcaggccaacggcctgaaccaggagaacgagagagccctgggcgccatccagagacaggtgaaggagatcaacagcctgcagagcgacttcaccaagtacctgaccaccgccgacagcagcctgctgcagaccaacatcgccctgcagctgatggagaagagccagaaggagtacgagaagctggccgccagcctgaacgaggccagacaggagctgagcgacaaggtgagagagctgagcagaagcgccggcaagaccagcctggtggaggaggccgagaagcacgccagaagcctgcaggagctggccaagcagctggaggagatcaagagaaacgccagcggcgacgagctggtgagatgcgccgtggacgccgccaccgcctacgagaacatcctgaacgccatcaaggccgccgaggacgccgccaacagagccgccagcgccagcgagagcgccctgcagaccgtgatcaaggaggacctgcccagaaaggccaagaccctgagcagcaacagcgacaagctgctgaacgaggccaagatgacccagaagaagctgaagcaggaggtgagccccgccctgaacaacctgcagcagaccctgaacatcgtgaccgtgcagaaggaggtgatcgacaccaacctgaccaccctgagagacggcctgcacggcatccagagaggcgacatcgacgccatgatcagcagcgccaagagcatggtgagaaaggccaacgacatcaccgacgaggtgctggacggcctgaaccccatccagaccgacgtggagagaatcaaggacacctacggcagaacccagaacgaggacttcaagaaggccctgaccgacgccgacaacagcgtgaacaagctgaccaacaagctgcccgacctgtggagaaagatcgagagcatcaaccagcagctgctgcccctgggcaacatcagcgacaacatggacagaatcagagagctgatccagcaggccagagacgccgccagcaaggtggccgtgcccatgagattcaacggcaagagcggcgtggaggtgagactgcccaacgacctggaggacctgaagggctacaccagcctgagcctgttcctgcagagacccaacagcagagagaacggcggcaccgagaacatgttcgtgatgtacctgggcaacaaggacgccagcagagactacatcggcatggccgtggtggacggccagctgacctgcgtgtacaacctgggcgacagagaggccgagctgcaggtggaccagatcctgaccaagagcgagaccaaggaggccgtgatggacagagtgaagttccagagaatctaccagttcgccagactgaactacaccaagggcgccaccagcagcaagcccgagacccccggcgtgtacgacatggacggcagaaacagcaacaccctgctgaacctggaccccgagaacgtggtgttctacgtgggcggctacccccccgacttcaagctgcccagcagactgagcttccccccctacaagggctgcatcgagctggacgacctgaacgagaacgtgctgagcctgtacaacttcaagaagaccttcaacctgaacaccaccgaggtggagccctgcagaagaagaaaggaggagagcgacaagaactacttcgagggcaccggctacgccagagtgcccacccagccccacgcccccatccccaccttcggccagaccatccagaccaccgtggacagaggcctgctgttcttcgccgagaacggcgacagattcatcagcctgaacatcgaggacggcaagctgatggtgagatacaagctgaacagcgagctgcccaaggagagaggcgtgggcgacgccatcaacaacggcagagaccacagcatccagatcaagatcggcaagctgcagaagagaatgtggatcaacgtggacgtgcagaacaccatcatcgacggcgaggtgttcgacttcagcacctactacctgggcggcatccccatcgccatcagagagagattcaacatcagcacccccgccttcagaggctgcatgaagaacctgaagaagaccagcggcgtggtgagactgaacgacaccgtgggcgtgaccaagaagtgcagcgaggactggaagctggtgagaagcgccagcttcagcagaggcggccagctgagcttcaccgacctgggcctgccccccaccgaccacctgcaggccagcttcggcttccagaccttccagcccagcggcatcctgctggaccaccagacctggaccagaaacctgcaggtgaccctggaggacggctacatcgagctgagcaccagcgacagcggcagccccatcttcaagagcccccagacctacatggacggcctgctgcactacgtgagcgtgatcagcgacaacagcggcctgagactgctgatcgacgaccagctgctgagaaacagcaagagactgaagcacatcagcagcagcagacagagcctgagactgggcggcagcaacttcgagggctgcatcagcaacgtgttcgtgcagagactgagcctgagccccgaggtgctggacctgaccagcaacagcctgaagagagacgtgagcctgggcggctgcagcctgaacaagccccccttcctgatgctgctgaagggcagcaccagattcaacaagaccaagaccttcagaatcaaccagctgctgcaggacacccccgtggccagccccagaagcgtgaaggtgtggcaggacgcctgcagccccctgcccaagacccaggccaaccacggcgccctgcagttcggcgacatccccaccagccacctgctgttcaagctgccccaggagctgctgaagcccagaagccagttcgccgtggacatgcagaccaccagcagcagaggcctggtgttccacaccggcaccaagaacagcttcatggccctgtacctgagcaagggcagactggtgttcgccctgggcaccgacggcaagaagctgagaatcaagagcaaggagaagtgcaacgacggcaagtggcacaccgtggtgttcggccacgacggcgagaagggcagactggtggtggacggcctgagagccagagagggcagcctgcccggcaacagcaccatcagcatcagagcccccgtgtacctgggcagcccccccagcggcaagcccaagagcctgcccaccaacagcttcgtgggctgcctgaagaacttccagctggacagcaagcccctgtacacccccagcagcagcttcggcgtgagcagctgcctgggcggccccctggagaagggcatctacttcagcgaggagggcggccacgtggtgctggcccacagcgtgctgctgggccccgagttcaagctggtgttcagcatcagacccagaagcctgaccggcatcctgatccacatcggcagccagcccggcaagcacctgtgcgtgtacctggaggccggcaaggtgaccgccagcatggacagcggcgccggcggcaccagcaccagcgtgacccccaagcagagcctgtgcgacggccagtggcacagcgtggccgtgaccatcaagcagcacatcctgcacctggagctggacaccgacagcagctacaccgccggccagatccccttcccccccgccagcacccaggagcccctgcacctgggcggcgcccccgccaacctgaccaccctgagaatccccgtgtggaagagcttcttcggctgcctgagaaacatccacgtgaaccacatccccgtgcccgtgaccgaggccctggaggtgcagggccccgtgagcctgaacggctgccccgaccagtag

SEQ ID NO: 86486 - DNA, 9834 bp, Artificial Sequence
  Description of Artificial Sequence: Synthetic coding sequence
atggccgccgccgccagacccagaggcagagccctgggccccgtgctgccccccacccccctgctgctgctggtgctgagagtgctgcccgcctgcggcgccaccgccagagaccccggcgccgccgccggcctgagcctgcaccccacctacttcaacctggccgaggccgccagaatctgggccaccgccacctgcggcgagagaggccccggcgagggcagaccccagcccgagctgtactgcaagctggtgggcggccccaccgcccccggcagcggccacaccatccagggccagttctgcgactactgcaacagcgaggaccccagaaaggcccaccccgtgaccaacgccatcgacggcagcgagagatggtggcagagcccccccctgagcagcggcacccagtacaacagagtgaacctgaccctggacctgggccagctgttccacgtggcctacatcctgatcaagttcgccaacagccccagacccgacctgtgggtgctggagagaagcgtggacttcggcagcacctacagcccctggcagtacttcgcccacagcaaggtggactgcctgaaggagttcggcagagaggccaacatggccgtgaccagagacgacgacgtgctgtgcgtgaccgagtacagcagaatcgtgcccctggagaacggcgaggtggtggtgagcctgatcaacggcagacccggcgccaagaacttcaccttcagccacaccctgagagagttcaccaaggccaccaacatcagactgagattcctgagaaccaacaccctgctgggccacctgatcagcaaggcccagagagaccccaccgtgaccagaagatactactacagcatcaaggacatcagcatcggcggccagtgcgtgtgcaacggccacgccgaggtgtgcaacatcaacaaccccgagaagctgttcagatgcgagtgccagcaccacacctgcggcgagacctgcgacagatgctgcaccggctacaaccagagaagatggagacccgccgcctgggagcagagccacgagtgcgaggcctgcaactgccacggccacgccagcaactgctactacgaccccgacgtggagagacagcaggccagcctgaacacccagggcatctacgccggcggcggcgtgtgcatcaactgccagcacaacaccgccggcgtgaactgcgagcagtgcgccaagggctactacagaccctacggcgtgcccgtggacgcccccgacggctgcatcccctgcagctgcgaccccgagcacgccgacggctgcgagcagggcagcggcagatgccactgcaagcccaacttccacggcgacaactgcgagaagtgcgccatcggctactacaacttccccttctgcctgagaatccccatcttccccgtgagcacccccagcagcgaggaccccgtggccggcgacatcaagggctgcgactgcaacctggagggcgtgctgcccgagatctgcgacgcccacggcagatgcctgtgcagacccggcgtggagggccccagatgcgacacctgcagaagcggcttctacagcttccccatctgccaggcctgctggtgcagcgccctgggcagctaccagatgccctgcagcagcgtgaccggccagtgcgagtgcagacccggcgtgaccggccagagatgcgacagatgcctgagcggcgcctacgacttcccccactgccagggcagcagcagcgcctgcgaccccgccggcaccatcaacagcaacctgggctactgccagtgcaagctgcacgtggagggccccacctgcagcagatgcaagctgctgtactggaacctggacaaggagaaccccagcggctgcagcgagtgcaagtgccacaaggccggcaccgtgagcggcaccggcgagtgcagacagggcgacggcgactgccactgcaagagccacgtgggcggcgacagctgcgacacctgcgaggacggctacttcgccctggagaagagcaactacttcggctgccagggctgccagtgcgacatcggcggcgccctgagcagcatgtgcagcggccccagcggcgtgtgccagtgcagagagcacgtggtgggcaaggtgtgccagagacccgagaacaactactacttccccgacctgcaccacatgaagtacgagatcgaggacggcagcacccccaacggcagagacctgagattcggcttcgaccccctggccttccccgagttcagctggagaggctacgcccagatgaccagcgtgcagaacgacgtgagaatcaccctgaacgtgggcaagagcagcggcagcctgttcagagtgatcctgagatacgtgaaccccggcaccgaggccgtgagcggccacatcaccatctaccccagctggggcgccgcccagagcaaggagatcatcttcctgcccagcaaggagcccgccttcgtgaccgtgcccggcaacggcttcgccgaccccttcagcatcacccccggcatctgggtggcctgcatcaaggccgagggcgtgctgctggactacctggtgctgctgcccagagactactacgaggccagcgtgctgcagctgcccgtgaccgagccctgcgcctacgccggccccccccaggagaactgcctgctgtaccagcacctgcccgtgaccagattcccctgcaccctggcctgcgaggccagacacttcctgctggacggcgagcccagacccgtggccgtgagacagcccacccccgcccaccccgtgatggtggacctgagcggcagagaggtggagctgcacctgagactgagaatcccccaggtgggccactacgtggtggtggtggagtacagcaccgaggccgcccagctgttcgtggtggacgtgaacgtgaagagcagcggcagcgtgctggccggccaggtgaacatctacagctgcaactacagcgtgctgtgcagaagcgccgtgatcgaccacatgagcagaatcgccatgtacgagctgctggccgacgccgacatccagctgaagggccacatggccagattcctgctgcaccaggtgtgcatcatccccatcgaggagttcagcgccgagtacgtgagaccccaggtgcactgcatcgccagctacggcagattcgtgaaccagagcgccacctgcgtgagcctggcccacgagaccccccccaccgccctgatcctggacgtgctgagcggcagacccttcccccacctgccccagcagagcagccccagcgtggacgtgctgcccggcgtgaccctgaaggccccccagaaccaggtgaccctgagaggcagagtgccccacctgggcagatacgtgttcgtgatccacttctaccaggccgcccaccccaccttccccgcccaggtgagcgtggacggcggctggcccagagccggcagcttccacgccagcttctgcccccacgtgctgggctgcagagaccaggtgatcgccgagggccagatcgagttcgacatcagcgagcccgaggtggccgccaccgtgaaggtgcccgagggcaagagcctggtgctggtgagagtgctggtggtgcccgccgagaactacgactaccagatcctgcacaagaagagcatggacaagagcctggagttcatcaccaactgcggcaagaacagcttctacctggacccccagaccgccagcagattctgcaagaacagcgccagaagcctggtggccttctaccacaagggcgccctgccctgcgagtgccaccccaccggcgccaccggcccccactgcagccccgagggcggccagtgcccctgccagcccaacgtgatcggcagacagtgcaccagatgcgccaccggccactacggcttccccagatgcaagccctgcagctgcggcagaagactgtgcgaggagatgaccggccagtgcagatgcccccccagaaccgtgagaccccagtgcgaggtgtgcgagacccacagcttcagcttccaccccatggccggctgcgagggctgcaactgcagcagaagaggcaccatcgaggccgccatgcccgagtgcgacagagacagcggccagtgcagatgcaagcccagaatcaccggcagacagtgcgacagatgcgccagcggcttctacagattccccgagtgcgtgccctgcaactgcaacagagacggcaccgagcccggcgtgtgcgaccccggcaccggcgcctgcctgtgcaaggagaacgtggagggcaccgagtgcaacgtgtgcagagagggcagcttccacctggaccccgccaacctgaagggctgcaccagctgcttctgcttcggcgtgaacaaccagtgccacagcagccacaagagaagaaccaagttcgtggacatgctgggctggcacctggagaccgccgacagagtggacatccccgtgagcttcaaccccggcagcaacagcatggtggccgacctgcaggagctgcccgccaccatccacagcgccagctgggtggcccccaccagctacctgggcgacaaggtgagcagctacggcggctacctgacctaccaggccaagagcttcggcctgcccggcgacatggtgctgctggagaagaagcccgacgtgcagctgaccggccagcacatgagcatcatctacgaggagaccaacacccccagacccgacagactgcaccacggcagagtgcacgtggtggagggcaacttcagacacgccagcagcagagcccccgtgagcagagaggagctgatgaccgtgctgagcagactggccgacgtgagaatccagggcctgtacttcaccgagacccagagactgaccctgagcgaggtgggcctggaggaggccagcgacaccggcagcggcagaatcgccctggccgtggagatctgcgcctgcccccccgcctacgccggcgacagctgccagggctgcagccccggctactacagagaccacaagggcctgtacaccggcagatgcgtgccctgcaactgcaacggccacagcaaccagtgccaggacggcagcggcatctgcgtgaactgccagcacaacaccgccggcgagcactgcgagagatgccaggagggctactacggcaacgccgtgcacggcagctgcagagcctgcccctgcccccacaccaacagcttcgccaccggctgcgtggtgaacggcggcgacgtgagatgcagctgcaaggccggctacaccggcacccagtgcgagagatgcgcccccggctacttcggcaacccccagaagttcggcggcagctgccagccctgcagctgcaacagcaacggccagctgggcagctgccaccccctgaccggcgactgcatcaaccaggagcccaaggacagcagccccgccgaggagtgcgacgactgcgacagctgcgtgatgaccctgctgaacgacctggccaccatgggcgagcagctgagactggtgaagagccagctgcagggcctgagcgccagcgccggcctgctggagcagatgagacacatggagacccaggccaaggacctgagaaaccagctgctgaactacagaagcgccatcagcaaccacggcagcaagatcgagggcctggagagagagctgaccgacctgaaccaggagttcgagaccctgcaggagaaggcccaggtgaacagcagaaaggcccagaccctgaacaacaacgtgaacagagccacccagagcgccaaggagctggacgtgaagatcaagaacgtgatcagaaacgtgcacatgctgaacagaatcagaacctggcagaagacccaccagggcgagaacaacggcctggccaacagcatcagagacagcctgaacgagtacgaggccaagctgagcgacctgagagccagactgcaggaggccgccgcccaggccaagcaggccaacggcctgaaccaggagaacgagagagccctgggcgccatccagagacaggtgaaggagatcaacagcctgcagagcgacttcaccaagtacctgaccaccgccgacagcagcctgctgcagaccaacatcgccctgcagctgatggagaagagccagaaggagtacgagaagctggccgccagcctgaacgaggccagacaggagctgagcgacaaggtgagagagctgagcagaagcgccggcaagaccagcctggtggaggaggccgagaagcacgccagaagcctgcaggagctggccaagcagctggaggagatcaagagaaacgccagcggcgacgagctggtgagatgcgccgtggacgccgccaccgcctacgagaacatcctgaacgccatcaaggccgccgaggacgccgccaacagagccgccagcgccagcgagagcgccctgcagaccgtgatcaaggaggacctgcccagaaaggccaagaccctgagcagcaacagcgacaagctgctgaacgaggccaagatgacccagaagaagctgaagcaggaggtgagccccgccctgaacaacctgcagcagaccctgaacatcgtgaccgtgcagaaggaggtgatcgacaccaacctgaccaccctgagagacggcctgcacggcatccagagaggcgacatcgacgccatgatcagcagcgccaagagcatggtgagaaaggccaacgacatcaccgacgaggtgctggacggcctgaaccccatccagaccgacgtggagagaatcaaggacacctacggcagaacccagaacgaggacttcaagaaggccctgaccgacgccgacaacagcgtgaacaagctgaccaacaagctgcccgacctgtggagaaagatcgagagcatcaaccagcagctgctgcccctgggcaacatcagcgacaacatggacagaatcagagagctgatccagcaggccagagacgccgccagcaaggtggccgtgcccatgagattcaacggcaagagcggcgtggaggtgagactgcccaacgacctggaggacctgaagggctacaccagcctgagcctgttcctgcagagacccaacagcagagagaacggcggcaccgagaacatgttcgtgatgtacctgggcaacaaggacgccagcagagactacatcggcatggccgtggtggacggccagctgacctgcgtgtacaacctgggcgacagagaggccgagctgcaggtggaccagatcctgaccaagagcgagaccaaggaggccgtgatggacagagtgaagttccagagaatctaccagttcgccagactgaactacaccaagggcgccaccagcagcaagcccgagacccccggcgtgtacgacatggacggcagaaacagcaacaccctgctgaacctggaccccgagaacgtggtgttctacgtgggcggctacccccccgacttcaagctgcccagcagactgagcttccccccctacaagggctgcatcgagctggacgacctgaacgagaacgtgctgagcctgtacaacttcaagaagaccttcaacctgaacaccaccgaggtggagccctgcagaagaagaaaggaggagagcgacaagaactacttcgagggcaccggctacgccagagtgcccacccagccccacgcccccatccccaccttcggccagaccatccagaccaccgtggacagaggcctgctgttcttcgccgagaacggcgacagattcatcagcctgaacatcgaggacggcaagctgatggtgagatacaagctgaacagcgagctgcccaaggagagaggcgtgggcgacgccatcaacaacggcagagaccacagcatccagatcaagatcggcaagctgcagaagagaatgtggatcaacgtggacgtgcagaacaccatcatcgacggcgaggtgttcgacttcagcacctactacctgggcggcatccccatcgccatcagagagagattcaacatcagcacccccgccttcagaggctgcatgaagaacctgaagaagaccagcggcgtggtgagactgaacgacaccgtgggcgtgaccaagaagtgcagcgaggactggaagctggtgagaagcgccagcttcagcagaggcggccagctgagcttcaccgacctgggcctgccccccaccgaccacctgcaggccagcttcggcttccagaccttccagcccagcggcatcctgctggaccaccagacctggaccagaaacctgcaggtgaccctggaggacggctacatcgagctgagcaccagcgacagcggcagccccatcttcaagagcccccagacctacatggacggcctgctgcactacgtgagcgtgatcagcgacaacagcggcctgagactgctgatcgacgaccagctgctgagaaacagcaagagactgaagcacatcagcagcagcagacagagcctgagactgggcggcagcaacttcgagggctgcatcagcaacgtgttcgtgcagagactgagcctgagccccgaggtgctggacctgaccagcaacagcctgaagagagacgtgagcctgggcggctgcagcctgaacaagccccccttcctgatgctgctgaagggcagcaccagattcaacaagaccaagaccttcagaatcaaccagctgctgcaggacacccccgtggccagccccagaagcgtgaaggtgtggcaggacgcctgcagccccctgcccaagacccaggccaaccacggcgccctgcagttcggcgacatccccaccagccacctgctgttcaagctgccccaggagctgctgaagcccagaagccagttcgccgtggacatgcagaccaccagcagcagaggcctggtgttccacaccggcaccaagaacagcttcatggccctgtacctgagcaagggcagactggtgttcgccctgggcaccgacggcaagaagctgagaatcaagagcaaggagaagtgcaacgacggcaagtggcacaccgtggtgttcggccacgacggcgagaagggcagactggtggtggacggcctgagagccagagagggcagcctgcccggcaacagcaccatcagcatcagagcccccgtgtacctgggcagcccccccagcggcaagcccaagagcctgcccaccaacagcttcgtgggctgcctgaagaacttccagctggacagcaagcccctgtacacccccagcagcagcttcggcgtgagcagctgcctgggcggccccctggagaagggcatctacttcagcgaggagggcggccacgtggtgctggcccacagcgtgctgctgggccccgagttcaagctggtgttcagcatcagacccagaagcctgaccggcatcctgatccacatcggcagccagcccggcaagcacctgtgcgtgtacctggaggccggcaaggtgaccgccagcatggacagcggcgccggcggcaccagcaccagcgtgacccccaagcagagcctgtgcgacggccagtggcacagcgtggccgtgaccatcaagcagcacatcctgcacctggagctggacaccgacagcagctacaccgccggccagatccccttcccccccgccagcacccaggagcccctgcacctgggcggcgcccccgccaacctgaccaccctgagaatccccgtgtggaagagcttcttcggctgcctgagaaacatccacgtgaaccacatccccgtgcccgtgaccgaggccctggaggtgcagggccccgtgagcctgaacggctgccccgaccagtag

SEQ ID NO: 86487 - DNA, 4560 bp, Artificial Sequence
  Description of Artificial Sequence: Synthetic coding sequence
atggccgccgccgccagacccagaggcagagccctgggccccgtgctgccccccacccccctgctgctgctggtgctgagagtgctgcccgcctgcggcgccaccgccagagaccccggcgccgccgccggcctgagcctgcaccccacctacttcaacctggccgaggccgccagaatctgggccaccgccacctgcggcgagagaggccccggcgagggcagaccccagcccgagctgtactgcaagctggtgggcggccccaccgcccccggcagcggccacaccatccagggccagttctgcgactactgcaacagcgaggaccccagaaaggcccaccccgtgaccaacgccatcgacggcagcgagagatggtggcagagcccccccctgagcagcggcacccagtacaacagagtgaacctgaccctggacctgggccagctgttccacgtggcctacatcctgatcaagttcgccaacagccccagacccgacctgtgggtgctggagagaagcgtggacttcggcagcacctacagcccctggcagtacttcgcccacagcaaggtggactgcctgaaggagttcggcagagaggccaacatggccgtgaccagagacgacgacgtgctgtgcgtgaccgagtacagcagaatcgtgcccctggagaacggcgaggtggtggtgagcctgatcaacggcagacccggcgccaagaacttcaccttcagccacaccctgagagtgtaccagggcaacaagcaccccctgttcctgagaaccaacaccctgctgggccacctgatcagcaaggcccagagagaccccaccgtgaccagaagatactactacagcatcaaggacatcagcatcggcggccagtgcgtgtgcaacggccacgccgaggtgtgcaacatcaacaaccccgagaagctgttcagatgcgagtgccagcaccacacctgcggcgagacctgcgacagatgctgcaccggctacaaccagagaagatggagacccgccgcctgggagcagagccacgagtgcgaggcctgcaactgccacggccacgccagcaactgctactacgaccccgacgtggagagacagcaggccagcctgaacacccagggcatctacgccggcggcggcgtgtgcatcaactgccagcacaacaccgccggcgtgaactgcgagcagtgcgccaagggctactacagaccctacggcgtgcccgtggacgcccccgacggctgcatcccctgcagctgcgaccccgagcacgccgacggctgcgagcagggcagcggcagatgccactgcaagcccaacttccacggcgacaactgcgagaagtgcgccatcggctactacaacttccccttctgcctgagaatccccatcttccccgtgagcacccccagcagcgaggaccccgtggccggcgacatcaagggctgcgactgcaacctggagggcgtgctgcccgagatctgcgacgcccacggcagatgcctgtgcagacccggcgtggagggccccagatgcgacacctgcagaagcggcttctacagcttccccatctgccaggcctgctggtgcagcgccctgggcagctaccagatgccctgcagcagcgtgaccggccagtgcgagtgcagacccggcgtgaccggccagagatgcgacagatgcctgagcggcgcctacgacttcccccactgccagggcagcagcagcgcctgcgaccccgccggcaccatcaacagcaacctgggctactgccagtgcaagctgcacgtggagggccccacctgcagcagatgcaagctgctgtactggaacctggacaaggagaaccccagcggctgcagcgagtgcaagtgccacaaggccggcaccgtgagcggcaccggcgagtgcagacagggcgacggcgactgccactgcaagagccacgtgggcggcgacagctgcgacacctgcgaggacggctacttcgccctggagaagagcaactacttcggctgccagggctgccagtgcgacatcggcggcgccctgagcagcatgtgcagcggccccagcggcgtgtgccagtgcagagagcacgtggtgggcaaggtgtgccagagacccgagaacaactactacttccccgacctgcaccacatgaagtacgagatcgaggacggcagcacccccaacggcagagacctgagattcggcttcgaccccctggccttccccgagttcagctggagaggctacgcccagatgaccagcgtgcagaacgacgtgagaatcaccctgaacgtgggcaagagcagcggcagcctgttcagagtgatcctgagatacgtgaaccccggcaccgaggccgtgagcggccacatcaccatctaccccagctggggcgccgcccagagcaaggagatcatcttcctgcccagcaaggagcccgccttcgtgaccgtgcccggcaacggcttcgccgaccccttcagcatcacccccggcatctgggtggcctgcatcaaggccgagggcgtgctgctggactacctggtgctgctgcccagagactactacgaggccagcgtgctgcagctgcccgtgaccgagccctgcgcctacgccggccccccccaggagaactgcctgctgtaccagcacctgcccgtgaccagattcccctgcaccctggcctgcgaggccagacacttcctgctggacggcgagcccagacccgtggccgtgagacagcccacccccgcccaccccgtgatggtggacctgagcggcagagaggtggagctgcacctgagactgagaatcccccaggtgggccactacgtggtggtggtggagtacagcaccgaggccgcccagctgttcgtggtggacgtgaacgtgaagagcagcggcagcgtgctggccggccaggtgaacatctacagctgcaactacagcgtgctgtgcagaagcgccgtgatcgaccacatgagcagaatcgccatgtacgagctgctggccgacgccgacatccagctgaagggccacatggccagattcctgctgcaccaggtgtgcatcatccccatcgaggagttcagcgccgagtacgtgagaccccaggtgcactgcatcgccagctacggcagattcgtgaaccagagcgccacctgcgtgagcctggcccacgagaccccccccaccgccctgatcctggacgtgctgagcggcagacccttcccccacctgccccagcagagcagccccagcgtggacgtgctgcccggcgtgaccctgaaggccccccagaaccaggtgaccctgagaggcagagtgccccacctgggcagatacgtgttcgtgatccacttctaccaggccgcccaccccaccttccccgcccaggtgagcgtggacggcggctggcccagagccggcagcttccacgccagcttctgcccccacgtgctgggctgcagagaccaggtgatcgccgagggccagatcgagttcgacatcagcgagcccgaggtggccgccaccgtgaaggtgcccgagggcaagagcctggtgctggtgagagtgctggtggtgcccgccgagaactacgactaccagatcctgcacaagaagagcatggacaagagcctggagttcatcaccaactgcggcaagaacagcttctacctggacccccagaccgccagcagattctgcaagaacagcgccagaagcctggtggccttctaccacaagggcgccctgccctgcgagtgccaccccaccggcgccaccggcccccactgcagccccgagggcggcgcccacgccagccccaccagcagcggcggcagcgcccccgccgtgcagcaggcctacggcttccccagatgcaagagaaagagctgcagctgcggcagaagactgtgcgaggagatgaccggccagtgcagatgcccccccagaaccgtgagaccccagtgcgaggtgtgcgagacccacagcttcagcttccaccccatggccggctgcgagggctgcaactgcagcagaagaggcaccatcgaggccgccatgcccgagtgcgacagagacagcggccagtgcagatgcaagcccagaatcaccggcagacagtgcgacagatgcgccagcggcttctacagattccccgagtgcgtgccctgcaactgcaacagagacggcaccgagcccggcgtgtgcgaccccggcaccggcgcctgcctgtgcaaggagaacgtggagggcaccgagtgcaacgtgtgcagagagggcagcttccacctggaccccgccaacctgaagggctgcaccagctgcttctgcttcggcgtgaacaaccagtgccacagcagccacaagagaagaaccaagttcgtggacatgctgggctggcacctggagaccgccgacagagtggacatccccgtgagcttcaaccccggcagcaacagcatggtggccgacctgcaggagctgcccgccaccatccacagcgccagctgggtggccccctag

SEQ ID NO: 86488 - DNA, 1743 bp, Artificial Sequence
  Description of Artificial Sequence: Synthetic coding sequence
atggccgccgccgccagacccagaggcagagccctgggccccgtgctgccccccacccccctgctgctgctggtgctgagagtgctgcccgcctgcggcgccaccgccagagaccccggcgccgccgccggcctgagcctgcaccccacctacttcaacctggccgaggccgccagaatctgggccaccgccacctgcggcgagagaggccccggcgagggcagaccccagcccgagctgtactgcaagctggtgggcggccccaccgcccccggcagcggccacaccatccagggccagttctgcgactactgcaacagcgaggaccccagaaaggcccaccccgtgaccaacgccatcgacggcagcgagagatggtggcagagcccccccctgagcagcggcacccagtacaacagagtgaacctgaccctggacctgggccagctgttccacgtggcctacatcctgatcaagttcgccaacagccccagacccgacctgtgggtgctggagagaagcgtggacttcggcagcacctacagcccctggcagtacttcgcccacagcaaggtggactgcctgaaggagttcggcagagaggccaacatggccgtgaccagagacgacgacgtgctgtgcgtgaccgagtacagcagaatcgtgcccctggagaacggcgaggtggtggtgagcctgatcaacggcagacccggcgccaagaacttcaccttcagccacaccctgagagagttcaccaaggccaccaacatcagactgagattcctgagaaccaacaccctgctgggccacctgatcagcaaggcccagagagaccccaccgtgaccagaagatactactacagcatcaaggacatcagcatcggcggccagtgcgtgtgcaacggccacgccgaggtgtgcaacatcaacaaccccgagaagctgttcagatgcgagtgccagcaccacacctgcggcgagacctgcgacagatgctgcaccggctacaaccagagaagatggagacccgccgcctgggagcagagccacgagtgcgaggcctgcaactgccacggccacgccagcaactgctactacgaccccgacgtggagagacagcaggccagcctgaacacccagggcatctacgccggcggcggcgtgtgcatcaactgccagcacaacaccgccggcgtgaactgcgagcagtgcgccaagggctactacagaccctacggcgtgcccgtggacgcccccgacggctgcatcccctgcagctgcgaccccgagcacgccgacggctgcgagcagggcagcggcagatgccactgcaagcccaacttccacggcgacaactgcgagaagtgcgccatcggctactacaacttccccttctgcctgagaatccccatcttccccgtgagcacccccagcagcgaggaccccgtggccggcgacatcaagggcaactggtgcgactgcaacctggagggcgtgctgcccgagatctgcgacgcccacggcagatgcctgtgcagacccggcgtggagggccccagatgcgacacctgcagaagcggcttctacagcttccccatctgccagggccccagcgagaaggtggccatctacaagcccgagagcagacccagcgccgagaccgagcccgccagcacctggatcctggacttccccgccagcagaaccggcgagatcaacttctactgcctgagcccctag

SEQ ID NO: 86489 - DNA, 5007 bp, Artificial Sequence
  Description of Artificial Sequence: Synthetic coding sequence
atgccccccgccgtgagaagaagcgcctgcagcatgggctggctgtggatcttcggcgccgccctgggccagtgcctgggctacagcagccagcagcagagagtgcccttcctgcagccccccggccagagccagctgcaggccagctacgtggagttcagacccagccagggctgcagccccggctactacagagaccacaagggcctgtacaccggcagatgcgtgccctgcaactgcaacggccacagcaaccagtgccaggacggcagcggcatctgcgtgaactgccagcacaacaccgccggcgagcactgcgagagatgccaggagggctactacggcaacgccgtgcacggcagctgcagagcctgcccctgcccccacaccaacagcttcgccaccggctgcgtggtgaacggcggcgacgtgagatgcagctgcaaggccggctacaccggcacccagtgcgagagatgcgcccccggctacttcggcaacccccagaagttcggcggcagctgccagccctgcagctgcaacagcaacggccagctgggcagctgccaccccctgaccggcgactgcatcaaccaggagcccaaggacagcagccccgccgaggagtgcgacgactgcgacagctgcgtgatgaccctgctgaacgacctggccaccatgggcgagcagctgagactggtgaagagccagctgcagggcctgagcgccagcgccggcctgctggagcagatgagacacatggagacccaggccaaggacctgagaaaccagctgctgaactacagaagcgccatcagcaaccacggcagcaagatcgagggcctggagagagagctgaccgacctgaaccaggagttcgagaccctgcaggagaaggcccaggtgaacagcagaaaggcccagaccctgaacaacaacgtgaacagagccacccagagcgccaaggagctggacgtgaagatcaagaacgtgatcagaaacgtgcacatgctgaacagaatcagaacctggcagaagacccaccagggcgagaacaacggcctggccaacagcatcagagacagcctgaacgagtacgaggccaagctgagcgacctgagagccagactgcaggaggccgccgcccaggccaagcaggccaacggcctgaaccaggagaacgagagagccctgggcgccatccagagacaggtgaaggagatcaacagcctgcagagcgacttcaccaagtacctgaccaccgccgacagcagcctgctgcagaccaacatcgccctgcagctgatggagaagagccagaaggagtacgagaagctggccgccagcctgaacgaggccagacaggagctgagcgacaaggtgagagagctgagcagaagcgccggcaagaccagcctggtggaggaggccgagaagcacgccagaagcctgcaggagctggccaagcagctggaggagatcaagagaaacgccagcggcgacgagctggtgagatgcgccgtggacgccgccaccgcctacgagaacatcctgaacgccatcaaggccgccgaggacgccgccaacagagccgccagcgccagcgagagcgccctgcagaccgtgatcaaggaggacctgcccagaaaggccaagaccctgagcagcaacagcgacaagctgctgaacgaggccaagatgacccagaagaagctgaagcaggaggtgagccccgccctgaacaacctgcagcagaccctgaacatcgtgaccgtgcagaaggaggtgatcgacaccaacctgaccaccctgagagacggcctgcacggcatccagagaggcgacatcgacgccatgatcagcagcgccaagagcatggtgagaaaggccaacgacatcaccgacgaggtgctggacggcctgaaccccatccagaccgacgtggagagaatcaaggacacctacggcagaacccagaacgaggacttcaagaaggccctgaccgacgccgacaacagcgtgaacaagctgaccaacaagctgcccgacctgtggagaaagatcgagagcatcaaccagcagctgctgcccctgggcaacatcagcgacaacatggacagaatcagagagctgatccagcaggccagagacgccgccagcaaggtggccgtgcccatgagattcaacggcaagagcggcgtggaggtgagactgcccaacgacctggaggacctgaagggctacaccagcctgagcctgttcctgcagagacccaacagcagagagaacggcggcaccgagaacatgttcgtgatgtacctgggcaacaaggacgccagcagagactacatcggcatggccgtggtggacggccagctgacctgcgtgtacaacctgggcgacagagaggccgagctgcaggtggaccagatcctgaccaagagcgagaccaaggaggccgtgatggacagagtgaagttccagagaatctaccagttcgccagactgaactacaccaagggcgccaccagcagcaagcccgagacccccggcgtgtacgacatggacggcagaaacagcaacaccctgctgaacctggaccccgagaacgtggtgttctacgtgggcggctacccccccgacttcaagctgcccagcagactgagcttccccccctacaagggctgcatcgagctggacgacctgaacgagaacgtgctgagcctgtacaacttcaagaagaccttcaacctgaacaccaccgaggtggagccctgcagaagaagaaaggaggagagcgacaagaactacttcgagggcaccggctacgccagagtgcccacccagccccacgcccccatccccaccttcggccagaccatccagaccaccgtggacagaggcctgctgttcttcgccgagaacggcgacagattcatcagcctgaacatcgaggacggcaagctgatggtgagatacaagctgaacagcgagctgcccaaggagagaggcgtgggcgacgccatcaacaacggcagagaccacagcatccagatcaagatcggcaagctgcagaagagaatgtggatcaacgtggacgtgcagaacaccatcatcgacggcgaggtgttcgacttcagcacctactacctgggcggcatccccatcgccatcagagagagattcaacatcagcacccccgccttcagaggctgcatgaagaacctgaagaagaccagcggcgtggtgagactgaacgacaccgtgggcgtgaccaagaagtgcagcgaggactggaagctggtgagaagcgccagcttcagcagaggcggccagctgagcttcaccgacctgggcctgccccccaccgaccacctgcaggccagcttcggcttccagaccttccagcccagcggcatcctgctggaccaccagacctggaccagaaacctgcaggtgaccctggaggacggctacatcgagctgagcaccagcgacagcggcagccccatcttcaagagcccccagacctacatggacggcctgctgcactacgtgagcgtgatcagcgacaacagcggcctgagactgctgatcgacgaccagctgctgagaaacagcaagagactgaagcacatcagcagcagcagacagagcctgagactgggcggcagcaacttcgagggctgcatcagcaacgtgttcgtgcagagactgagcctgagccccgaggtgctggacctgaccagcaacagcctgaagagagacgtgagcctgggcggctgcagcctgaacaagccccccttcctgatgctgctgaagggcagcaccagattcaacaagaccaagaccttcagaatcaaccagctgctgcaggacacccccgtggccagccccagaagcgtgaaggtgtggcaggacgcctgcagccccctgcccaagacccaggccaaccacggcgccctgcagttcggcgacatccccaccagccacctgctgttcaagctgccccaggagctgctgaagcccagaagccagttcgccgtggacatgcagaccaccagcagcagaggcctggtgttccacaccggcaccaagaacagcttcatggccctgtacctgagcaagggcagactggtgttcgccctgggcaccgacggcaagaagctgagaatcaagagcaaggagaagtgcaacgacggcaagtggcacaccgtggtgttcggccacgacggcgagaagggcagactggtggtggacggcctgagagccagagagggcagcctgcccggcaacagcaccatcagcatcagagcccccgtgtacctgggcagcccccccagcggcaagcccaagagcctgcccaccaacagcttcgtgggctgcctgaagaacttccagctggacagcaagcccctgtacacccccagcagcagcttcggcgtgagcagctgcctgggcggccccctggagaagggcatctacttcagcgaggagggcggccacgtggtgctggcccacagcgtgctgctgggccccgagttcaagctggtgttcagcatcagacccagaagcctgaccggcatcctgatccacatcggcagccagcccggcaagcacctgtgcgtgtacctggaggccggcaaggtgaccgccagcatggacagcggcgccggcggcaccagcaccagcgtgacccccaagcagagcctgtgcgacggccagtggcacagcgtggccgtgaccatcaagcagcacatcctgcacctggagctggacaccgacagcagctacaccgccggccagatccccttcccccccgccagcacccaggagcccctgcacctgggcggcgcccccgccaacctgaccaccctgagaatccccgtgtggaagagcttcttcggctgcctgagaaacatccacgtgaaccacatccccgtgcccgtgaccgaggccctggaggtgcagggccccgtgagcctgaacggctgccccgaccagtag

SEQ ID NO: 86490 - DNA, 1065 bp, Artificial Sequence
  Description of Artificial Sequence: Synthetic coding sequence
atgcagggcctgctgttcagcaccctgctgctggccggcctggcccagttctgctgcagagtgcagggcaccggccccctggacaccacccccgagggcagacccggcgaggtgagcgacgccccccagagaaagcagttctgccactggccctgcaagtgcccccagcagaagcccagatgcccccccggcgtgagcctggtgagagacggctgcggctgctgcaagatctgcgccaagcagcccggcgagatctgcaacgaggccgacctgtgcgacccccacaagggcctgtactgcgactacagcgtggacagacccagatacgagaccggcgtgtgcgcctacctggtggccgtgggctgcgagttcaaccaggtgcactaccacaacggccaggtgttccagcccaaccccctgttcagctgcctgtgcgtgagcggcgccatcggctgcacccccctgttcatccccaagctggccggcagccactgcagcggcgccaagggcggcaagaagagcgaccagagcaactgcagcctggagcccctgctgcagcagctgagcaccagctacaagaccatgcccgcctacagaaacctgcccctgatctggaagaagaagtgcctggtgcaggccaccaagtggaccccctgcagcagaacctgcggcatgggcatcagcaacagagtgaccaacgagaacagcaactgcgagatgagaaaggagaagagactgtgctacatccagccctgcgacagcaacatcctgaagaccatcaagatccccaagggcaagacctgccagcccaccttccagctgagcaaggccgagaagttcgtgttcagcggctgcagcagcacccagagctacaagcccaccttctgcggcatctgcctggacaagagatgctgcatccccaacaagagcaagatgatcaccatccagttcgactgccccaacgagggcagcttcaagtggaagatgctgtggatcaccagctgcgtgtgccagagaaactgcagagagcccggcgacatcttcagcgagctgaagatcctgtag

SEQ ID NO: 86491 - DNA, 267 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagctag

SEQ ID NO: 86492 - DNA, 363 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgaggtgcagtgcccctgccactgccaccccgccggcgcccccgccccccccagagccgtgccccacagcagcttcagcctgagcccccccctgagcagcccccagtgcctggagagcttcacctgggccagaagcgtgagaaagctggagatcaagagcttccccctgtag

SEQ ID NO: 86493 - DNA, 549 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagacccagcccccagagcaccagaggcttccccctgaacgacagctag

SEQ ID NO: 86494 - DNA, 537 bp, Artificial Sequence
  Description of Artificial Sequence: Synthetic coding sequence
tgaatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggcatggactgccccaccatcagctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtacgccctgagaaagatccagatcaacaacgccgagaacaccatgaagagcctgctgagcgacgtggaggagctggtggagaagcactggaacaagcccagaagaagactggagctgcaggagggcgtgtag

SEQ ID NO: 86495 - DNA, 5451 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtacgccctgagaaagatccagatcaacaacgccgagaacaccatgaagagcctgctgagcgacgtggaggagctggtggagaaggagaaccaggccagcagaaagggccagctggtgcagaaggagagcatggacaccatcaaccacgccagccagctggtggagcaggcccacgacatgagagacaagatccaggagatcaacaacaagatgctgtactacggcgaggagcacgagctgagccccaaggagatcagcgagaagctggtgctggcccagaagatgctggaggagatcagaagcagacagcccttcttcacccagagagagctggtggacgaggaggccgacgaggcctacgagctgctgagccaggccgagagctggcagagactgcacaacgagaccagaaccctgttccccgtggtgctggagcagctggacgactacaacgccaagctgagcgacctgcaggaggccctggaccaggccctgaactacgtgagagacgccgaggacatgaacagagccaccgccgccagacagagagaccacgagaagcagcaggagagagtgagagagcagatggaggtggtgaacatgagcctgagcaccagcgccgacagcctgaccacccccagactgaccctgagcgagctggacgacatcatcaagaacgccagcggcatctacgccgagatcgacggcgccaagagcgagctgcaggtgaagctgagcaacctgagcaacctgagccacgacctggtgcaggaggccatcgaccacgcccaggacctgcagcaggaggccaacgagctgagcagaaagctgcacagcagcgacatgaacggcctggtgcagaaggccctggacgccagcaacgtgtacgagaacatcgtgaactacgtgagcgaggccaacgagaccgccgagttcgccctgaacaccaccgacagaatctacgacgccgtgagcggcatcgacacccagatcatctaccacaaggacgagagcgagaacctgctgaaccaggccagagagctgcaggccaaggccgagagcagcagcgacgaggccgtggccgacaccagcagaagagtgggcggcgccctggccagaaagagcgccctgaagaccagactgagcgacgccgtgaagcagctgcaggccgccgagagaggcgacgcccagcagagactgggccagagcagactgatcaccgaggaggccaacagaaccaccatggaggtgcagcaggccaccgcccccatggccaacaacctgaccaactggagccagaacctgcagcacttcgacagcagcgcctacaacaccgccgtgaacagcgccagagacgccgtgagaaacctgaccgaggtggtgccccagctgctggaccagctgagaaccgtggagcagaagagacccgccagcaacgtgagcgccagcatccagagaatcagagagctgatcgcccagaccagaagcgtggccagcaagatccaggtgagcatgatgttcgacggccagagcgccgtggaggtgcacagcagaaccagcatggacgacctgaaggccttcaccagcctgagcctgtacatgaagccccccgtgaagagacccgagctgaccgagaccgccgaccagttcatcctgtacctgggcagcaagaacgccaagaaggagtacatgggcctggccatcaagaacgacaacctggtgtacgtgtacaacctgggcaccaaggacgtggagatccccctggacagcaagcccgtgagcagctggcccgcctacttcagcatcgtgaagatcgagagagtgggcaagcacggcaaggtgttcctgaccgtgcccagcctgagcagcaccgccgaggagaagttcatcaagaagggcgagttcagcggcgacgacagcctgctggacctggaccccgaggacaccgtgttctacgtgggcggcgtgcccagcaacttcaagctgcccaccagcctgaacctgcccggcttcgtgggctgcctggagctggccaccctgaacaacgacgtgatcagcctgtacaacttcaagcacatctacaacatggaccccagcaccagcgtgccctgcgccagagacaagctggccttcacccagagcagagccgccagctacttcttcgacggcagcggctacgccgtggtgagagacatcaccagaagaggcaagttcggccaggtgaccagattcgacatcgaggtgagaacccccgccgacaacggcctgatcctgctgatggtgaacggcagcatgttcttcagactggagatgagaaacggctacctgcacgtgttctacgacttcggcttcagcggcggccccgtgcacctggaggacaccctgaagaaggcccagatcaacgacgccaagtaccacgagatcagcatcatctaccacaacgacaagaagatgatcctggtggtggacagaagacacgtgaagagcatggacaacgagaagatgaagatccccttcaccgacatctacatcggcggcgccccccccgagatcctgcagagcagagccctgagagcccacctgcccctggacatcaacttcagaggctgcatgaagggcttccagttccagaagaaggacttcaacctgctggagcagaccgagaccctgggcgtgggctacggctgccccgaggacagcctgatcagcagaagagcctacttcaacggccagagcttcatcgccagcatccagaagatcagcttcttcgacggcttcgagggcggcttcaacttcagaaccctgcagcccaacggcctgctgttctactacgccagcggcagcgacgtgttcagcatcagcctggacaacggcaccgtgatcatggacgtgaagggcatcaaggtgcagagcgtggacaagcagtacaacgacggcctgagccacttcgtgatcagcagcgtgagccccaccagatacgagctgatcgtggacaagagcagagtgggcagcaagaaccccaccaagggcaagatcgagcagacccaggccagcgagaagaagttctacttcggcggcagccccatcagcgcccagtacgccaacttcaccggctgcatcagcaacgcctacttcaccagagtggacagagacgtggaggtggaggacttccagagatacaccgagaaggtgcacaccagcctgtacgagtgccccatcgagagcagccccctgttcctgctgcacaagaagggcaagaacctgagcaagcccaaggccagccagaacaagaagggcggcaagagcaaggacgcccccagctgggaccccgtggccctgaagctgcccgagagaaacacccccagaaacagccactgccacctgagcaacagccccagagccatcgagcacgcctaccagtacggcggcaccgccaacagcagacaggagttcgagcacctgaagggcgacttcggcgccaagagccagttcagcatcagactgagaaccagaagcagccacggcatgatcttctacgtgagcgaccaggaggagaacgacttcatgaccctgttcctggcccacggcagactggtgtacatgttcaacgtgggccacaagaagctgaagatcagaagccaggagaagtacaacgacggcctgtggcacgacgtgatcttcatcagagagagaagcagcggcagactggtgatcgacggcctgagagtgctggaggagagcctgccccccaccgaggccacctggaagatcaagggccccatctacctgggcggcgtggcccccggcaaggccgtgaagaacgtgcagatcaacagcatctacagcttcagcggctgcctgagcaacctgcagctgaacggcgccagcatcaccagcgccagccagaccttcagcgtgaccccctgcttcgagggccccatggagaccggcacctacttcagcaccgagggcggctacgtggtgctggacgagagcttcaacatcggcctgaagttcgagatcgccttcgaggtgagacccagaagcagcagcggcaccctggtgcacggccacagcgtgaacggcgagtacctgaacgtgcacatgaagaacggccaggtgatcgtgaaggtgaacaacggcatcagagacttcagcaccagcgtgacccccaagcagagcctgtgcgacggcagatggcacagaatcaccgtgatcagagacagcaacgtggtgcagctggacgtggacagcgaggtgaaccacgtggtgggccccctgaaccccaagcccatcgaccacagagagcccgtgttcgtgggcggcgtgcccgagagcctgctgacccccagactggcccccagcaagcccttcaccggctgcatcagacacttcgtgatcgacggccaccccgtgagcttcagcaaggccgccctggtgagcggcgccgtgagcatcaacagctgccccgccgcctag

SEQ ID NO: 86496 - DNA, 5451 bp, Artificial Sequence; identical to SEQ ID NO: 86495
  Description of Artificial Sequence: Synthetic coding sequence

SEQ ID NO: 86497 - DNA, 390 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgaccaccgacggcgaggaccccggcttcagcgccagcgccctgagcttcatcctgagcagccagggcgccagagaggccagagcccccacctag

SEQ ID NO: 86498 - DNA, 363 bp, Artificial Sequence; identical to SEQ ID NO: 86492
  Description of Artificial Sequence: Synthetic coding sequence

SEQ ID NO: 86499 - DNA, 1125 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggcatggactgccccaccatcagctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtacgccctgagaaagatccagatcaacaacgccgagaacaccatgaagagcctgctgagcgacgtggaggagctggtggagaagcactggaacaagcccagaagaagactggagctgcaggagggcgtgtag

SEQ ID NO: 86500 - DNA, 363 bp, Artificial Sequence; identical to SEQ ID NO: 86492
  Description of Artificial Sequence: Synthetic coding sequence

SEQ ID NO: 86501 - DNA, 324 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggctag

SEQ ID NO: 86502 - DNA, 996 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggcatggactgccccaccatcagctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaccaagctgagcgagagagagaaccagtag

SEQ ID NO: 86503 - DNA, 246 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctag

SEQ ID NO: 86504 - DNA, 5451 bp, Artificial Sequence; identical to SEQ ID NO: 86495
  Description of Artificial Sequence: Synthetic coding sequence

SEQ ID NO: 86505 - DNA, 975 bp, Artificial Sequence
  Description of Artificial Sequence: Synthetic coding sequence
atggccctgagcagcgcctggagaagcgtgctgcccctgtggctgctgtggagcgccgcctgcagcagagccgccagcggcgacgacaacgccttccccttcgacatcgagggcagcagcgccgtgggcagacaggacccccccgagaccagcgagcccagagtggccctgggcagactgccccccgccgccgagaagtgcaacgccggcttcttccacaccctgagcggcgagtgcgtgccctgcgactgcaacggcaacagcaacgagtgcctggacggcagcggctactgcgtgcactgccagagaaacaccaccggcgagcactgcgagaagtgcctggacggctacatcggcgacagcatcagaggcgccccccagttctgccagccctgcccctgccccctgccccacctggccaacttcgccgagagctgctacagaaagaacggcgccgtgagatgcatctgcaacgagaactacgccggccccaactgcgagagatgcgcccccggctactacggcaaccccctgctgatcggcagcacctgcaagaagtgcgactgcagcggcaacagcgaccccaacctgatcttcgaggactgcgacgaggtgaccggccagtgcagaaactgcctgagaaacaccaccggcttcaagtgcgagagatgcgcccccggctactacggcgacgccagaatcgccaagaactgcgccgtgtgcaactgcggcggcggcccctgcgacagcgtgaccggcgagtgcctggaggagggcttcgagccccccaccggctgcgacaagtgcgtgtgggacctgaccgacgccctgagactggccgccctgagcatcgaggagggcaagagcggcgtgctgagcgtgagcagcggcgccgccgcccacagacacgtgaacgagatcaacgccaccatctacctgctgaagaagaccaagcagaagaacaacaagaagtag

SEQ ID NO: 86506 - DNA, 11088 bp, Artificial Sequence
  Description of Artificial Sequence: Synthetic coding sequence
atggccaagagactgtgcgccggcagcgccctgtgcgtgagaggccccagaggccccgcccccctgctgctggtgggcctggccctgctgggcgccgccagagccagagaggaggccggcggcggcttcagcctgcaccccccctacttcaacctggccgagggcgccagaatcgccgccagcgccacctgcggcgaggaggcccccgccagaggcagccccagacccaccgaggacctgtactgcaagctggtgggcggccccgtggccggcggcgaccccaaccagaccatcagaggccagtactgcgacatctgcaccgccgccaacagcaacaaggcccaccccgccagcaacgccatcgacggcaccgagagatggtggcagagcccccccctgagcagaggcctggagtacaacgaggtgaacgtgaccctggacctgggccaggtgttccacgtggcctacgtgctgatcaagttcgccaacagccccagacccgacctgtgggtgctggagagaagcatggacttcggcagaacctaccagccctggcagttcttcgccagcagcaagagagactgcctggagagattcggcccccagaccctggagagaatcaccagagacgacgccgccatctgcaccaccgagtacagcagaatcgtgcccctggagaacggcgagatcgtggtgagcctggtgaacggcagacccggcgccatgaacttcagctacagccccctgctgagagagttcaccaaggccaccaacgtgagactgagattcctgagaaccaacaccctgctgggccacctgatgggcaaggccctgagagaccccaccgtgaccagaagatactactacagcatcaaggacatcagcatcggcggcagatgcgtgtgccacggccacgccgacgcctgcgacgccaaggaccccaccgaccccttcagactgcagtgcacctgccagcacaacacctgcggcggcacctgcgacagatgctgccccggcttcaaccagcagccctggaagcccgccaccgccaacagcgccaacgagtgccagagctgcaactgctacggccacgccaccgactgctactacgaccccgaggtggacagaagaagagccagccagagcctggacggcacctaccagggcggcggcgtgtgcatcgactgccagcaccacaccaccggcgtgaactgcgagagatgcctgcccggcttctacagaagccccaaccaccccctggacagcccccacgtgtgcagaagatgcaactgcgagagcgacttcaccgacggcacctgcgaggacctgaccggcagatgctactgcagacccaacttcagcggcgagagatgcgacgtgtgcgccgagggcttcaccggcttccccagctgctaccccacccccagcagcagcaacgacaccagagagcaggtgctgcccgccggccagatcgtgaactgcgactgcagcgccgccggcacccagggcaacgcctgcagaaaggaccccagagtgggcagatgcctgtgcaagcccaacttccagggcacccactgcgagctgtgcgcccccggcttctacggccccggctgccagccctgccagtgcagcagccccggcgtggccgacgacagatgcgaccccgacaccggccagtgcagatgcagagtgggcttcgagggcgccacctgcgacagatgcgcccccggctacttccacttccccctgtgccagctgtgcggctgcagccccgccggcaccctgcccgagggctgcgacgaggccggcagatgcctgtgccagcccgagttcgccggcccccactgcgacagatgcagacccggctaccacggcttccccaactgccaggcctgcacctgcgaccccagaggcgccctggaccagctgtgcggcgccggcggcctgtgcagatgcagacccggctacaccggcaccgcctgccaggagtgcagccccggcttccacggcttccccagctgcgtgccctgccactgcagcgccgagggcagcctgcacgccgcctgcgaccccagaagcggccagtgcagctgcagacccagagtgaccggcctgagatgcgacacctgcgtgcccggcgcctacaacttcccctactgcgaggccggcagctgccaccccgccggcctggcccccgtggaccccgccctgcccgaggcccaggtgccctgcatgtgcagagcccacgtggagggccccagctgcgacagatgcaagcccggcttctggggcctgagccccagcaaccccgagggctgcaccagatgcagctgcgacctgagaggcaccctgggcggcgtggccgagtgccagcccggcaccggccagtgcttctgcaagccccacgtgtgcggccaggcctgcgccagctgcaaggacggcttcttcggcctggaccaggccgactacttcggctgcagaagctgcagatgcgacatcggcggcgccctgggccagagctgcgagcccagaaccggcgtgtgcagatgcagacccaacacccagggccccacctgcagcgagcccgccagagaccactacctgcccgacctgcaccacctgagactggagctggaggaggccgccacccccgagggccacgccgtgagattcggcttcaaccccctggagttcgagaacttcagctggagaggctacgcccagatggcccccgtgcagcccagaatcgtggccagactgaacctgaccagccccgacctgttctggctggtgttcagatacgtgaacagaggcgccatgagcgtgagcggcagagtgagcgtgagagaggagggcagaagcgccacctgcgccaactgcaccgcccagagccagcccgtggccttcccccccagcaccgagcccgccttcatcaccgtgccccagagaggcttcggcgagcccttcgtgctgaaccccggcacctgggccctgagagtggaggccgagggcgtgctgctggactacgtggtgctgctgcccagcgcctactacgaggccgccctgctgcagctgagagtgaccgaggcctgcacctacagacccagcgcccagcagagcggcgacaactgcctgctgtacacccacctgcccctggacggcttccccagcgccgccggcctggaggccctgtgcagacaggacaacagcctgcccagaccctgccccaccgagcagctgagccccagccacccccccctgatcacctgcaccggcagcgacgtggacgtgcagctgcaggtggccgtgccccagcccggcagatacgccctggtggtggagtacgccaacgaggacgccagacaggaggtgggcgtggccgtgcacaccccccagagagccccccagcagggcctgctgagcctgcacccctgcctgtacagcaccctgtgcagaggcaccgccagagacacccaggaccacctggccgtgttccacctggacagcgaggccagcgtgagactgaccgccgagcaggccagattcttcctgcacggcgtgaccctggtgcccatcgaggagttcagccccgagttcgtggagcccagagtgagctgcatcagcagccacggcgccttcggccccaacagcgccgcctgcctgcccagcagattccccaagcccccccagcccatcatcctgagagactgccaggtgatccccctgccccccggcctgcccctgacccacgcccaggacctgacccccgccatgagccccgccggccccagacccagaccccccaccgccgtggaccccgacgccgagcccaccctgctgagagagccccaggccaccgtggtgttcaccacccacgtgcccaccctgggcagatacgccttcctgctgcacggctaccagcccgcccaccccaccttccccgtggaggtgctgatcaacgccggcagagtgtggcagggccacgccaacgccagcttctgcccccacggctacggctgcagaaccctggtggtgtgcgagggccaggccctgctggacgtgacccacagcgagctgaccgtgaccgtgagagtgcccaagggcagatggctgtggctggactacgtgctggtggtgcccgagaacgtgtacagcttcggctacctgagagaggagcccctggacaagagctacgacttcatcagccactgcgccgcccagggctaccacatcagccccagcagcagcagcctgttctgcagaaacgccgccgccagcctgagcctgttctacaacaacggcgccagaccctgcggctgccacgaggtgggcgccaccggccccacctgcgagcccttcggcggccagtgcccctgccacgcccacgtgatcggcagagactgcagcagatgcgccaccggctactggggcttccccaactgcagaccctgcgactgcggcgccagactgtgcgacgagctgaccggccagtgcatctgcccccccagaaccatcccccccgactgcctgctgtgccagccccagaccttcggctgccaccccctggtgggctgcgaggagtgcaactgcagcggccccggcatccaggagctgaccgaccccacctgcgacaccgacagcggccagtgcaagtgcagacccaacgtgaccggcagaagatgcgacacctgcagccccggcttccacggctaccccagatgcagaccctgcgactgccacgaggccggcaccgcccccggcgtgtgcgaccccctgaccggccagtgctactgcaaggagaacgtgcagggccccaagtgcgaccagtgcagcctgggcaccttcagcctggacgccgccaaccccaagggctgcaccagatgcttctgcttcggcgccaccgagagatgcagaagcagcagctacaccagacaggagttcgtggacatggagggctgggtgctgctgagcaccgacagacaggtggtgccccacgagagacagcccggcaccgagatgctgagagccgacctgagacacgtgcccgaggccgtgcccgaggccttccccgagctgtactggcaggccccccccagctacctgggcgacagagtgagcagctacggcggcaccctgagatacgagctgcacagcgagacccagagaggcgacgtgttcgtgcccatggagagcagacccgacgtggtgctgcagggcaaccagatgagcatcaccttcctggagcccgcctaccccacccccggccacgtgcacagaggccagctgcagctggtggagggcaacttcagacacaccgagaccagaaacaccgtgagcagagaggagctgatgatggtgctggccagcctggagcagctgcagatcagagccctgttcagccagatcagcagcgccgtgttcctgagaagagtggccctggaggtggccagccccgccggccagggcgccctggccagcaacgtggagctgtgcctgtgccccgccagctacagaggcgacagctgccaggagtgcgcccccggcttctacagagacgtgaagggcctgttcctgggcagatgcgtgccctgccagtgccacggccacagcgacagatgcctgcccggcagcggcgtgtgcgtggactgccagcacaacaccgagggcgcccactgcgagagatgccaggccggcttcgtgagcagcagagacgaccccagcgccccctgcgtgagctgcccctgccccctgagcgtgcccagcaacaacttcgccgagggctgcgtgctgagaggcggcagaacccagtgcctgtgcaagcccggctacgccggcgccagctgcgagagatgcgcccccggcttcttcggcaaccccctggtgctgggcagcagctgccagccctgcgactgcagcggcaacggcgaccccaacctgctgttcagcgactgcgaccccctgaccggcgcctgcagaggctgcctgagacacaccaccggccccagatgcgagatctgcgcccccggcttctacggcaacgccctgctgcccggcaactgcaccagatgcgactgcaccccctgcggcaccgaggcctgcgacccccacagcggccactgcctgtgcaaggccggcgtgaccggcagaagatgcgacagatgccaggagggccacttcggcttcgacggctgcggcggctgcagaccctgcgcctgcggccccgccgccgagggcagcgagtgccacccccagagcggccagtgccactgcagacccggcaccatgggcccccagtgcagagagtgcgcccccggctactggggcctgcccgagcagggctgcagaagatgccagtgccccggcggcagatgcgacccccacaccggcagatgcaactgcccccccggcctgagcggcgagagatgcgacacctgcagccagcagcaccaggtgcccgtgcccggcggccccgtgggccacagcatccactgcgaggtgtgcgaccactgcgtggtgctgctgctggacgacctggagagagccggcgccctgctgcccgccatccacgagcagctgagaggcatcaacgccagcagcatggcctgggccagactgcacagactgaacgccagcatcgccgacctgcagagccagctgagaagccccctgggccccagacacgagaccgcccagcagctggaggtgctggagcagcagagcaccagcctgggccaggacgccagaagactgggcggccaggccgtgggcaccagagaccaggccagccagctgctggccggcaccgaggccaccctgggccacgccaagaccctgctggccgccatcagagccgtggacagaaccctgagcgagctgatgagccagaccggccacctgggcctggccaacgccagcgcccccagcggcgagcagctgctgagaaccctggccgaggtggagagactgctgtgggagatgagagccagagacctgggcgccccccaggccgccgccgaggccgagctggccgccgcccagagactgctggccagagtgcaggagcagctgagcagcctgtgggaggagaaccaggccctggccacccagaccagagacagactggcccagcacgaggccggcctgatggacctgagagaggccctgaacagagccgtggacgccaccagagaggcccaggagctgaacagcagaaaccaggagagactggaggaggccctgcagagaaagcaggagctgagcagagacaacgccaccctgcaggccaccctgcacgccgccagagacaccctggccagcgtgttcagactgctgcacagcctggaccaggccaaggaggagctggagagactggccgccagcctggacggcgccagaacccccctgctgcagagaatgcagaccttcagccccgccggcagcaagctgagactggtggaggccgccgaggcccacgcccagcagctgggccagctggccctgaacctgagcagcatcatcctggacgtgaaccaggacagactgacccagagagccatcgaggccagcaacgcctacagcagaatcctgcaggccgtgcaggccgccgaggacgccgccggccaggccctgcagcaggccgaccacacctgggccaccgtggtgagacagggcctggtggacagagcccagcagctgctggccaacagcaccgccctggaggaggccatgctgcaggagcagcagagactgggcctggtgtgggccgccctgcagggcgccagaacccagctgagagacgtgagagccaagaaggaccagctggaggcccacatccaggccgcccaggccatgctggccatggacaccgacgagaccagcaagaagatcgcccacgccaaggccgtggccgccgaggcccaggacaccgccaccagagtgcagagccagctgcaggccatgcaggagaacgtggagagatggcagggccagtacgagggcctgagaggccaggacctgggccaggccgtgctggacgccggccacagcgtgagcaccctggagaagaccctgccccagctgctggccaagctgagcatcctggagaacagaggcgtgcacaacgccagcctggccctgagcgccagcatcggcagagtgagagagctgatcgcccaggccagaggcgccgccagcaaggtgaaggtgcccatgaagttcaacggcagaagcggcgtgcagctgagaacccccagagacctggccgacctggccgcctacaccgccctgaagttctacctgcagggccccgagcccgagcccggccagggcaccgaggacagattcgtgatgtacatgggcagcagacaggccaccggcgactacatgggcgtgagcctgagagacaagaaggtgcactgggtgtaccagctgggcgaggccggccccgccgtgctgagcatcgacgaggacatcggcgagcagttcgccgccgtgagcctggacagaaccctgcagttcggccacatgagcgtgaccgtggagagacagatgatccaggagaccaagggcgacaccgtggcccccggcgccgagggcctgctgaacctgagacccgacgacttcgtgttctacgtgggcggctaccccagcaccttcacccccccccccctgctgagattccccggctacagaggctgcatcgagatggacaccctgaacgaggaggtggtgagcctgtacaacttcgagagaaccttccagctggacaccgccgtggacagaccctgcgccagaagcaagagcaccggcgacccctggctgaccgacggcagctacctggacggcaccggcttcgccagaatcagcttcgacagccagatcagcaccaccaagagattcgagcaggagctgagactggtgagctacagcggcgtgctgttcttcctgaagcagcagagccagttcctgtgcctggccgtgcaggagggcagcctggtgctgctgtacgacttcggcgccggcctgaagaaggccgtgcccctgcagccccccccccccctgaccagcgccagcaaggccatccaggtgttcctgctgggcggcagcagaaagagagtgctggtgagagtggagagagccaccgtgtacagcgtggagcaggacaacgacctggagctggccgacgcctactacctgggcggcgtgccccccgaccagctgccccccagcctgagaagactgttccccaccggcggcagcgtgagaggctgcgtgaagggcatcaaggccctgggcaagtacgtggacctgaagagactgaacaccaccggcgtgagcgccggctgcaccgccgacctgctggtgggcagagccatgaccttccacggccacggcttcctgagactggccctgagcaacgtggcccccctgaccggcaacgtgtacagcggcttcggcttccacagcgcccaggacagcgccctgctgtactacagagccagccccgacggcctgtgccaggtgagcctgcagcagggcagagtgagcctgcagctgctgagaaccgaggtgaagacccaggccggcttcgccgacggcgccccccactacgtggccttctacagcaacgccaccggcgtgtggctgtacgtggacgaccagctgcagcagatgaagccccacagaggccccccccccgagctgcagccccagcccgagggcccccccagactgctgctgggcggcctgcccgagagcggcaccatctacaacttcagcggctgcatcagcaacgtgttcgtgcagagactgctgggcccccagagagtgttcgacctgcagcagaacctgggcagcgtgaacgtgagcaccggctgcgcccccgccctgcaggcccagacccccggcctgggccccagaggcctgcaggccaccgccagaaaggccagcagaagaagcagacagcccgccagacaccccgcctgcatgctgcccccccacctgagaaccaccagagacagctaccagttcggcggcagcctgagcagccacctggagttcgtgggcatcctggccagacacagaaactggcccagcctgagcatgcacgtgctgcccagaagcagcagaggcctgctgctgttcaccgccagactgagacccggcagccccagcctggccctgttcctgagcaacggccacttcgtggcccagatggagggcctgggcaccagactgagagcccagagcagacagagaagcagacccggcagatggcacaaggtgagcgtgagatgggagaagaacagaatcctgctggtgaccgacggcgccagagcctggagccaggagggcccccacagacagcaccagggcgccgagcacccccagccccacaccctgttcgtgggcggcctgcccgccagcagccacagcagcaagctgcccgtgaccgtgggcttcagcggctgcgtgaagagactgagactgcacggcagacccctgggcgcccccaccagaatggccggcgtgaccccctgcatcctgggccccctggaggccggcctgttcttccccggcagcggcggcgtgatcaccctggacctgcccggcgccaccctgcccgacgtgggcctggagctggaggtgagacccctggccgtgaccggcctgatcttccacctgggccaggccagaacccccccctacctgcagctgcaggtgaccgagaagcaggtgctgctgagagccgacgacggcgccggcgagttcagcaccagcgtgaccagacccagcgtgctgtgcgacggccagtggcacagactggccgtgatgaagagcggcaacgtgctgagactggaggtggacgcccagagcaaccacaccgtgggccccctgctggccgccgccgccggcgcccccgcccccctgtacctgggcggcctgcccgagcccatggccgtgcagccctggccccccgcctactgcggctgcatgagaagactggccgtgaacagaagccccgtggccatgaccagaagcgtggaggtgcacggcgccgtgggcgccagcggctgccccgccgcctag

SEQ ID NO: 86507 - DNA, 1503 bp, Artificial Sequence
  Description of Artificial Sequence: Synthetic coding sequence
atggccaagagactgtgcgccggcagcgccctgtgcgtgagaggccccagaggccccgcccccctgctgctggtgggcctggccctgctgggcgccgccagagccagagaggaggccggcggcggcttcagcctgcaccccccctacttcaacctggccgagggcgccagaatcgccgccagcgccacctgcggcgaggaggcccccgccagaggcagccccagacccaccgaggacctgtactgcaagctggtgggcggccccgtggccggcggcgaccccaaccagaccatcagaggccagtactgcgacatctgcaccgccgccaacagcaacaaggcccaccccgccagcaacgccatcgacggcaccgagagatggtggcagagcccccccctgagcagaggcctggagtacaacgaggtgaacgtgaccctggacctgggccaggtgttccacgtggcctacgtgctgatcaagttcgccaacagccccagacccgacctgtgggtgctggagagaagcatggacttcggcagaacctaccagccctggcagttcttcgccagcagcaagagagactgcctggagagattcggcccccagaccctggagagaatcaccagagacgacgccgccatctgcaccaccgagtacagcagaatcgtgcccctggagaacggcgagatcgtggtgagcctggtgaacggcagacccggcgccatgaacttcagctacagccccctgctgagagagttcaccaaggccaccaacgtgagactgagattcctgagaaccaacaccctgctgggccacctgatgggcaaggccctgagagaccccaccgtgaccagaagatactactacagcatcaaggacatcagcatcggcggcagatgcgtgtgccacggccacgccgacgcctgcgacgccaaggaccccaccgaccccttcagactgcagtgcacctgccagcacaacacctgcggcggcacctgcgacagatgctgccccggcttcaaccagcagccctggaagcccgccaccgccaacagcgccaacgagtgccagagctgcaactgctacggccacgccaccgactgctactacgaccccgaggtggacagaagaagagccagccagagcctggacggcacctaccagggcggcggcgtgtgcatcgactgccagcaccacaccaccggcgtgaactgcgagagatgcctgcccggcttctacagaagccccaaccaccccctggacagcccccacgtgtgcagaagatgcaactgcgagagcgacttcaccgacggcacctgcgaggacctgaccggcagatgctactgcagacccaacttcagcggcgagagatgcgacgtgtgcgccgagggcttcaccggcttccccagctgctaccccacccccagcagcagcaacgacaccagagagcaggtgctgcccgccggccagatcgtgaccaacaccaagatcagctgggtgtag

SEQ ID NO: 86508 - DNA, 1587 bp, Artificial Sequence
  Description of Artificial Sequence: Synthetic coding sequence
atggccaagagactgtgcgccggcagcgccctgtgcgtgagaggccccagaggccccgcccccctgctgctggtgggcctggccctgctgggcgccgccagagccagagaggaggccggcggcggcttcagcctgcaccccccctacttcaacctggccgagggcgccagaatcgccgccagcgccacctgcggcgaggaggcccccgccagaggcagccccagacccaccgaggacctgtactgcaagctggtgggcggccccgtggccggcggcgaccccaaccagaccatcagaggccagtactgcgacatctgcaccgccgccaacagcaacaaggcccaccccgccagcaacgccatcgacggcaccgagagatggtggcagagcccccccctgagcagaggcctggagtacaacgaggtgaacgtgaccctggacctgggccaggtgttccacgtggcctacgtgctgatcaagttcgccaacagccccagacccgacctgtgggtgctggagagaagcatggacttcggcagaacctaccagccctggcagttcttcgccagcagcaagagagactgcctggagagattcggcccccagaccctggagagaatcaccagagacgacgccgccatctgcaccaccgagtacagcagaatcgtgcccctggagaacggcgagatcgtggtgagcctggtgaacggcagacccggcgccatgaacttcagctacagccccctgctgagagagttcaccaaggccaccaacgtgagactgagattcctgagaaccaacaccctgctgggccacctgatgggcaaggccctgagagaccccaccgtgaccagaagatactactacagcatcaaggacatcagcatcggcggcagatgcgtgtgccacggccacgccgacgcctgcgacgccaaggaccccaccgaccccttcagactgcagtgcacctgccagcacaacacctgcggcggcacctgcgacagatgctgccccggcttcaaccagcagccctggaagcccgccaccgccaacagcgccaacgagtgccagagctgcaactgctacggccacgccaccgactgctactacgaccccgaggtggacagaagaagagccagccagagcctggacggcacctaccagggcggcggcgtgtgcatcgactgccagcaccacaccaccggcgtgaactgcgagagatgcctgcccggcttctacagaagccccaaccaccccctggacagcccccacgtgtgcagaagatgcaactgcgagagcgacttcaccgacggcacctgcgaggacctgaccggcagatgctactgcagacccaacttcagcggcgagagatgcgacgtgtgcgccgagggcttcaccggcttccccagctgctaccccacccccagcagcagcaacgacaccagagagcaggtgctgcccgccggccagatcgtgaacggcgtgagcctgtgcagacccggctggagcgccgtggccagaagcagactgaccagcaccagcgccagctgggtgcaggccatcctgctgccccagagccccgagtag

SEQ ID NO: 86509 - DNA, 2187 bp, Artificial Sequence
  Description of Artificial Sequence: Synthetic coding sequence
atgtgggtgaccaagctgctgcccgccctgctgctgcagcacgtgctgctgcacctgctgctgctgcccatcgccatcccctacgccgagggccagagaaagagaagaaacaccatccacgagttcaagaagagcgccaagaccaccctgatcaagatcgaccccgccctgaagatcaagaccaagaaggtgaacaccgccgaccagtgcgccaacagatgcaccagaaacaagggcctgcccttcacctgcaaggccttcgtgttcgacaaggccagaaagcagtgcctgtggttccccttcaacagcatgagcagcggcgtgaagaaggagttcggccacgagttcgacctgtacgagaacaaggactacatcagaaactgcatcatcggcaagggcagaagctacaagggcaccgtgagcatcaccaagagcggcatcaagtgccagccctggagcagcatgatcccccacgagcacagcttcctgcccagcagctacagaggcaaggacctgcaggagaactactgcagaaaccccagaggcgaggagggcggcccctggtgcttcaccagcaaccccgaggtgagatacgaggtgtgcgacatcccccagtgcagcgaggtggagtgcatgacctgcaacggcgagagctacagaggcctgatggaccacaccgagagcggcaagatctgccagagatgggaccaccagaccccccacagacacaagttcctgcccgagagataccccgacaagggcttcgacgacaactactgcagaaaccccgacggccagcccagaccctggtgctacaccctggacccccacaccagatgggagtactgcgccatcaagacctgcgccgacaacaccatgaacgacaccgacgtgcccctggagaccaccgagtgcatccagggccagggcgagggctacagaggcaccgtgaacaccatctggaacggcatcccctgccagagatgggacagccagtacccccacgagcacgacatgacccccgagaacttcaagtgcaaggacctgagagagaactactgcagaaaccccgacggcagcgagagcccctggtgcttcaccaccgaccccaacatcagagtgggctactgcagccagatccccaactgcgacatgagccacggccaggactgctacagaggcaacggcaagaactacatgggcaacctgagccagaccagaagcggcctgacctgcagcatgtgggacaagaacatggaggacctgcacagacacatcttctgggagcccgacgccagcaagctgaacgagaactactgcagaaaccccgacgacgacgcccacggcccctggtgctacaccggcaaccccctgatcccctgggactactgccccatcagcagatgcgagggcgacaccacccccaccatcgtgaacctggaccaccccgtgatcagctgcgccaagaccaagcagctgagagtggtgaacggcatccccaccagaaccaacatcggctggatggtgagcctgagatacagaaacaagcacatctgcggcggcagcctgatcaaggagagctgggtgctgaccgccagacagtgcttccccagcagagacctgaaggactacgaggcctggctgggcatccacgacgtgcacggcagaggcgacgagaagtgcaagcaggtgctgaacgtgagccagctggtgtacggccccgagggcagcgacctggtgctgatgaagctggccagacccgccgtgctggacgacttcgtgagcaccatcgacctgcccaactacggctgcaccatccccgagaagaccagctgcagcgtgtacggctggggctacaccggcctgatcaactacgacggcctgctgagagtggcccacctgtacatcatgggcaacgagaagtgcagccagcaccacagaggcaaggtgaccctgaacgagagcgagatctgcgccggcgccgagaagatcggcagcggcccctgcgagggcgactacggcggccccctggtgtgcgagcagcacaagatgagaatggtgctgggcgtgatcgtgcccggcagaggctgcgccatccccaacagacccggcatcttcgtgagagtggcctactacgccaagtggatccacaagatcatcctgacctacaaggtgccccagagctag

SEQ ID NO: 86510 - DNA, 276 bp, Artificial Sequence
  Description of Artificial Sequence: Synthetic coding sequence
atgggcctgctgcagctgctggccttcagcttcctggccctgtgcagagccagagtgagagcccaggagcccgagttcagctacggctgcgccgagggcagctgctaccccgccaccggcgacctgctgatcggcagagcccagaagctgagcgtgaccagcacctgcggcctgcacaagcccgagccctactgcatcgtgagccacctgcaggaggacaagaagtgcttcatctgcaacagccaggacccctaccacgagaccctgaacccctag

SEQ ID NO: 86511 - DNA, 2553 bp, Artificial Sequence
  Description of Artificial Sequence: Synthetic coding sequence
atgggcctgctgcagctgctggccttcagcttcctggccctgtgcagagccagagtgagagcccaggagcccgagttcagctacggctgcgccgagggcagctgctaccccgccaccggcgacctgctgatcggcagagcccagaagctgagcgtgaccagcacctgcggcctgcacaagcccgagccctactgcatcgtgagccacctgcaggaggacaagaagtgcttcatctgcaacagccaggacccctaccacgagaccctgaaccccgacagccacctgatcgagaacgtggtgaccaccttcgcccccaacagactgaagatctggtggcagagcgagaacggcgtggagaacgtgaccatccagctggacctggaggccgagttccacttcacccacctgatcatgaccttcaagaccttcagacccgccgccatgctgatcgagagaagcagcgacttcggcaagacctggggcgtgtacagatacttcgcctacgactgcgaggccagcttccccggcatcagcaccggccccatgaagaaggtggacgacatcatctgcgacagcagatacagcgacatcgagcccagcaccgagggcgaggtgatcttcagagccctggaccccgccttcaagatcgaggacccctacagccccagaatccagaacctgctgaagatcaccaacctgagaatcaagttcgtgaagctgcacaccctgggcgacaacctgctggacagcagaatggagatcagagagaagtactactacgccgtgtacgacatggtggtgagaggcaactgcttctgctacggccacgccagcgagtgcgcccccgtggacggcttcaacgaggaggtggagggcatggtgcacggccactgcatgtgcagacacaacaccaagggcctgaactgcgagctgtgcatggacttctaccacgacctgccctggagacccgccgagggcagaaacagcaacgcctgcaagaagtgcaactgcaacgagcacagcatcagctgccacttcgacatggccgtgtacctggccaccggcaacgtgagcggcggcgtgtgcgacgactgccagcacaacaccatgggcagaaactgcgagcagtgcaagcccttctactaccagcaccccgagagagacatcagagaccccaacttctgcgagagatgcacctgcgaccccgccggcagccagaacgagggcatctgcgacagctacaccgacttcagcaccggcctgatcgccggccagtgcagatgcaagctgaacgtggagggcgagcactgcgacgtgtgcaaggagggcttctacgacctgagcagcgaggaccccttcggctgcaagagctgcgcctgcaaccccctgggcaccatccccggcggcaacccctgcgacagcgagaccggccactgctactgcaagagactggtgaccggccagcactgcgaccagtgcctgcccgagcactggggcctgagcaacgacctggacggctgcagaccctgcgactgcgacctgggcggcgccctgaacaacagctgcttcgccgagagcggccagtgcagctgcagaccccacatgatcggcagacagtgcaacgaggtggagcccggctactacttcgccaccctggaccactacctgtacgaggccgaggaggccaacctgggccccggcgtgagcatcgtggagagacagtacatccaggacagaatccccagctggaccggcgccggcttcgtgagagtgcccgagggcgcctacctggagttcttcatcgacaacatcccctacagcatggagtacgacatcctgatcagatacgagccccagctgcccgaccactgggagaaggccgtgatcaccgtgcagagacccggcagaatccccaccagcagcagatgcggcaacaccatccccgacgacgacaaccaggtggtgagcctgagccccggcagcagatacgtggtgctgcccagacccgtgtgcttcgagaagggcaccaactacaccgtgagactggagctgccccagtacaccagcagcgacagcgacgtggagagcccctacaccctgatcgacagcctggtgctgatgccctactgcaagagcctggacatcttcaccgtgggcggcagcggcgacggcgtggtgaccaacagcgcctgggagaccttccagagatacagatgcctggagaacagcagaagcgtggtgaagacccccatgaccgacgtgtgcagaaacatcatcttcagcatcagcgccctgctgcaccagaccggcctggcctgcgagtgcgacccccagggcagcctgagcagcgtgtgcgaccccaacggcggccagtgccagtgcagacccaacgtggtgggcagaacctgcaacagatgcgcccccggcaccttcggcttcggccccagcggctgcaagagaagattcctgaagagcatcgtgatgcacagcttcagactgacccagcccctgtggcagggcagcatcgccgccgagcccatgctgcccagctag

SEQ ID NO: 86512 - DNA, 5397 bp, Artificial Sequence
  Description of Artificial Sequence: Synthetic coding sequence
atggagctgaccagcagagagagaggcagaggccagcccctgccctgggagctgagactgggcctgctgctgagcgtgctggccgccaccctggcccaggcccccgcccccgacgtgcccggctgcagcagaggcagctgctaccccgccaccggcgacctgctggtgggcagagccgacagactgaccgccagcagcacctgcggcctgaacggcccccagccctactgcatcgtgagccacctgcaggacgagaagaagtgcttcctgtgcgacagcagaagacccttcagcgccagagacaacccccacagccacagaatccagaacgtggtgaccagcttcgccccccagagaagagccgcctggtggcagagcgagaacggcatccccgccgtgaccatccagctggacctggaggccgagttccacttcacccacctgatcatgaccttcaagaccttcagacccgccgccatgctggtggagagaagcgccgacttcggcagaacctggcacgtgtacagatacttcagctacgactgcggcgccgacttccccggcgtgcccctggccccccccagacactgggacgacgtggtgtgcgagagcagatacagcgagatcgagcccagcaccgagggcgaggtgatctacagagtgctggaccccgccatccccatccccgacccctacagcagcagaatccagaacctgctgaagatcaccaacctgagagtgaacctgaccagactgcacaccctgggcgacaacctgctggaccccagaagagagatcagagagaagtactactacgccctgtacgagctggtggtgagaggcaactgcttctgctacggccacgccagcgagtgcgcccccgcccccggcgcccccgcccacgccgagggcatggtgcacggcgcctgcatctgcaagcacaacaccagaggcctgaactgcgagcagtgccaggacttctacagagacctgccctggagacccgccgaggacggccacagccacgcctgcagaaagtgcgagtgccacggccacacccacagctgccacttcgacatggccgtgtacctggccagcggcaacgtgagcggcggcgtgtgcgacggctgccagcacaacaccgccggcagacactgcgagctgtgcagacccttcttctacagagaccccaccaaggacctgagagaccccgccgtgtgcagaagctgcgactgcgaccccatgggcagccaggacggcggcagatgcgacagccacgacgaccccgccctgggcctggtgagcggccagtgcagatgcaaggagcacgtggtgggcaccagatgccagcagtgcagagacggcttcttcggcctgagcatcagcgacagactgggctgcagaagatgccagtgcaacgccagaggcaccgtgcccggcagcaccccctgcgaccccaacagcggcagctgctactgcaagagactggtgaccggcagaggctgcgacagatgcctgcccggccactggggcctgagccacgacctgctgggctgcagaccctgcgactgcgacgtgggcggcgccctggacccccagtgcgacgagggcaccggccagtgccactgcagacagcacatggtgggcagaagatgcgagcaggtgcagcccggctacttcagacccttcctggaccacctgatctgggaggccgaggacaccagaggccaggtgctggacgtggtggagagactggtgacccccggcgagacccccagctggaccggcagcggcttcgtgagactgcaggagggccagaccctggagttcctggtggccagcgtgcccaaggccatggactacgacctgctgctgagactggagccccaggtgcccgagcagtgggccgagctggagctgatcgtgcagagacccggccccgtgcccgcccacagcctgtgcggccacctggtgcccaaggacgacagaatccagggcaccctgcagccccacgccagatacctgatcttccccaaccccgtgtgcctggagcccggcatcagctacaagctgcacctgaagctggtgagaaccggcggcagcgcccagcccgagaccccctacagcggccccggcctgctgatcgacagcctggtgctgctgcccagagtgctggtgctggagatgttcagcggcggcgacgccgccgccctggagagacaggccaccttcgagagataccagtgccacgaggagggcctggtgcccagcaagaccagccccagcgaggcctgcgcccccctgctgatcagcctgagcaccctgatctacaacggcgccctgccctgccagtgcaacccccagggcagcctgagcagcgagtgcaacccccacggcggccagtgcctgtgcaagcccggcgtggtgggcagaagatgcgacctgtgcgcccccggctactacggcttcggccccaccggctgccaggcctgccagtgcagccacgagggcgccctgagcagcctgtgcgagaagaccagcggccagtgcctgtgcagaaccggcgccttcggcctgagatgcgacagatgccagagaggccagtggggcttccccagctgcagaccctgcgtgtgcaacggccacgccgacgagtgcaacacccacaccggcgcctgcctgggctgcagagaccacaccggcggcgagcactgcgagagatgcatcgccggcttccacggcgaccccagactgccctacggcggccagtgcagaccctgcccctgccccgagggccccggcagccagagacacttcgccaccagctgccaccaggacgagtacagccagcagatcgtgtgccactgcagagccggctacaccggcctgagatgcgaggcctgcgcccccggccacttcggcgaccccagcagacccggcggcagatgccagctgtgcgagtgcagcggcaacatcgaccccatggaccccgacgcctgcgacccccacaccggccagtgcctgagatgcctgcaccacaccgagggcccccactgcgcccactgcaagcccggcttccacggccaggccgccagacagagctgccacagatgcacctgcaacctgctgggcaccaacccccagcagtgccccagccccgaccagtgccactgcgaccccagcagcggccagtgcccctgcctgcccaacgtgcagggccccagctgcgacagatgcgcccccaacttctggaacctgaccagcggccacggctgccagccctgcgcctgccaccccagcagagccagaggccccacctgcaacgagttcaccggccagtgccactgcagagccggcttcggcggcagaacctgcagcgagtgccaggagctgcactggggcgaccccggcctgcagtgccacgcctgcgactgcgacagcagaggcatcgacaccccccagtgccacagattcaccggccactgcagctgcagacccggcgtgagcggcgtgagatgcgaccagtgcgccagaggcttcagcggcatcttccccgcctgccacccctgccacgcctgcttcggcgactgggacagagtggtgcaggacctggccgccagaacccagagactggagcagagagcccaggagctgcagcagaccggcgtgctgggcgccttcgagagcagcttctggcacatgcaggagaagctgggcatcgtgcagggcatcgtgggcgccagaaacaccagcgccgccagcaccgcccagctggtggaggccaccgaggagctgagaagagagatcggcgaggccaccgagcacctgacccagctggaggccgacctgaccgacgtgcaggacgagaacttcaacgccaaccacgccctgagcggcctggagagagacagactggccctgaacctgaccctgagacagctggaccagcacctggacctgctgaagcacagcaacttcctgggcgcctacgacagcatcagacacgcccacagccagagcgccgaggccgagagaagagccaacaccagcgccctggccgtgcccagccccgtgagcaacagcgccagcgccagacacagaaccgaggccctgatggacgcccagaaggaggacttcaacagcaagcacatggccaaccagagagccctgggcaagctgagcgcccacacccacaccctgagcctgaccgacatcaacgagctggtgtgcggcgcccccggcgacgccccctgcgccaccagcccctgcggcggcgccggctgcagagacgaggacggccagcccagatgcggcggcctgagctgcaacggcgccgccgccaccgccgacctggccctgggcagagccagacacacccaggccgagctgcagagagccctggccgagggcggcagcatcctgagcagagtggccgagaccagaagacaggccagcgaggcccagcagagagcccaggccgccctggacaaggccaacgccagcagaggccaggtggagcaggccaaccaggagctgcaggagctgatccagagcgtgaaggacttcctgaaccaggagggcgccgaccccgacagcatcgagatggtggccaccagagtgctggagctgagcatccccgccagcgccgagcagatccagcacctggccggcgccatcgccgagagagtgagaagcctggccgacgtggacgccatcctggccagaaccgtgggcgacgtgagaagagccgagcagctgctgcaggacgccagaagagccagaagctgggccgaggacgagaagcagaaggccgagaccgtgcaggccgccctggaggaggcccagagagcccagggcatcgcccagggcgccatcagaggcgccgtggccgacaccagagacaccgagcagaccctgtaccaggtgcaggagagaatggccggcgccgagagagccctgagcagcgccggcgagagagccagacagctggacgccctgctggaggccctgaagctgaagagagccggcaacagcctggccgccagcaccgccgaggagaccgccggcagcgcccagggcagagcccaggaggccgagcagctgctgagaggccccctgggcgaccagtaccagaccgtgaaggccctggccgagagaaaggcccagggcgtgctggccgcccaggccagagccgagcagctgagagacgaggccagagacctgctgcaggccgcccaggacaagctgcagagactgcaggagctggagggcacctacgaggagaacgagagagccctggagagcaaggccgcccagctggacggcctggaggccagaatgagaagcgtgctgcaggccatcaacctgcaggtgcagatctacaacacctgccagtag

SEQ ID NO: 86513 - DNA, 1143 bp, Artificial Sequence
  Description of Artificial Sequence: Synthetic coding sequence
atgcaggagaagctgggcatcgtgcagggcatcgtgggcgccagaaacaccagcgccgccagcaccgcccagctggtggaggccaccgaggagctgagaagagagatcggcgaggccaccgagcacctgacccagctggaggccgacctgaccgacgtgcaggacgagaacttcaacgccaaccacgccctgagcggcctggagagagacagactggccctgaacctgaccctgagacagctggaccagcacctggacctgctgaagcacagcaacttcctgggcgcctacgacagcatcagacacgcccacagccagagcgccgaggccgagagaagagccaacaccagcgccctggccgtgcccagccccgtgagcaacagcgccagcgccagacacagaaccgaggccctgatggacgcccagaaggaggacttcaacagcaagcacatggccaaccagagagccctgggcaagctgagcgcccacacccacaccctgagcctgaccgacatcaacgagctggtgtgcggcgcccccggcgacgccccctgcgccaccagcccctgcggcggcgccggctgcagagacgaggacggccagcccagatgcggcggcctgagctgcaacggcgccgccgccaccgccgacctggccctgggcagagccagacacacccaggccgagctgcagagagccctggccgagggcggcagcatcctgagcagagtggccgagaccagaagacaggccagcgaggcccagcagagagcccaggccgccctggacaaggccaacgccagcagaggccaggtggagcaggccaaccaggagctgcaggagctgatccagagcgtgaaggacttcctgaaccaggagggcgccgaccccgacagcatcgagatggtggccaccagagtgctggagctgagcatccccgccagcgccgagcagatccagcacctggccggcgccatcgccgagagagtgagaagcctggccgacgtggacgccatcctggcccagggcatcgcccagggcgccatcagaggcgccgtggccgacaccagagacaccgagcagcccgtgcccggcaccggcgaggacggcagatgcagagccggcaccgagctgtgcagatag

SEQ ID NO: 86514 - DNA, 5397 bp, Artificial Sequence; identical to SEQ ID NO: 86512
  Description of Artificial Sequence: Synthetic coding sequence

SEQ ID NO: 86515 - DNA, 3519 bp, Artificial Sequence
  Description of Artificial Sequence: Synthetic coding sequence
atgagacccttcttcctgctgtgcttcgccctgcccggcctgctgcacgcccagcaggcctgcagcagaggcgcctgctacccccccgtgggcgacctgctggtgggcagaaccagattcctgagagccagcagcacctgcggcctgaccaagcccgagacctactgcacccagtacggcgagtggcagatgaagtgctgcaagtgcgacagcagacagccccacaactactacagccacagagtggagaacgtggccagcagcagcggccccatgagatggtggcagagccagaacgacgtgaaccccgtgagcctgcagctggacctggacagaagattccagctgcaggaggtgatgatggagttccagggccccatgcccgccggcatgctgatcgagagaagcagcgacttcggcaagacctggagagtgtaccagtacctggccgccgactgcaccagcaccttccccagagtgagacagggcagaccccagagctggcaggacgtgagatgccagagcctgccccagagacccaacgccagactgaacggcggcaaggtgcagctgaacctgatggacctggtgagcggcatccccgccacccagagccagaagatccaggaggtgggcgagatcaccaacctgagagtgaacttcaccagactggcccccgtgccccagagaggctaccacccccccagcgcctactacgccgtgagccagctgagactgcagggcagctgcttctgccacggccacgccgacagatgcgcccccaagcccggcgccagcgccggccccagcaccgccgtgcaggtgcacgacgtgtgcgtgtgccagcacaacaccgccggccccaactgcgagagatgcgcccccttctacaacaacagaccctggagacccgccgagggccaggacgcccacgagtgccagagatgcgactgcaacggccacagcgagacctgccacttcgaccccgccgtgttcgccgccagccagggcgcctacggcggcgtgtgcgacaactgcagagaccacaccgagggcaagaactgcgagagatgccagctgcactacttcagaaacagaagacccggcgccagcatccaggagacctgcatcagctgcgagtgcgaccccgacggcgccgtgcccggcgccccctgcgaccccgtgaccggccagtgcgtgtgcaaggagcacgtgcagggcgagagatgcgacctgtgcaagcccggcttcaccggcctgacctacgccaacccccagggctgccacagatgcgactgcaacatcctgggcagcagaagagacatgccctgcgacgaggagagcggcagatgcctgtgcctgcccaacgtggtgggccccaagtgcgaccagtgcgccccctaccactggaagctggccagcggccagggctgcgagccctgcgcctgcgacccccacaacagcctgagcccccagtgcaaccagttcaccggccagtgcccctgcagagagggcttcggcggcctgatgtgcagcgccgccgccatcagacagtgccccgacagaacctacggcgacgtggccaccggctgcagagcctgcgactgcgacttcagaggcaccgagggccccggctgcgacaaggccagcggcagatgcctgtgcagacccggcctgaccggccccagatgcgaccagtgccagagaggctactgcaacagataccccgtgtgcgtggcctgccacccctgcttccagacctacgacgccgacctgagagagcaggccctgagattcggcagactgagaaacgccaccgccagcctgtggagcggccccggcctggaggacagaggcctggccagcagaatcctggacgccaagagcaagatcgagcagatcagagccgtgctgagcagccccgccgtgaccgagcaggaggtggcccaggtggccagcgccatcctgagcctgagaagaaccctgcagggcctgcagctggacctgcccctggaggaggagaccctgagcctgcccagagacctggagagcctggacagaagcttcaacggcctgctgaccatgtaccagagaaagagagagcagttcgagaagatcagcagcgccgaccccagcggcgccttcagaatgctgagcaccgcctacgagcagagcgcccaggccgcccagcaggtgagcgacagcagcagactgctggaccagctgagagacagcagaagagaggccgagagactggtgagacaggccggcggcggcggcggcaccggcagccccaagctggtggccctgagactggagatgagcagcctgcccgacctgacccccaccttcaacaagctgtgcggcaacagcagacagatggcctgcacccccatcagctgccccggcgagctgtgcccccaggacaacggcaccgcctgcggcagcagatgcagaggcgtgctgcccagagccggcggcgccttcctgatggccggccaggtggccgagcagctgagaggcttcaacgcccagctgcagagaaccagacagatgatcagagccgccgaggagagcgccagccagatccagagcagcgcccagagactggagacccaggtgagcgccagcagaagccagatggaggaggacgtgagaagaaccagactgctgatccagcaggtgagagacttcctgaccgaccccgacaccgacgccgccaccatccaggaggtgagcgaggccgtgctggccctgtggctgcccaccgacagcgccaccgtgctgcagaagatgaacgagatccaggccatcgccgccagactgcccaacgtggacctggtgctgagccagaccaagcaggacatcgccagagccagaagactgcaggccgaggccgaggaggccagaagcagagcccacgccgtggagggccaggtggaggacgtggtgggcaacctgagacagggcaccgtggccctgcaggaggcccaggacaccatgcagggcaccagcagaagcctgagactgatccaggacagagtggccgaggtgcagcaggtgctgagacccgccgagaagctggtgaccagcatgaccaagcagctgggcgacttctggaccagaatggaggagctgagacaccaggccagacagcagggcgccgaggccgtgcaggcccagcagctggccgagggcgccagcgagcaggccctgagcgcccaggagggcttcgagagaatcaagcagaagtacgccgagctgaaggacagactgggccagagcagcatgctgggcgagcagggcgccagaatccagagcgtgaagaccgaggccgaggagctgttcggcgagaccatggagatgatggacagaatgaaggacatggagctggagctgctgagaggcagccaggccatcatgctgagaagcgccgacctgaccggcctggagaagagagtggagcagatcagagaccacatcaacggcagagtgctgtactacgccacctgcaagtag

SEQ ID NO: 86516 - DNA, 3519 bp, Artificial Sequence; identical to SEQ ID NO: 86515
  Description of Artificial Sequence: Synthetic coding sequence

SEQ ID NO: 86517 - DNA, 3519 bp, Artificial Sequence; identical to SEQ ID NO: 86515
  Description of Artificial Sequence: Synthetic coding sequence

SEQ ID NO: 86518 - DNA, 567 bp, Artificial Sequence
  Description of Artificial Sequence: Synthetic coding sequence
atgagacccttcttcctgctgtgcttcgccctgcccggcctgctgcacgcccagcaggcctgcagcagaggcgcctgctacccccccgtgggcgacctgctggtgggcagaaccagattcctgagagccagcagcacctgcggcctgaccaagcccgagacctactgcacccagtacggcgagtggcagatgaagtgctgcaagtgcgacagcagacagccccacaactactacagccacagagtggagaacgtggccagcagcagcggccccatgagatggtggcagagccagaacgacgtgaaccccgtgagcctgcagctggacctggacagaagattccagctgcaggaggtgatgatggagttccagggccccatgcccgccggcatgctgatcgagagaagcagcgacttcggcaagacctggagagtgtaccagtacctggccgccgactgcaccagcaccttccccagagtgagacagggcagaccccagagctggcaggacgtgagatgccagagcctgccccagagacccaacgccagactgaacggcggcaagtag

SEQ ID NO: 86519 - DNA, 483 bp, Artificial Sequence
  Description of Artificial Sequence: Synthetic coding sequence
atgaacgagatccaggccatcgccgccagactgcccaacgtggacctggtgctgagccagaccaagcaggacatcgccagagccagaagactgcaggccgaggccgaggaggccagaagcagagcccacgccgtggagggccaggtggaggacgtggtgggcaacctgagacagggcaccgtggccctgcaggaggcccaggacaccatgcagggcaccagcagaagcctgagactgatccaggacagagtggccgaggtgcagcaggtgctgagacccgccgagaagctggtgaccagcatgaccaagcagctgggcgacttctggaccagaatggaggagctgagacaccaggccagacagcagggcgccgaggccgtgcaggcccagcagctggccgagggcgccagcgagcaggccctgagcgcccaggagggcttcgagagaatcaagcagaagtacgccgagctgaaggacagatag

SEQ ID NO: 86520 - DNA, 4830 bp, Artificial Sequence
  Description of Artificial Sequence: Synthetic coding sequence
atgagaggcagccacagagccgcccccgccctgagacccagaggcagactgtggcccgtgctggccgtgctggccgccgccgccgccgccggctgcgcccaggccgccatggacgagtgcaccgacgagggcggcagaccccagagatgcatgcccgagttcgtgaacgccgccttcaacgtgaccgtggtggccaccaacacctgcggcaccccccccgaggagtactgcgtgcagaccggcgtgaccggcgtgaccaagagctgccacctgtgcgacgccggccagccccacctgcagcacggcgccgccttcctgaccgactacaacaaccaggccgacaccacctggtggcagagccagaccatgctggccggcgtgcagtaccccagcagcatcaacctgaccctgcacctgggcaaggccttcgacatcacctacgtgagactgaagttccacaccagcagacccgagagcttcgccatctacaagagaaccagagaggacggcccctggatcccctaccagtactacagcggcagctgcgagaacacctacagcaaggccaacagaggcttcatcagaaccggcggcgacgagcagcaggccctgtgcaccgacgagttcagcgacatcagccccctgaccggcggcaacgtggccttcagcaccctggagggcagacccagcgcctacaacttcgacaacagccccgtgctgcaggagtgggtgaccgccaccgacatcagagtgaccctgaacagactgaacaccttcggcgacgaggtgttcaacgaccccaaggtgctgaagagctactactacgccatcagcgacttcgccgtgggcggcagatgcaagtgcaacggccacgccagcgagtgcatgaagaacgagttcgacaagctggtgtgcaactgcaagcacaacacctacggcgtggactgcgagaagtgcctgcccttcttcaacgacagaccctggagaagagccaccgccgagagcgccagcgagtgcctgccctgcgactgcaacggcagaagccaggagtgctacttcgaccccgagctgtacagaagcaccggccacggcggccactgcaccaactgccaggacaacaccgacggcgcccactgcgagagatgcagagagaacttcttcagactgggcaacaacgaggcctgcagcagctgccactgcagccccgtgggcagcctgagcacccagtgcgacagctacggcagatgcagctgcaagcccggcgtgatgggcgacaagtgcgacagatgccagcccggcttccacagcctgaccgaggccggctgcagaccctgcagctgcgaccccagcggcagcatcgacgagtgcaacatcgagaccggcagatgcgtgtgcaaggacaacgtggagggcttcaactgcgagagatgcaagcccggcttcttcaacctggagagcagcaaccccagaggctgcaccccctgcttctgcttcggccacagcagcgtgtgcaccaacgccgtgggctacagcgtgtacagcatcagcagcaccttccagatcgacgaggacggctggagagccgagcagagagacggcagcgaggccagcctggagtggagcagcgagagacaggacatcgccgtgatcagcgacagctacttccccagatacttcatcgcccccgccaagttcctgggcaagcaggtgctgagctacggccagaacctgagcttcagcttcagagtggacagaagagacaccagactgagcgccgaggacctggtgctggagggcgccggcctgagagtgagcgtgcccctgatcgcccagggcaacagctaccccagcgagaccaccgtgaagtacgtgttcagactgcacgaggccaccgactacccctggagacccgccctgacccccttcgagttccagaagctgctgaacaacctgaccagcatcaagatcagaggcacctacagcgagagaagcgccggctacctggacgacgtgaccctggccagcgccagacccggccccggcgtgcccgccacctgggtggagagctgcacctgccccgtgggctacggcggccagttctgcgagatgtgcctgagcggctacagaagagagacccccaacctgggcccctacagcccctgcgtgctgtgcgcctgcaacggccacagcgagacctgcgaccccgagaccggcgtgtgcaactgcagagacaacaccgccggcccccactgcgagaagtgcagcgacggctactacggcgacagcaccgccggcaccagcagcgactgccagccctgcccctgccccggcggcagcagctgcgccgtggtgcccaagaccaaggaggtggtgtgcaccaactgccccaccggcaccaccggcaagagatgcgagctgtgcgacgacggctacttcggcgaccccctgggcagaaacggccccgtgagactgtgcagactgtgccagtgcagcgacaacatcgaccccaacgccgtgggcaactgcaacagactgaccggcgagtgcctgaagtgcatctacaacaccgccggcttctactgcgacagatgcaaggacggcttcttcggcaaccccctggcccccaaccccgccgacaagtgcaaggcctgcaactgcaacctgtacggcaccatgaagcagcagagcagctgcaaccccgtgaccggccagtgcgagtgcctgccccacgtgaccggccaggactgcggcgcctgcgaccccggcttctacaacctgcagagcggccagggctgcgagagatgcgactgccacgccctgggcagcaccaacggccagtgcgacatcagaaccggccagtgcgagtgccagcccggcatcaccggccagcactgcgagagatgcgaggtgaaccacttcggcttcggccccgagggctgcaagccctgcgactgccaccccgagggcagcctgagcctgcagtgcaaggacgacggcagatgcgagtgcagagagggcttcgtgggcaacagatgcgaccagtgcgaggagaactacttctacaacagaagctggcccggctgccaggagtgccccgcctgctacagactggtgaaggacaaggtggccgaccacagagtgaagctgcaggagctggagagcctgatcgccaacctgggcaccggcgacgagatggtgaccgaccaggccttcgaggacagactgaaggaggccgagagagaggtgatggacctgctgagagaggcccaggacgtgaaggacgtggaccagaacctgatggacagactgcagagagtgaacaacaccctgagcagccagatcagcagactgcagaacatcagaaacaccatcgaggagaccggcaacctggccgagcaggccagagcccacgtggagaacaccgagagactgatcgagatcgccagcagagagctggagaaggccaaggtggccgccgccaacgtgagcgtgacccagcccgagagcaccggcgaccccaacaacatgaccctgctggccgaggaggccagaaagctggccgagagacacaagcaggaggccgacgacatcgtgagagtggccaagaccgccaacgacaccagcaccgaggcctacaacctgctgctgagaaccctggccggcgagaaccagaccgccttcgagatcgaggagctgaacagaaagtacgagcaggccaagaacatcagccaggacctggagaagcaggccgccagagtgcacgaggaggccaagagagccggcgacaaggccgtggagatctacgccagcgtggcccagctgagccccctggacagcgagaccctggagaacgaggccaacaacatcaagatggaggccgagaacctggagcagctgatcgaccagaagctgaaggactacgaggacctgagagaggacatgagaggcaaggagctggaggtgaagaacctgctggagaagggcaagaccgagcagcagaccgccgaccagctgctggccagagccgacgccgccaaggccctggccgaggaggccgccaagaagggcagagacaccctgcaggaggccaacgacatcctgaacaacctgaaggacttcgacagaagagtgaacgacaacaagaccgccgccgaggaggccctgagaaagatccccgccatcaaccagaccatcaccgaggccaacgagaagaccagagaggcccagcaggccctgggcagcgccgccgccgacgccaccgaggccaagaacaaggcccacgaggccgagagaatcgccagcgccgtgcagaagaacgccaccagcaccaaggccgaggccgagagaaccttcgccgaggtgaccgacctggacaacgaggtgaacaacatgctgaagcagctgcaggaggccgagaaggagctgaagagaaagcaggacgacgccgaccaggacatgatgatggccggcatggccagccaggccgcccaggaggccgagatcaacgccagaaaggccaagaacagcgtgaccagcctgctgagcatcatcaacgacctgctggagcagctgggccagctggacaccgtggacctgaacaagctgaacgagatcgagggcaccctgaacaaggccaaggacgagatgaaggtgagcgacctggacagaaaggtgagcgacctggagaacgaggccaagaagcaggaggccgccatcatggactacaacagagacatcgaggagatcatgaaggacatcagaaacctggaggacatcagaaagaccctgcccagcggctgcttcaacacccccagcatcgagaagccctag

SEQ ID NO: 86521 - DNA, 3582 bp, Artificial Sequence
  Description of Artificial Sequence: Synthetic coding sequence
atgcccgccctgtggctgggctgctgcctgtgcttcagcctgctgctgcccgccgccagagccaccagcagaagagaggtgtgcgactgcaacggcaagagcagacagtgcatcttcgacagagagctgcacagacagaccggcaacggcttcagatgcctgaactgcaacgacaacaccgacggcatccactgcgagaagtgcaagaacggcttctacagacacagagagagagacagatgcctgccctgcaactgcaacagcaagggcagcctgagcgccagatgcgacaacagcggcagatgcagctgcaagcccggcgtgaccggcgccagatgcgacagatgcctgcccggcttccacatgctgaccgacgccggctgcacccaggaccagagactgctggacagcaagtgcgactgcgaccccgccggcatcgccggcccctgcgacgccggcagatgcgtgtgcaagcccgccgtgaccggcgagagatgcgacagatgcagaagcggctactacaacctggacggcggcaaccccgagggctgcacccagtgcttctgctacggccacagcgccagctgcagaagcagcgccgagtacagcgtgcacaagatcaccagcaccttccaccaggacgtggacggctggaaggccgtgcagagaaacggcagccccgccaagctgcagtggagccagagacaccaggacgtgttcagcagcgcccagagactggaccccgtgtacttcgtggcccccgccaagttcctgggcaaccagcaggtgagctacggccagagcctgagcttcgactacagagtggacagaggcggcagacaccccagcgcccacgacgtgatcctggagggcgccggcctgagaatcaccgcccccctgatgcccctgggcaagaccctgccctgcggcctgaccaagacctacaccttcagactgaacgagcaccccagcaacaactggagcccccagctgagctacttcgagtacagaagactgctgagaaacctgaccgccctgagaatcagagccacctacggcgagtacagcaccggctacatcgacaacgtgaccctgatcagcgccagacccgtgagcggcgcccccgccccctgggtggagcagtgcatctgccccgtgggctacaagggccagttctgccaggactgcgccagcggctacaagagagacagcgccagactgggccccttcggcacctgcatcccctgcaactgccagggcggcggcgcctgcgaccccgacaccggcgactgctacagcggcgacgagaaccccgacatcgagtgcgccgactgccccatcggcttctacaacgacccccacgaccccagaagctgcaagccctgcccctgccacaacggcttcagctgcagcgtgatgcccgagaccgaggaggtggtgtgcaacaactgcccccccggcgtgaccggcgccagatgcgagctgtgcgccgacggctacttcggcgaccccttcggcgagcacggccccgtgagaccctgccagccctgccagtgcaacaacaacgtggaccccagcgccagcggcaactgcgacagactgaccggcagatgcctgaagtgcatccacaacaccgccggcatctactgcgaccagtgcaaggccggctacttcggcgaccccctggcccccaaccccgccgacaagtgcagagcctgcaactgcaaccccatgggcagcgagcccgtgggctgcagaagcgacggcacctgcgtgtgcaagcccggcttcggcggccccaactgcgagcacggcgccttcagctgccccgcctgctacaaccaggtgaagatccagatggaccagttcatgcagcagctgcagagaatggaggccctgatcagcaaggcccagggcggcgacggcgtggtgcccgacaccgagctggagggcagaatgcagcaggccgagcaggccctgcaggacatcctgagagacgcccagatcagcgagggcgccagcagaagcctgggcctgcagctggccaaggtgagaagccaggagaacagctaccagagcagactggacgacctgaagatgaccgtggagagagtgagagccctgggcagccagtaccagaacagagtgagagacacccacagactgatcacccagatgcagctgagcctggccgagagcgaggccagcctgggcaacaccaacatccccgccagcgaccactacgtgggccccaacggcttcaagagcctggcccaggaggccaccagactggccgagagccacgtggagagcgccagcaacatggagcagctgaccagagagaccgaggactacagcaagcaggccctgagcctggtgagaaaggccctgcacgagggcgtgggcagcggcagcggcagccccgacggcgccgtggtgcagggcctggtggagaagctggagaagaccaagagcctggcccagcagctgaccagagaggccacccaggccgagatcgaggccgacagaagctaccagcacagcctgagactgctggacagcgtgagcagactgcagggcgtgagcgaccagagcttccaggtggaggaggccaagagaatcaagcagaaggccgacagcctgagcagcctggtgaccagacacatggacgagttcaagagaacccagaagaacctgggcaactggaaggaggaggcccagcagctgctgcagaacggcaagagcggcagagagaagagcgaccagctgctgagcagagccaacctggccaagagcagagcccaggaggccctgagcatgggcaacgccaccttctacgaggtggagagcatcctgaagaacctgagagagttcgacctgcaggtggacaacagaaaggccgaggccgaggaggccatgaagagactgagctacatcagccagaaggtgagcgacgccagcgacaagacccagcaggccgagagagccctgggcagcgccgccgccgacgcccagagagccaagaacggcgccggcgaggccctggagatcagcagcgagatcgagcaggagatcggcagcctgaacctggaggccaacgtgaccgccgacggcgccctggccatggagaagggcctggccagcctgaagagcgagatgagagaggtggagggcgagctggagagaaaggagctggagttcgacaccaacatggacgccgtgcagatggtgatcaccgaggcccagaaggtggacaccagagccaagaacgccggcgtgaccatccaggacaccctgaacaccctggacggcctgctgcacctgatggaccagcccctgagcgtggacgaggagggcctggtgctgctggagcagaagctgagcagagccaagacccagatcaacagccagctgagacccatgatgagcgagctggaggagagagccagacagcagagaggccacctgcacctgctggagaccagcatcgacggcatcctggccgacgtgaagaacctggagaacatcagagacaacctgccccccggctgctacaacacccaggccctggagcagcagtag

SEQ ID NO: 86522 - DNA, 3336 bp, Artificial Sequence
  Description of Artificial Sequence: Synthetic coding sequence
atgcccgccctgtggctgggctgctgcctgtgcttcagcctgctgctgcccgccgccagagccaccagcagaagagaggtgtgcgactgcaacggcaagagcagacagtgcatcttcgacagagagctgcacagacagaccggcaacggcttcagatgcctgaactgcaacgacaacaccgacggcatccactgcgagaagtgcaagaacggcttctacagacacagagagagagacagatgcctgccctgcaactgcaacagcaagggcagcctgagcgccagatgcgacaacagcggcagatgcagctgcaagcccggcgtgaccggcgccagatgcgacagatgcctgcccggcttccacatgctgaccgacgccggctgcacccaggaccagagactgctggacagcaagtgcgactgcgaccccgccggcatcgccggcccctgcgacgccggcagatgcgtgtgcaagcccgccgtgaccggcgagagatgcgacagatgcagaagcggctactacaacctggacggcggcaaccccgagggctgcacccagtgcttctgctacggccacagcgccagctgcagaagcagcgccgagtacagcgtgcacaagatcaccagcaccttccaccaggacgtggacggctggaaggccgtgcagagaaacggcagccccgccaagctgcagtggagccagagacaccaggacgtgttcagcagcgcccagagactggaccccgtgtacttcgtggcccccgccaagttcctgggcaaccagcaggtgagctacggccagagcctgagcttcgactacagagtggacagaggcggcagacaccccagcgcccacgacgtgatcctggagggcgccggcctgagaatcaccgcccccctgatgcccctgggcaagaccctgccctgcggcctgaccaagacctacaccttcagactgaacgagcaccccagcaacaactggagcccccagctgagctacttcgagtacagaagactgctgagaaacctgaccgccctgagaatcagagccacctacggcgagtacagcaccggctacatcgacaacgtgaccctgatcagcgccagacccgtgagcggcgcccccgccccctgggtggagcagtgcatctgccccgtgggctacaagggccagttctgccaggactgcgccagcggctacaagagagacagcgccagactgggccccttcggcacctgcatcccctgcaactgccagggcggcggcgcctgcgaccccgacaccggcgactgctacagcggcgacgagaaccccgacatcgagtgcgccgactgccccatcggcttctacaacgacccccacgaccccagaagctgcaagccctgcccctgccacaacggcttcagctgcagcgtgatgcccgagaccgaggaggtggtgtgcaacaactgcccccccggcgtgaccggcgccagatgcgagctgtgcgccgacggctacttcggcgaccccttcggcgagcacggccccgtgagaccctgccagccctgccagtgcaacaacaacgtggaccccagcgccagcggcaactgcgacagactgaccggcagatgcctgaagtgcatccacaacaccgccggcatctactgcgaccagtgcaaggccggctacttcggcgaccccctggcccccaaccccgccgacaagtgcagagcctgcaactgcaaccccatgggcagcgagcccgtgggctgcagaagcgacggcacctgcgtgtgcaagcccggcttcggcggccccaactgcgagcacggcgccttcagctgccccgcctgctacaaccaggtgaagatccagatggaccagttcatgcagcagctgcagagaatggaggccctgatcagcaaggcccagggcggcgacggcgtggtgcccgacaccgagctggagggcagaatgcagcaggccgagcaggccctgcaggacatcctgagagacgcccagatcagcgagggcgccagcagaagcctgggcctgcagctggccaaggtgagaagccaggagaacagctaccagagcagactggacgacctgaagatgaccgtggagagagtgagagccctgggcagccagtaccagaacagagtgagagacacccacagactgatcacccagatgcagctgagcctggccgagagcgaggccagcctgggcaacaccaacatccccgccagcgaccactacgtgggccccaacggcttcaagagcctggcccaggaggccaccagactggccgagagccacgtggagagcgccagcaacatggagcagctgaccagagagaccgaggactacagcaagcaggccctgagcctggtgagaaaggccctgcacgagggcgtgggcagcggcagcggcagccccgacggcgccgtggtgcagggcctggtggagaagctggagaagaccaagagcctggcccagcagctgaccagagaggccacccaggccgagatcgaggccgacagaagctaccagcacagcctgagactgctggacagcgtgagcagactgcagggcgtgagcgaccagagcttccaggtggaggaggccaagagaatcaagcagaaggccgacagcctgagcagcctggtgaccagacacatggacgagttcaagagaacccagaagaacctgggcaactggaaggaggaggcccagcagctgctgcagaacggcaagagcggcagagagaagagcgaccagctgctgagcagagccaacctggccaagagcagagcccaggaggccctgagcatgggcaacgccaccttctacgaggtggagagcatcctgaagaacctgagagagttcgacctgcaggtggacaacagaaaggccgaggccgaggaggccatgaagagactgagctacatcagccagaaggtgagcgacgccagcgacaagacccagcaggccgagagagccctgggcagcgccgccgccgacgcccagagagccaagaacggcgccggcgaggccctggagatcagcagcgagatcgagcaggagatcggcagcctgaacctggaggccaacgtgaccgccgacggcgccctggccatggagaagggcctggccagcctgaagagcgagatgagagaggtggagggcgagctggagagaaaggagctggagttcgacaccaacatggacgccgtgcagatggtgatcaccgaggcccagaaggtggacaccagagccaagaacgccggcgtgaccatccaggacaccctgaacaccctggacggcctgctgcacctgatgggcatgtag

SEQ ID NO: 86523 - DNA, 3033 bp, Artificial Sequence
  Description of Artificial Sequence: Synthetic coding sequence
atgcccgccctgtggctgggctgctgcctgtgcttcagcctgctgctgcccgccgccagagccaccagcagaagagaggtgtgcgactgcaacggcaagagcagacagtgcatcttcgacagagagctgcacagacagaccggcaacggcttcagatgcctgaactgcaacgacaacaccgacggcatccactgcgagaagtgcaagaacggcttctacagacacagagagagagacagatgcctgccctgcaactgcaacagcaagggcagcctgagcgccagatgcgacaacagcggcagatgcagctgcaagcccggcgtgaccggcgccagatgcgacagatgcctgcccggcttccacatgctgaccgacgccggctgcacccaggaccagagactgctggacagcaagtgcgactgcgaccccgccggcatcgccggcccctgcgacgccggcagatgcgtgtgcaagcccgccgtgaccggcgagagatgcgacagatgcagaagcggctactacaacctggacggcggcaaccccgagggctgcacccagtgcttctgctacggccacagcgccagctgcagaagcagcgccgagtacagcgtgcacaagatcaccagcaccttccaccaggacgtggacggctggaaggccgtgcagagaaacggcagccccgccaagctgcagtggagccagagacaccaggacgtgttcagcagcgcccagagactggaccccgtgtacttcgtggcccccgccaagttcctgggcaaccagcaggtgagctacggccagagcctgagcttcgactacagagtggacagaggcggcagacaccccagcgcccacgacgtgatcctggagggcgccggcctgagaatcaccgcccccctgatgcccctgggcaagaccctgccctgcggcctgaccaagacctacaccttcagactgaacgagcaccccagcaacaactggagcccccagctgagctacttcgagtacagaagactgctgagaaacctgaccgccctgagaatcagagccacctacggcgagtacagcaccggctacatcgacaacgtgaccctgatcagcgccagacccgtgagcggcgcccccgccccctgggtggagcagtgcatctgccccgtgggctacaagggccagttctgccaggactgcgccagcggctacaagagagacagcgccagactgggccccttcggcacctgcatcccctgcaactgccagggcggcggcgcctgcgaccccgacaccggcgactgctacagcggcgacgagaaccccgacatcgagtgcgccgactgccccatcggcttctacaacgacccccacgaccccagaagctgcaagccctgcccctgccacaacggcttcagctgcagcgtgatgcccgagaccgaggaggtggtgtgcaacaactgcccccccggcgtgaccggcgccagatgcgagctgtgcgccgacggctacttcggcgaccccttcggcgagcacggccccgtgagaccctgccagccctgccagtgcaacaacaacgtggaccccagcgccagcggcaactgcgacagactgaccggcagatgcctgaagtgcatccacaacaccgccggcatctactgcgaccagtgcaaggccggctacttcggcgaccccctggcccccaaccccgccgacaagtgcagagcctgcaactgcaaccccatgggcagcgagcccgtgggctgcagaagcgacggcacctgcgtgtgcaagcccggcttcggcggccccaactgcgagcacggcgccttcagctgccccgcctgctacaaccaggtgaagatccagatggaccagttcatgcagcagctgcagagaatggaggccctgatcagcaaggcccagggcggcgacggcgtggtgcccgacaccgagctggagggcagaatgcagcaggccgagcaggccctgcaggacatcctgagagacgcccagatcagcgagggcgccagcagaagcctgggcctgcagctggccaaggtgagaagccaggagaacagctaccagagcagactggacgacctgaagatgaccgtggagagagtgagagccctgggcagccagtaccagaacagagtgagagacacccacagactgatcacccagatgcagctgagcctggccgagagcgaggccagcctgggcaacaccaacatccccgccagcgaccactacgtgggccccaacggcttcaagagcctggcccaggaggccaccagactggccgagagccacgtggagagcgccagcaacatggagcagctgaccagagagaccgaggactacagcaagcaggccctgagcctggtgagaaaggccctgcacgagggcgtgggcagcggcagcggcagccccgacggcgccgtggtgcagggcctggtggagaagctggagaagaccaagagcctggcccagcagctgaccagagaggccacccaggccgagatcgaggccgacagaagctaccagcacagcctgagactgctggacagcgtgagcagactgcagggcgtgagcgaccagagcttccaggtggaggaggccaagagaatcaagcagaaggccgacagcctgagcagcctggtgaccagacacatggacgagttcaagagaacccagaagaacctgggcaactggaaggaggaggcccagcagctgctgcagaacggcaagagcggcagagagaagagcgaccagctgctgagcagagccaacctggccaagagcagagcccaggaggccctgagcatgggcaacgccaccttctacgaggtggagagcatcctgaagaacctgagagagttcgacctgcaggtggacaacagaaaggccgaggccttccccagccaggaccccgaccagcagcccaccgccgcccacgacgtgagagccggcagagagggcaccagcgccgagggccccccccccttcgccggcgacaagcacagatgggacagcggctag

SEQ ID NO: 86524 - DNA, 1590 bp, Artificial Sequence
  Description of Artificial Sequence: Synthetic coding sequence
atggccgccgccgccctgctgctgggcctggccctgctggcccccagagccgccggcgccggcatgggcgcctgctacgacggcgccggcagaccccagagatgcctgcccgtgttcgagaacgccgccttcggcagactggcccaggccagccacacctgcggcagcccccccgaggacttctgcccccacgtgggcgccgccggcgccggcgcccactgccagagatgcgacgccgccgacccccagagacaccacaacgccagctacctgaccgacttccacagccaggacgagagcacctggtggcagagccccagcatggccttcggcgtgcagtaccccaccagcgtgaacatcaccctgagactgggcaaggcctacgagatcacctacgtgagactgaagttccacaccagcagacccgagagcttcgccatctacaagagaagcagagccgacggcccctgggagccctaccagttctacagcgccagctgccagaagacctacggcagacccgagggccagtacctgagacccggcgaggacgagagagtggccttctgcaccagcgagttcagcgacatcagccccctgagcggcggcaacgtggccttcagcaccctggagggcagacccagcgcctacaacttcgaggagagccccggcctgcaggagtgggtgaccagcaccgagctgctgatcagcctggacagactgaacaccttcggcgacgacatcttcaaggaccccaaggtgctgcagagctactactacgccgtgagcgacttcagcgtgggcggcagatgcaagtgcaacggccacgccagcgagtgcggccccgacgtggccggccagctggcctgcagatgccagcacaacaccaccggcaccgactgcgagagatgcctgcccttcttccaggacagaccctgggccagaggcaccgccgaggccgcccacgagtgcctgccctgcaactgcagcggcagaagcgaggagtgcaccttcgacagagagctgttcagaagcaccggccacggcggcagatgccaccactgcagagaccacaccgccggcccccactgcgagagatgccaggagaacttctaccactgggaccccagaatgccctgccagccctgcgactgccagagcgccggcagcctgcacctgcagtgcgacgacaccggcacctgcgcctgcaagcccaccgtgaccggctggaagtgcgacagatgcctgcccggcttccacagcctgagcgagggcggctgcagaccctgcacctgcaaccccgccggcagcctggacacctgcgaccccagaagcggcagatgcccctgcaaggagaacgtggagggcaacctgtgcgacagatgcagacccggcaccttcaacctgcagccccacaaccccgccggcagaagctgcagaagcagagccagcagagtgaccagccccagaagcgcccccaccaacagaacctggagacccttctgcaccgcctgccccagaaccgtgcccgccggcagcgagggctgccccgaccccagacacaccctgccccacctgctgttcacctag

SEQ ID NO: 86525 - DNA, 4728 bp, Artificial Sequence
  Description of Artificial Sequence: Synthetic coding sequence
atggccgccgccgccctgctgctgggcctggccctgctggcccccagagccgccggcgccggcatgggcgcctgctacgacggcgccggcagaccccagagatgcctgcccgtgttcgagaacgccgccttcggcagactggcccaggccagccacacctgcggcagcccccccgaggacttctgcccccacgtgggcgccgccggcgccggcgcccactgccagagatgcgacgccgccgacccccagagacaccacaacgccagctacctgaccgacttccacagccaggacgagagcacctggtggcagagccccagcatggccttcggcgtgcagtaccccaccagcgtgaacatcaccctgagactgggcaaggcctacgagatcacctacgtgagactgaagttccacaccagcagacccgagagcttcgccatctacaagagaagcagagccgacggcccctgggagccctaccagttctacagcgccagctgccagaagacctacggcagacccgagggccagtacctgagacccggcgaggacgagagagtggccttctgcaccagcgagttcagcgacatcagccccctgagcggcggcaacgtggccttcagcaccctggagggcagacccagcgcctacaacttcgaggagagccccggcctgcaggagtgggtgaccagcaccgagctgctgatcagcctggacagactgaacaccttcggcgacgacatcttcaaggaccccaaggtgctgcagagctactactacgccgtgagcgacttcagcgtgggcggcagatgcaagtgcaacggccacgccagcgagtgcggccccgacgtggccggccagctggcctgcagatgccagcacaacaccaccggcaccgactgcgagagatgcctgcccttcttccaggacagaccctgggccagaggcaccgccgaggccgcccacgagtgcctgccctgcaactgcagcggcagaagcgaggagtgcaccttcgacagagagctgttcagaagcaccggccacggcggcagatgccaccactgcagagaccacaccgccggcccccactgcgagagatgccaggagaacttctaccactgggaccccagaatgccctgccagccctgcgactgccagagcgccggcagcctgcacctgcagtgcgacgacaccggcacctgcgcctgcaagcccaccgtgaccggctggaagtgcgacagatgcctgcccggcttccacagcctgagcgagggcggctgcagaccctgcacctgcaaccccgccggcagcctggacacctgcgaccccagaagcggcagatgcccctgcaaggagaacgtggagggcaacctgtgcgacagatgcagacccggcaccttcaacctgcagccccacaaccccgccggctgcagcagctgcttctgctacggccacagcaaggtgtgcgccagcaccgcccagttccaggtgcaccacatcctgagcgacttccaccagggcgccgagggctggtgggccagaagcgtgggcggcagcgagcaccccccccagtggagccccaacggcgtgctgctgagccccgaggacgaggaggagctgaccgcccccgagaagttcctgggcgaccagagattcagctacggccagcccctgatcctgaccttcagagtgccccccggcgacagccccctgcccgtgcagctgagactggagggcaccggcctggccctgagcctgagacacagcagcctgagcggcccccaggacgccggccaccccagagaggtggagctgagattccacctgcaggagaccagcgaggacgtggccccccccctgccccccttccacttccagagactgctggccaacctgaccagcctgagactgagagtgagccccggccccagccccgccggccccgtgttcctgaccgaggtgagactgaccagcgccagacccggcctgagcccccccgccagctgggtggagatctgcagctgccccaccggctacaccggccagttctgcgagagctgcgcccccggctacaagagagagatgccccagggcggcccctacgccagctgcgtgccctgcacctgcaaccagcacggcacctgcgaccccaacaccggcatctgcgtgtgcagccaccacaccgagggccccagctgcgagagatgcctgcccggcttctacggcaaccccttcgccggccaggccgacgactgccagccctgcccctgccccggccagagcgcctgcaccaccatccccgagagcagagaggtggtgtgcacccactgcccccccggccagagaggcagaagatgcgaggtgtgcgacgacggcttcttcggcgaccccctgggcctgttcggccacccccagccctgccaccagtgccagtgcagcggcaacgtggaccccaacgccgtgggcaactgcgaccccctgagcggccactgcctgagatgcctgcacaacaccaccggcgaccactgcgagcactgccaggagggcttctacggcagcgccctggcccccagacccgccgacaagtgcatgccctgcagctgccacccccagggcagcgtgagcgagcagatgccctgcgaccccgtgaccggccagtgcagctgcctgccccacgtgaccgccagagactgcagcagatgctaccccggcttcttcgacctgcagcccggcagaggctgcagaagctgcaagtgccaccccctgggcagccaggaggaccagtgccaccccaagaccggccagtgcacctgcagacccggcgtgaccggccaggcctgcgacagatgccagctgggcttcttcggcttcagcatcaagggctgcagagcctgcagatgcagccccctgggcgccgccagcgcccagtgccacgagaacggcacctgcgtgtgcagacccggcttcgagggctacaagtgcgacagatgccacgacaacttcttcctgaccgccgacggcacccactgccagcagtgccccagctgctacgccctggtgaaggaggaggccgccaagctgaaggccagactgaccctgaccgagggctggctgcagggcagcgactgcggcagcccctggggccccctggacatcctgctgggcgaggcccccagaggcgacgtgtaccagggccaccacctgctgcccggcgccagagaggccttcctggagcagatgatgagcctggagggcgccgtgaaggccgccagagagcagctgcagagactgaacaagggcgccagatgcgcccaggccggcagccagaagacctgcacccagctggccgacctggaggccgtgctggagagcagcgaggaggagatcctgcacgccgccgccatcctggccagcctggagatcccccaggagggccccagccagcccaccaagtggagccacctggccaccgaggccagagccctggccagaagccacagagacaccgccaccaagatcgccgccaccgcctggagagccctgctggccagcaacaccagctacgccctgctgtggaacctgctggagggcagagtggccctggagacccagagagacctggaggacagataccaggaggtgcaggccgcccagaaggccctgagaaccgccgtggccgaggtgctgcccgaggccgagagcgtgctggccaccgtgcagcaggtgggcgccgacaccgccccctacctggccctgctggccagccccggcgccctgccccagaagagcagagccgaggacctgggcctgaaggccaaggccctggagaagaccgtggccagctggcagcacatggccaccgaggccgccagaaccctgcagaccgccgcccaggccaccctgagacagaccgagcccctgaccaagctgcaccaggaggccagagccgccctgacccaggccagcagcagcgtgcaggccgccaccgtgaccgtgatgggcgccagaaccctgctggccgacctggagggcatgaagctgcagttccccagacccaaggaccaggccgccctgcagagaaaggccgacagcgtgagcgacagactgctggccgacaccagaaagaagaccaagcaggccgagagaatgctgggcaacgccgcccccctgagcagcagcgccaagaagaagggcagagaggccgaggtgctggccaaggacagcgccaagctggccaaggccctgctgagagagagaaagcaggcccacagaagagccagcagactgaccagccagacccaggccaccctgcagcaggccagccagcaggtgctggccagcgaggccagaagacaggagctggaggaggccgagagagtgggcgccggcctgagcgagatggagcagcagatcagagagagcagaatcagcctggagaaggacatcgagaccctgagcgagctgctggccagactgggcagcctggacacccaccaggcccccgcccaggccctgaacgagacccagtgggccctggagagactgagactgcagctgggcagccccggcagcctgcagagaaagctgagcctgctggagcaggagagccagcagcaggagctgcagatccagggcttcgagagcgacctggccgagatcagagccgacaagcagaacctggaggccatcctgcacagcctgcccgagaactgcgccagctggcagtag

SEQ ID NO: 86526 - DNA, 459 bp, Artificial Sequence
  Description of Artificial Sequence: Synthetic coding sequence
atgagactgcccctgagccacagccccgagcacgtggagatggccctgctgagcaacatcctggccgcctacagcttcgtgagcgagaaccccgagagagccgccctgtacttcgtgagcggcgtgtgcatcggcctggtgctgaccctggccgccctggtgatcagaatcagctgccacaccgactgcagaagaagacccggcaagaagttcctgcaggacagagagagcagcagcgacagcagcgacagcgaggacggcagcgaggacaccgtgagcgacctgagcgtgagaagacacagaagattcgagagaaccctgaacaagaacgtgttcaccagcgccgaggagctggagagagcccagagactggaggagagagagagaatcatcagagagatctggatgaacggccagcccgaggtgcccggcaccagaagcctgaacagatactactag

SEQ ID NO: 86527 - DNA, 1200 bp, Artificial Sequence
  Description of Artificial Sequence: Synthetic coding sequence
atggcccagagagccttccccaacccctacgccgactacaacaagagcctggccgagggctacttcgacgccgccggcagactgacccccgagttcagccagagactgaccaacaagatcagagagctgctgcagcagatggagagaggcctgaagagcgccgaccccagagacggcaccggctacaccggctgggccggcatcgccgtgctgtacctgcacctgtacgacgtgttcggcgaccccgcctacctgcagctggcccacggctacgtgaagcagagcctgaactgcctgaccaagagaagcatcaccttcctgtgcggcgacgccggccccctggccgtggccgccgtgctgtaccacaagatgaacaacgagaagcaggccgaggactgcatcaccagactgatccacctgaacaagatcgacccccacgcccccaacgagatgctgtacggcagaatcggctacatctacgccctgctgttcgtgaacaagaacttcggcgtggagaagatcccccagagccacatccagcagatctgcgagaccatcctgaccagcggcgagaacctggccagaaagagaaacttcaccgccaagagccccctgatgtacgagtggtaccaggagtactacgtgggcgccgcccacggcctggccggcatctactactacctgatgcagcccagcctgcaggtgagccagggcaagctgcacagcctggtgaagcccagcgtggactacgtgtgccagctgaagttccccagcggcaactaccccccctgcatcggcgacaacagagacctgctggtgcactggtgccacggcgcccccggcgtgatctacatgctgatccaggcctacaaggtgttcagagaggagaagtacctgtgcgacgcctaccagtgcgccgacgtgatctggcagtacggcctgctgaagaagggctacggcctgtgccacggcagcgccggcaacgcctacgccttcctgaccctgtacaacctgacccaggacatgaagtacctgtacagagcctgcaagttcgccgagtggtgcctggagtacggcgagcacggctgcagaacccccgacacccccttcagcctgttcgagggcatggccggcaccatctacttcctggccgacctgctggtgcccaccaaggccagattccccgccttcgagctgtag

SEQ ID NO: 86528 - DNA, 1200 bp, Artificial Sequence; identical to SEQ ID NO: 86527
  Description of Artificial Sequence: Synthetic coding sequence

SEQ ID NO: 86529 - DNA, 1200 bp, Artificial Sequence; identical to SEQ ID NO: 86527
  Description of Artificial Sequence: Synthetic coding sequence

SEQ ID NO: 86530 - DNA, 591 bp, Artificial Sequence
  Description of Artificial Sequence: Synthetic coding sequence
atggcccagagagccttccccaacccctacgccgactacaacaagagcctggccgagggctacttcgacgccgccggcagactgacccccgagttcagccagagactgaccaacaagatcagagagctgctgcagcagatggagagaggcctgaagagcgccgaccccagagacggcaccggctacaccggctgggccggcatcgccgtgctgtacctgcacctgtacgacgtgttcggcgaccccgcctacctgcagctggcccacggctacgtgaagcagagcctgaactgcctgaccaagagaagcatcaccttcctgtgcggcgacgccggccccctggccgtggccgccgtgctgtaccacaagatgaacaacgagaagcaggccgaggactgcatcaccagactgatccacctgaacaagatcgacccccacgcccccaacgagatgctgtacggcagaatcggctacatctacgccctgctgttcgtgaacaagaacttcggcgtggagaagatcccccagagccacatccagcagatctgcgagaccatcctgaccagcggcgagaacctggccagaaagtag

SEQ ID NO: 86531 - DNA, 1200 bp, Artificial Sequence; identical to SEQ ID NO: 86527
  Description of Artificial Sequence: Synthetic coding sequence

SEQ ID NO: 86532 - DNA, 1353 bp, Artificial Sequence
  Description of Artificial Sequence: Synthetic coding sequence
atgggcgagaccatgagcaagagactgaagctgcacctgggcggcgaggccgagatggaggagagagccttcgtgaaccccttccccgactacgaggccgccgccggcgccctgctggccagcggcgccgccgaggagaccggctgcgtgagaccccccgccaccaccgacgagcccggcctgcccttccaccaggacggcaagatcatccacaacttcatcagaagaatccagaccaagatcaaggacctgctgcagcagatggaggagggcctgaagaccgccgacccccacgactgcagcgcctacaccggctggaccggcatcgccctgctgtacctgcagctgtacagagtgacctgcgaccagacctacctgctgagaagcctggactacgtgaagagaaccctgagaaacctgaacggcagaagagtgaccttcctgtgcggcgacgccggccccctggccgtgggcgccgtgatctaccacaagctgagaagcgactgcgagagccaggagtgcgtgaccaagctgctgcagctgcagagaagcgtggtgtgccaggagagcgacctgcccgacgagctgctgtacggcagagccggctacctgtacgccctgctgtacctgaacaccgagatcggccccggcaccgtgtgcgagagcgccatcaaggaggtggtgaacgccatcatcgagagcggcaagaccctgagcagagaggagagaaagaccgagagatgccccctgctgtaccagtggcacagaaagcagtacgtgggcgccgcccacggcatggccggcatctactacatgctgatgcagcccgccgccaaggtggaccaggagaccctgaccgagatggtgaagcccagcatcgactacgtgagacacaagaagttcagaagcggcaactaccccagcagcctgagcaacgagaccgacagactggtgcactggtgccacggcgcccccggcgtgatccacatgctgatgcaggcctacaaggtgttcaaggaggagaagtacctgaaggaggccatggagtgcagcgacgtgatctggcagagaggcctgctgagaaagggctacggcatctgccacggcaccgccggcaacggctacagcttcctgagcctgtacagactgacccaggacaagaagtacctgtacagagcctgcaagttcgccgagtggtgcctggactacggcgcccacggctgcagaatccccgacagaccctacagcctgttcgagggcatggccggcgccatccacttcctgagcgacgtgctgggccccgagaccagcagattccccgccttcgagctggacagcagcaagagagactag

SEQ ID NO: 86533 - DNA, 2199 bp, Artificial Sequence
  Description of Artificial Sequence: Synthetic coding sequence
atgaccgagggcacctgcctgagaagaagaggcggcccctacaagaccgagcccgccaccgacctgggcagatggagactgaactgcgagagaggcagacagacctggacctacctgcaggacgagagagccggcagagagcagaccggcctggaggcctacgccctgggcctggacaccaagaactacttcaaggacctgcccaaggcccacaccgccttcgagggcgccctgaacggcatgaccttctacgtgggcctgcaggccgaggacggccactggaccggcgactacggcggccccctgttcctgctgcccggcctgctgatcacctgccacgtggccagaatccccctgcccgccggctacagagaggagatcgtgagatacctgagaagcgtgcagctgcccgacggcggctggggcctgcacatcgaggacaagagcaccgtgttcggcaccgccctgaactacgtgagcctgagaatcctgggcgtgggccccgacgaccccgacctggtgagagccagaaacatcctgcacaagaagggcggcgccgtggccatccccagctggggcaagttctggctggccgtgctgaacgtgtacagctgggagggcctgaacaccctgttccccgagatgtggctgttccccgactgggcccccgcccaccccagcaccctgtggtgccactgcagacaggtgtacctgcccatgagctactgctacgccgtgagactgagcgccgccgaggaccccctggtgcagagcctgagacaggagctgtacgtggaggacttcgccagcatcgactggctggcccagagaaacaacgtggcccccgacgagctgtacaccccccacagctggctgctgagagtggtgtacgccctgctgaacctgtacgagcaccaccacagcgcccacctgagacagagagccgtgcagaagctgtacgagcacatcgtggccgacgacagattcaccaagagcatcagcatcggccccatcagcaagaccatcaacatgctggtgagatggtacgtggacggccccgccagcaccgccttccaggagcacgtgagcagaatccccgactacctgtggatgggcctggacggcatgaagatgcagggcaccaacggcagccagatctgggacaccgccttcgccatccaggccctgctggaggccggcggccaccacagacccgagttcagcagctgcctgcagaaggcccacgagttcctgagactgagccaggtgcccgacaacccccccgactaccagaagtactacagacagatgagaaagggcggcttcagcttcagcaccctggactgcggctggatcgtgagcgactgcaccgccgaggccctgaaggccgtgctgctgctgcaggagaagtgcccccacgtgaccgagcacatccccagagagagactgtgcgacgccgtggccgtgctgctgaacatgagaaaccccgacggcggcttcgccacctacgagaccaagagaggcggccacctgctggagctgctgaaccccagcgaggtgttcggcgacatcatgatcgactacacctacgtggagtgcaccagcgccgtgatgcaggccctgaagtacttccacaagagattccccgagcacagagccgccgagatcagagagaccctgacccagggcctggagttctgcagaagacagcagagagccgacggcagctgggagggcagctggggcgtgtgcttcacctacggcacctggttcggcctggaggccttcgcctgcatgggccagacctacagagacggcaccgcctgcgccgaggtgagcagagcctgcgacttcctgctgagcagacagatggccgacggcggctggggcgaggacttcgagagctgcgaggagagaagatacctgcagagcgcccagagccagatccacaacacctgctgggccatgatgggcctgatggccgtgagacaccccgacatcgaggcccaggagagaggcgtgagatgcctgctggagaagcagctgcccaacggcgactggccccaggagaacatcgccggcgtgttcaacaagagctgcgccatcagctacaccagctacagaaacatcttccccatctgggccctgggcagattcagccagctgtaccccgagagagccctggccggccacccctag

SEQ ID NO: 86534 - DNA, 2199 bp, Artificial Sequence; identical to SEQ ID NO: 86533
  Description of Artificial Sequence: Synthetic coding sequence

SEQ ID NO: 86535 - DNA, 1959 bp, Artificial Sequence
  Description of Artificial Sequence: Synthetic coding sequence
atgaccttctacgtgggcctgcaggccgaggacggccactggaccggcgactacggcggccccctgttcctgctgcccggcctgctgatcacctgccacgtggccagaatccccctgcccgccggctacagagaggagatcgtgagatacctgagaagcgtgcagctgcccgacggcggctggggcctgcacatcgaggacaagagcaccgtgttcggcaccgccctgaactacgtgagcctgagaatcctgggcgtgggccccgacgaccccgacctggtgagagccagaaacatcctgcacaagaagggcggcgccgtggccatccccagctggggcaagttctggctggccgtgctgaacgtgtacagctgggagggcctgaacaccctgttccccgagatgtggctgttccccgactgggcccccgcccaccccagcaccctgtggtgccactgcagacaggtgtacctgcccatgagctactgctacgccgtgagactgagcgccgccgaggaccccctggtgcagagcctgagacaggagctgtacgtggaggacttcgccagcatcgactggctggcccagagaaacaacgtggcccccgacgagctgtacaccccccacagctggctgctgagagtggtgtacgccctgctgaacctgtacgagcaccaccacagcgcccacctgagacagagagccgtgcagaagctgtacgagcacatcgtggccgacgacagattcaccaagagcatcagcatcggccccatcagcaagaccatcaacatgctggtgagatggtacgtggacggccccgccagcaccgccttccaggagcacgtgagcagaatccccgactacctgtggatgggcctggacggcatgaagatgcagggcaccaacggcagccagatctgggacaccgccttcgccatccaggccctgctggaggccggcggccaccacagacccgagttcagcagctgcctgcagaaggcccacgagttcctgagactgagccaggtgcccgacaacccccccgactaccagaagtactacagacagatgagaaagggcggcttcagcttcagcaccctggactgcggctggatcgtgagcgactgcaccgccgaggccctgaaggccgtgctgctgctgcaggagaagtgcccccacgtgaccgagcacatccccagagagagactgtgcgacgccgtggccgtgctgctgaacatgagaaaccccgacggcggcttcgccacctacgagaccaagagaggcggccacctgctggagctgctgaaccccagcgaggtgttcggcgacatcatgatcgactacacctacgtggagtgcaccagcgccgtgatgcaggccctgaagtacttccacaagagattccccgagcacagagccgccgagatcagagagaccctgacccagggcctggagttctgcagaagacagcagagagccgacggcagctgggagggcagctggggcgtgtgcttcacctacggcacctggttcggcctggaggccttcgcctgcatgggccagacctacagagacggcaccgcctgcgccgaggtgagcagagcctgcgacttcctgctgagcagacagatggccgacggcggctggggcgaggacttcgagagctgcgaggagagaagatacctgcagagcgcccagagccagatccacaacacctgctgggccatgatgggcctgatggccgtgagacaccccgacatcgaggcccaggagagaggcgtgagatgcctgctggagaagcagctgcccaacggcgactggccccaggagaacatcgccggcgtgttcaacaagagctgcgccatcagctacaccagctacagaaacatcttccccatctgggccctgggcagattcagccagctgtaccccgagagagccctggccggccacccctag

SEQ ID NO: 86536 - DNA, 2166 bp, Artificial Sequence
  Description of Artificial Sequence: Synthetic coding sequence
atgaccgagggcacctgcctgagaagaagaggcggcccctacaagaccgagcccgccaccgacctgggcagatggagactgaactgcgagagaggcagacagacctggacctacctgcaggacgagagagccggcagagagcagaccggcctggaggcctacgccctgggcctggacaccaagaactacttcaaggacctgcccaaggcccacaccgccttcgagggcgccctgaacggcatgaccttctacgtgggcctgcaggccgaggacggccactggaccggcgactacggcggccccctgttcctgctgcccggcctgctgatcacctgccacgtggccagaatccccctgcccgccggctacagagaggagatcgtgagatacctgagacacatcgaggacaagagcaccgtgttcggcaccgccctgaactacgtgagcctgagaatcctgggcgtgggccccgacgaccccgacctggtgagagccagaaacatcctgcacaagaagggcggcgccgtggccatccccagctggggcaagttctggctggccgtgctgaacgtgtacagctgggagggcctgaacaccctgttccccgagatgtggctgttccccgactgggcccccgcccaccccagcaccctgtggtgccactgcagacaggtgtacctgcccatgagctactgctacgccgtgagactgagcgccgccgaggaccccctggtgcagagcctgagacaggagctgtacgtggaggacttcgccagcatcgactggctggcccagagaaacaacgtggcccccgacgagctgtacaccccccacagctggctgctgagagtggtgtacgccctgctgaacctgtacgagcaccaccacagcgcccacctgagacagagagccgtgcagaagctgtacgagcacatcgtggccgacgacagattcaccaagagcatcagcatcggccccatcagcaagaccatcaacatgctggtgagatggtacgtggacggccccgccagcaccgccttccaggagcacgtgagcagaatccccgactacctgtggatgggcctggacggcatgaagatgcagggcaccaacggcagccagatctgggacaccgccttcgccatccaggccctgctggaggccggcggccaccacagacccgagttcagcagctgcctgcagaaggcccacgagttcctgagactgagccaggtgcccgacaacccccccgactaccagaagtactacagacagatgagaaagggcggcttcagcttcagcaccctggactgcggctggatcgtgagcgactgcaccgccgaggccctgaaggccgtgctgctgctgcaggagaagtgcccccacgtgaccgagcacatccccagagagagactgtgcgacgccgtggccgtgctgctgaacatgagaaaccccgacggcggcttcgccacctacgagaccaagagaggcggccacctgctggagctgctgaaccccagcgaggtgttcggcgacatcatgatcgactacacctacgtggagtgcaccagcgccgtgatgcaggccctgaagtacttccacaagagattccccgagcacagagccgccgagatcagagagaccctgacccagggcctggagttctgcagaagacagcagagagccgacggcagctgggagggcagctggggcgtgtgcttcacctacggcacctggttcggcctggaggccttcgcctgcatgggccagacctacagagacggcaccgcctgcgccgaggtgagcagagcctgcgacttcctgctgagcagacagatggccgacggcggctggggcgaggacttcgagagctgcgaggagagaagatacctgcagagcgcccagagccagatccacaacacctgctgggccatgatgggcctgatggccgtgagacaccccgacatcgaggcccaggagagaggcgtgagatgcctgctggagaagcagctgcccaacggcgactggccccaggagaacatcgccggcgtgttcaacaagagctgcgccatcagctacaccagctacagaaacatcttccccatctgggccctgggcagattcagccagctgtaccccgagagagccctggccggccacccctag

SEQ ID NO: 86537 - DNA, 1977 bp, Artificial Sequence
  Description of Artificial Sequence: Synthetic coding sequence
atgggcagaagaagagcccccgccggcggcagcctgggcagagccctgatgagacaccagacccagagaagcagaagccacagacacaccgacagctggctgcacaccagcgagctgaacgacggctacgactggggcagactgaacctgcagagcgtgaccgagcagagcagcctggacgacttcctggccaccgccgagctggccggcaccgagttcgtggccgagaagctgaacatcaagttcgtgcccgccgaggccagaaccggcctgctgagcttcgaggagagccagagaatcaagaagctgcacgaggagaacaagcagttcctgtgcatccccagaagacccaactggaaccagaacaccacccccgaggagctgaagcaggccgagaaggacaacttcctggagtggagaagacagctggtgagactggaggaggagcagaagctgatcctgacccccttcgagagaaacctggacttctggagacagctgtggagagtgatcgagagaagcgacatcgtggtgcagatcgtggacgccagaaaccccctgctgttcagatgcgaggacctggagtgctacgtgaaggagatggacgccaacaaggagaacgtgatcctgatcaacaaggccgacctgctgaccgccgagcagagaagcgcctgggccatgtacttcgagaaggaggacgtgaaggtgatcttctggagcgccctggccggcgccatccccctgaacggcgacagcgaggaggaggccaacagagacgacagacagagcaacaccaccaagttcggccacagcagcttcgaccaggccgagatcagccacagcgagagcgagcacctgcccgccagagacagccccagcctgagcgagaaccccaccaccgacgaggacgacagcgagtacgaggactgccccgaggaggaggaggacgactggcagacctgcagcgaggaggacggccccaaggaggaggactgcagccaggactggaaggagagcagcaccgccgacagcgaggccagaagcagaaagaccccccagaagagacagatccacaacttcagccacctggtgagcaagcaggagctgctggagctgttcaaggagctgcacaccggcagaaaggtgaaggacggccagctgaccgtgggcctggtgggctaccccaacgtgggcaagagcagcaccatcaacaccatcatgggcaacaagaaggtgagcgtgagcgccacccccggccacaccaagcacttccagaccctgtacgtggagcccggcctgtgcctgtgcgactgccccggcctggtgatgcccagcttcgtgagcaccaaggccgagatgacctgcagcggcatcctgcccatcgaccagatgagagaccacgtgccccccgtgagcctggtgtgccagaacatccccagacacgtgctggaggccacctacggcatcaacatcatcacccccagagaggacgaggacccccacagaccccccaccagcgaggagctgctgaccgcctacggctacatgagaggcttcatgaccgcccacggccagcccgaccagcccagaagcgccagatacatcctgaaggactacgtgagcggcaagctgctgtactgccaccccccccccggcagagaccccgtgaccttccagcaccagcaccagagactgctggagaacaagatgaacagcgacgagatcaagatgcagctgggcagaaacaagaaggccaagcagatcgagaacatcgtggacaagaccttcttccaccaggagaacgtgagagccctgaccaagggcgtgcaggccgtgatgggctacaagcccggcagcggcgtggtgaccgccagcaccgccagcagcgagaacggcgccggcaagccctggaagaagcacggcaacagaaacaagaaggagaagagcagaagactgtacaagcacctggacatgtag

SEQ ID NO: 86538 - DNA, 333 bp, Artificial Sequence
  Description of Artificial Sequence: Synthetic coding sequence
atgagctgccagcagagccagcagcagtgccagcccccccccaagtgcacccccaagtgcccccccaagtgccccacccccaagtgcccccccaagtgcccccccaagtgcccccccgtgagcagctgctgcagcgtgagcagcggcggctgctgcggcagcagcagcggcggcggctgcagcagcggcggcggcggctgctgcctgagccaccacagaagacacagaagccacagacacagactgcagagcagcggctgctgcagccagcccagcggcggcagcagctgctgcggcggcgacagcggccagcacagcggcggctgctgctag

SEQ ID NO: 86539 - DNA, 333 bp, Artificial Sequence; identical to SEQ ID NO: 86538
  Description of Artificial Sequence: Synthetic coding sequence

SEQ ID NO: 86540 - DNA, 357 bp, Artificial Sequence
  Description of Artificial Sequence: Synthetic coding sequence
atgagctgccagcagaaccagcagcagtgccagcccccccccaagtgcatccccaagtgcccccccaagtgcctgacccccagatgcccccccaagtgcccccccaagtgcccccccgtgagcagctgctgcagcgtgagcagcggcggctgctgcggcagcagcagcggcggcagctgcggcagcagcagcggcggctgctgcagcagcggcggcggcggctgctgcctgagccaccacagaagaagaagaagccactgccacagaccccagagcagcggctgctgcagccagcccagcggcggcagcagctgctgcggcggcggcagcggccagcacagcggcggctgctgctag

SEQ ID NO: 86541 - DNA, 333 bp, Artificial Sequence
  Description of Artificial Sequence: Synthetic coding sequence
atgagctgccagcagaaccagcagcagtgccagcccccccccaagtgcatccccaagtgcccccccaagtgcctgacccccagatgcccccccaagtgcccccccaagtgcccccccgtgagcagctgctgcagcgtgagcagcggcggctgctgcggcagcagcagcggcggctgctgcagcagcggcggcggcggctgctgcctgagccaccacagaagaagaagaagccactgccacagaccccagagcagcggctgctgcagccagcccagcggcggcagcagctgctgcggcggcggcagcggccagcacagcggcggctgctgctag

SEQ ID NO: 86542 - DNA, 357 bp, Artificial Sequence
  Description of Artificial Sequence: Synthetic coding sequence
atgagctgccagcagagccagcagcagtgccagcccccccccaagtgcacccccaagtgcccccccaagtgccccacccccaagtgcccccccaagtgcccccccaagtgcccccccgtgagcagctgctgcagcgtgagcagcggcggctgctgcggcagcagcagcggcggcagctgcggcagcagcagcggcggctgctgcagcagcggcggcggcggctgctgcctgagccaccacagaagaagaagaagccactgccacagaccccagagcagcggctgctgcagccagcccagcggcggcagcagctgctgcggcggcggcagcggccagcacagcggcggctgctgctag

SEQ ID NO: 86543 - DNA, 345 bp, Artificial Sequence
  Description of Artificial Sequence: Synthetic coding sequence
atgagctgccagcagagccagcagcagtgccagcccccccccaagtgcacccccaagtgcacccccaagtgccccgcccccaagtgcccccccaagtgcccccccgtgagcagctgctgcagcgtgagcagcggcggctgctgcggcagcagcagcggcggcggctgcggcagcaacagcggcggctgctgcagcagcggcggcggcggctgctgcctgagccaccacagaagacacagaagccacagaagaagaccccagagcagcgactgctgcagccagcccagcggcggcagcagctgctgcggcggcggcagcagccagcacagcggcggctgctgctag

SEQ ID NO: 86544 - DNA, 357 bp, Artificial Sequence
  Description of Artificial Sequence: Synthetic coding sequence
atgagctgccagcagagccagcagcagtgccagcccccccccaagtgcacccccaagtgcccccccaagtgccccacccccaagtgcccccccaagtgcccccccaagtgcccccccgtgagcagctgctgcagcgtgagcagcggcggctgctgcggcagcagcagcggcggcagctgcggcagcagcagcggcggctgctgcagcagcggcggcggcggctgctgcctgagccaccacagacaccacagaagccacagacacagaccccagagcagcgactgctgcagccagcccagcggcggcagcagctgctgcggcggcggcagcggccagcacagcggcggctgctgctag

SEQ ID NO: 86545 - DNA, 357 bp, Artificial Sequence; identical to SEQ ID NO: 86544
  Description of Artificial Sequence: Synthetic coding sequence

SEQ ID NO: 86546 - DNA, 357 bp, Artificial Sequence
  Description of Artificial Sequence: Synthetic coding sequence
atgagctgccagcagagccagcagcagtgccagcccccccccaagtgcacccccaagtgcccccccaagtgccccacccccaagtgcccccccaagtgcccccccaagtgcccccccgtgagcagctgctgcagcgtgagcagcggcggctgctgcggcagcagcagcggcggctgctgcagcagcggcggcggcggctgctgcagcagcggcggcggcggctgctgcctgagccaccacagaagaagaagaagccacagacacagaccccagagcagcgactgctgcagccagcccagcgccggcagcagctgctgcggcggcggcagcggccagcacagcggcggctgctgctag

SEQ ID NO: 86547 - DNA, 321 bp, Artificial Sequence
  Description of Artificial Sequence: Synthetic coding sequence
atgagctgccagcagaaccagcagcagtgccagcccccccccaagtgcccccccaagtgcccccccaagtgcccccccaagtgcagaccccagtgccccgccccctgccccccccccgtgagcagctgctgcggccccagcagcggcggctgctgcggcagcagcagcggcggctgctgcagcagcggcggcggcggctgctgcctgagccaccacagacccagactgttccacagacacagacaccagagccccgactgctgcgagtgcgagcccagcggcggcagcggctgctgccacagcagcggcgactgctgctag

SEQ ID NO: 86548 - DNA, 333 bp, Artificial Sequence
  Description of Artificial Sequence: Synthetic coding sequence
atgagctgccagcagaaccagcagcagtgccagcccccccccaagtgcccccccaagtgcacccccaagtgcccccccaagtgcccccccaagtgcctgccccagtgccccgccccctgcagccccgccgtgagcagctgctgcggccccatcagcggcggctgctgcggccccagcagcggcggctgctgcaacagcggcgccggcggctgctgcctgagccaccacagacccagactgttccacagaagaagacaccagagccccgactgctgcgagagcgagcccagcggcggcagcggctgctgccacagcagcggcggctgctgctag

SEQ ID NO: 86549 - DNA, 333 bp, Artificial Sequence; identical to SEQ ID NO: 86548
  Description of Artificial Sequence: Synthetic coding sequence

SEQ ID NO: 86550 - DNA, 333 bp, Artificial Sequence
  Description of Artificial Sequence: Synthetic coding sequence
atgagctgccagcagaaccagcagcagtgccagcccccccccaagtgcccccccaagtgcacccccaagtgcccccccaagtgcccccccaagtgccccccccagtgccccgccccctgcttccccgccgtgagcagctgctgcggccccagcagcggcagctgctgcggccccagcagcggcggctgctgcagcagcggcgccggcggctgcagcctgagccaccacagacccagactgttccacagaagaagacaccagagccccgactgctgcgagagcgagcccagcggcggcagcggctgctgccacagcagcggcggctgctgctag

SEQ ID NO: 86551 - DNA, 333 bp, Artificial Sequence
  Description of Artificial Sequence: Synthetic coding sequence
atgagctgccagcagaaccagcagcagtgccagcccccccccaagtgcccccccaagtgcacccccaagtgcccccccaagtgcccccccaagtgccccccccagtgccccgccccctgcagccccgccgtgagcagctgctgcggccccagcagcggcagctgctgcggccccagcagcggcggctgctgcagcagcggcggcggcggctgctgcctgagccaccacagacccagactgttccacagaagaagacaccagagccccgactgctgcgagagcgagcccagcggcgccagcggctgctgccacagcagcggcggctgctgctag

SEQ ID NO: 86552 - DNA, 270 bp, Artificial Sequence
  Description of Artificial Sequence: Synthetic coding sequence
atgagctgccagcagaaccagcagcagtgccagcccccccccaagtgccccgccaagagccccgcccagtgcctgccccccgccagcagcagctgcgcccccagcagcggcggctgcggccccagcagcgagagaagctgctgcctgagccaccacagatgcagaagaagccacagatgcagatgccagagcagcaacagctgcgacagaggcagcggccagcagggcggcagcagcagctgcggccacagcagcgccggctgctgctag

SEQ ID NO: 86553 - DNA, 288 bp, Artificial Sequence
  Description of Artificial Sequence: Synthetic coding sequence
atgagctgccagcagaaccagcagcagtgccagcccctgcccaagtgccccagccccaagtgcccccccaagagcagcgcccagtgcctgccccccgccagcagctgctgcgcccccagacccggctgctgcggcggccccagcagcgagggcggctgctgcctgagccaccacagatgctgcagaagccacagatgcagaagacagagcagcaacagctgcgacagaggcagcggccagcaggacggcgccagcgactgcggctacggcagcggcggctgctgctag

SEQ ID NO: 86554 - DNA, 285 bp, Artificial Sequence
  Description of Artificial Sequence: Synthetic coding sequence
atgagctgccagcagaaccagcagcagtgccagcccccccccagctgccccagccccaagtgcccccccaagagccccgcccagtgcctgcccccccccagcagcgactgcgccctgagcagcggcggctgcggccccagcagcgagagcggctgctgcctgagccaccacagacacttcagaagccaccagtgcagaagacagagaagcaacagctgcgacagaggcagcggccagcagggcggcggcagctgcagaggccacggcagcggcggctgctgctag

SEQ ID NO: 86555 - DNA, 279 bp, Artificial Sequence
  Description of Artificial Sequence: Synthetic coding sequence
atgagctgccagcagaaccagcagcagtgccagcccccccccaagtgccccagccccaagtgcccccccaagagccccgtgcagtgcctgccccccgccagcagcggctgcgcccccagcagcggcggctgcggccccagcagcgagggcggctgcttcctgaaccaccacagaagacaccacagatgcagaagacagagacccaacagctgcgacagaggcagcggccagcagggcggcggcagcggctgcggccacggcagcggcggctgctgctag

SEQ ID NO: 86556 - DNA, 279 bp, Artificial Sequence
  Description of Artificial Sequence: Synthetic coding sequence
atgagctgccagcagaaccagaagcagtgccagcccccccccaagtgccccagccccaagtgcccccccaagaaccccgtgcagtgcctgccccccgccagcagcggctgcgcccccagcagcggcggctgcggccccagcagcgagggcggctgcttcctgaaccaccacagaagacaccacagatgcagaagacagagaagcaacagctgcgacagaggcagcggccagcagggcggcggcagcggctgctgccacggcagcggcggctgctgctag

SEQ ID NO: 86557 - DNA, 300 bp, Artificial Sequence
  Description of Artificial Sequence: Synthetic coding sequence
atgagctgccagcagaaccagcagcagtgccagcccccccccaagtgccccatccccaagtacccccccaagtgccccagcaagtgcgccagcagctgccccccccccatcagcagctgctgcggcagcagcagcggcggctgcggctgctgcagcagcgagggcggcggctgctgcctgagccaccacagacaccacagaagccactgccacagacccaagagcagcaactgctacggcagcggcagcggccagcagagcggcggcagcggctgctgcagcggcggcggctgctgctag

SEQ ID NO: 86558 - DNA, 300 bp, Artificial Sequence; identical to SEQ ID NO: 86557
  Description of Artificial Sequence: Synthetic coding sequence

SEQ ID NO: 86559 - DNA, 357 bp, Artificial Sequence
  Description of Artificial Sequence: Synthetic coding sequence
atgagctgccagcagagccagcagcagtgccagcccccccccaagtgcacccccaagtgcccccccaagtgcacccccaagtgcccccccaagtgcccccccaagtgccccccccagtgcagcgccccctgccccccccccgtgagcagctgctgcggcagcagcagcggcggctgctgcagcagcgagggcggcggctgctgcctgagccaccacagacccagacagagcctgagaagaagaccccagagcagcagctgctgcggcagcggcagcggccagcagagcggcggcagcagctgctgccacagcagcggcggcagcggctgctgccacagcagcggcggctgctgctag

SEQ ID NO: 86560 - DNA, 297 bp, Artificial Sequence
  Description of Artificial Sequence: Synthetic coding sequence
atgagcagcgacgacaagagcaagagcaacgaccccaagaccgagcccaagaactgcgaccccaagtgcgagcagaagtgcgagagcaagtgccagcccagctgcctgaagaagctgctgcagagatgcttcgagaagtgcccctgggagaagtgccccgccccccccaagtgcctgccctgccccagccagagccccagcagctgccccccccagccctgcaccaagccctgcccccccaagtgccccagcagctgcccccacgcctgcccccccccctgccccccccccgagtag

SEQ ID NO: 86561 - DNA, 1860 bp, Artificial Sequence
  Description of Artificial Sequence: Synthetic coding sequence
atgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86562 - DNA, 5169 bp, Artificial Sequence
  Description of Artificial Sequence: Synthetic coding sequence
atggccggcgcctggctgagatggggcctgctgctgtgggccggcctgctggccagcagcgcccacggcagactgagaagaatcacctacgtggtgcaccccggccccggcctggccgccggcgccctgcccctgagcggcccccccagaagcagaaccttcaacgtggccctgaacgccagatacagcagaagcagcgccgccgccggcgcccccagcagagccagccccggcgtgcccagcgagagaaccagaagaaccagcaagcccggcggcgccgccctgcagggcctgagacccccccccccccccccccccgagcccgccagacccgccgtgcccggcggccagctgcaccccaaccccggcggccaccccgccgccgcccccttcaccaagcagggcagacaggtggtgagaagcaaggtgccccaggagacccagagcggcggcggcagcagactgcaggtgcaccagaagcagcagctgcagggcgtgaacgtgtgcggcggcagatgctgccacggctggagcaaggcccccggcagccagagatgcaccaagcccagctgcgtgcccccctgccagaacggcggcatgtgcctgagaccccagctgtgcgtgtgcaagcccggcaccaagggcaaggcctgcgagaccatcgccgcccaggacaccagcagccccgtgttcggcggccagagccccggcgccgccagcagctggggcccccccgagcaggccgccaagcacaccagcagcaagaaggccgacaccctgcccagagtgagccccgtggcccagatgaccctgaccctgaagcccaagcccagcgtgggcctgccccagcagatccacagccaggtgacccccctgagcagccagagcgtggtgatccaccacggccagacccaggagtacgtgctgaagcccaagtacttccccgcccagaagggcatcagcggcgagcagagcaccgagggcagcttccccctgagatacgtgcaggaccaggtggccgcccccttccagctgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccgccttcaaggagatctgccccggcggcatgggctacaccgtgagcggcgtgcacagaagaagacccatccaccaccacgtgggcaagggccccgtgttcgtgaagcccaagaacacccagcccgtggccaagagcacccaccccccccccctgcccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccggcatcgtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacatcgacgagtgcgtgaacaacaccgtgtgcgacagccacggcttctgcgacaacaccgccggcagcttcagatgcctgtgctaccagggcttccaggccccccaggacggccagggctgcgtggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86563 - DNA, 4191 bp, Artificial Sequence
  Description of Artificial Sequence: Synthetic coding sequence
atggacaccaagctgatgtgcctgctgttcttcttcagcctgccccccctgctggtgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccgccttcaaggagatctgccccggcggcatgggctacaccgtgagcggcgtgcacagaagaagacccatccaccaccacgtgggcaagggccccgtgttcgtgaagcccaagaacacccagcccgtggccaagagcacccaccccccccccctgcccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccggcatcgtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacatcgacgagtgcgtgaacaacaccgtgtgcgacagccacggcttctgcgacaacaccgccggcagcttcagatgcctgtgctaccagggcttccaggccccccaggacggccagggctgcgtggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86564 - DNA, 5166 bp, Artificial Sequence
  Description of Artificial Sequence: Synthetic coding sequence
atggccggcgcctggctgagatggggcctgctgctgtgggccggcctgctggccagcagcgcccacggcagactgagaagaatcacctacgtggtgcaccccggccccggcctggccgccggcgccctgcccctgagcggcccccccagaagcagaaccttcaacgtggccctgaacgccagatacagcagaagcagcgccgccgccggcgcccccagcagagccagccccggcgtgcccagcgagagaaccagaagaaccagcaagcccggcggcgccgccctgcagggcctgagacccccccccccccccccccccgagcccgccagacccgccgtgcccggcggccagctgcaccccaaccccggcggccaccccgccgccgcccccttcaccaagcagggcagacaggtggtgagaagcaaggtgccccaggagacccagagcggcggcggcagcagactgcaggtgcaccagaagcagcagctgcagggcgtgaacgtgtgcggcggcagatgctgccacggctggagcaaggcccccggcagccagagatgcaccaagcccagctgcgtgcccccctgccagaacggcggcatgtgcctgagaccccagctgtgcgtgtgcaagcccggcaccaagggcaaggcctgcgagaccatcgccgcccaggacaccagcagccccgtgttcggcggccagagccccggcgccgccagcagctggggcccccccgagcaggccgccaagcacaccagcagcaagaaggccgacaccctgcccagagtgagccccgtggcccagatgaccctgaccctgaagcccaagcccagcgtgggcctgccccagcagatccacagccaggtgacccccctgagcagccagagcgtggtgatccaccacggccagacccaggagtacgtgctgaagcccaagtacttccccgcccagaagggcatcagcggcgagcagagcaccgagggcagcttccccctgagatacgtgcaggaccaggtggccgcccccttccagctgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccgccttcaaggagatctgccccggcggcatgggctacaccgtgagcggcgtgcacagaagaagacccatccaccaccacgtgggcaagggccccgtgttcgtgaagcccaagaacacccagcccgtggccaagagcacccaccccccccccctgcccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccgtggtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacatcgacgagtgcgtgaacaacaccgtgtgcgacagccacggcttctgcgacaacaccgccggcagcttcagatgcctgtgctaccagggcttccaggccccccaggacggccagggctgcgtggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86565 - DNA, 4188 bp, Artificial Sequence
  Description of Artificial Sequence: Synthetic coding sequence
atggacaccaagctgatgtgcctgctgttcttcttcagcctgccccccctgctggtgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccgccttcaaggagatctgccccggcggcatgggctacaccgtgagcggcgtgcacagaagaagacccatccaccaccacgtgggcaagggccccgtgttcgtgaagcccaagaacacccagcccgtggccaagagcacccaccccccccccctgcccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccgtggtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacatcgacgagtgcgtgaacaacaccgtgtgcgacagccacggcttctgcgacaacaccgccggcagcttcagatgcctgtgctaccagggcttccaggccccccaggacggccagggctgcgtggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86566 - DNA, 4062 bp, Artificial Sequence
  Description of Artificial Sequence: Synthetic coding sequence
atggacaccaagctgatgtgcctgctgttcttcttcagcctgccccccctgctggtgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccgccttcaaggagatctgccccggcggcatgggctacaccgtgagcggcgtgcacagaagaagacccatccaccaccacgtgggcaagggccccgtgttcgtgaagcccaagaacacccagcccgtggccaagagcacccaccccccccccctgcccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccgtggtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86567 - DNA, 4029 bp, Artificial Sequence
  Description of Artificial Sequence: Synthetic coding sequence
atggacaccaagctgatgtgcctgctgttcttcttcagcctgccccccctgctggtgagcaaccacaccggcagaatcaaggtggtgttcacccccagcatctgcaaggtgacctgcaccaagggcagctgccagaacagctgcgagaagggcaacaccaccaccctgatcagcgagaacggccacgccgccgacaccctgaccgccaccaacttcagagtggtgatctgccacctgccctgcatgaacggcggccagtgcagcagcagagacaagtgccagtgcccccccaacttcaccggcaagctgtgccagatccccgtgcacggcgccagcgtgcccaagctgtaccagcacagccagcagcccggcaaggccctgggcacccacgtgatccacagcacccacaccctgcccctgaccgtgaccagccagcagggcgtgaaggtgaagttcccccccaacatcgtgaacatccacgtgaagcacccccccgaggccagcgtgcagatccaccaggtgagcagaatcgacggccccaccggccagaagaccaaggaggcccagcccggccagagccaggtgagctaccagggcctgcccgtgcagaagacccagaccatccacagcacctacagccaccagcaggtgatcccccacgtgtaccccgtggccgccaagacccagctgggcagatgcttccaggagaccatcggcagccagtgcggcaaggccctgcccggcctgagcaagcaggaggactgctgcggcaccgtgggcaccagctggggcttcaacaagtgccagaagtgccccaagaagcccagctaccacggctacaaccagatgatggagtgcctgcccggctacaagagagtgaacaacaccttctgccaggacatcaacgagtgccagctgcagggcgtgtgccccaacggcgagtgcctgaacaccatgggcagctacagatgcacctgcaagatcggcttcggccccgaccccaccttcagcagctgcgtgcccgacccccccgtgatcagcgaggagaagggcccctgctacagactggtgagcagcggcagacagtgcatgcaccccctgagcgtgcacctgaccaagcagctgtgctgctgcagcgtgggcaaggcctggggcccccactgcgagaagtgccccctgcccggcaccgccaaggaggagcccgtggaggccctgaccttcagcagagagcacggccccggcgtggccgagcccgaggtggccaccgccccccccgagaaggagatccccagcctggaccaggagaagaccaagctggagcccggccagccccagctgagccccggcatcagcaccatccacctgcacccccagttccccgtggtgatcgagaagaccagcccccccgtgcccgtggaggtggcccccgaggccagcaccagcagcgccagccaggtgatcgcccccacccaggtgaccgagatcaacgagtgcaccgtgaaccccgacatctgcggcgccggccactgcatcaacctgcccgtgagatacacctgcatctgctacgagggctacagattcagcgagcagcagagaaagtgcgtggacatcgacgagtgcacccaggtgcagcacctgtgcagccagggcagatgcgagaacaccgagggcagcttcctgtgcatctgccccgccggcttcatggccagcgaggagggcaccaactgcatcgacgtggacgagtgcctgagacccgacgtgtgcggcgagggccactgcgtgaacaccgtgggcgccttcagatgcgagtactgcgacagcggctacagaatgacccagagaggcagatgcgaggacatcgacgagtgcctgaaccccagcacctgccccgacgagcagtgcgtgaacagccccggcagctaccagtgcgtgccctgcaccgagggcttcagaggctggaacggccagtgcctggacgtggacgagtgcctggagcccaacgtgtgcgccaacggcgactgcagcaacctggagggcagctacatgtgcagctgccacaagggctacaccagaacccccgaccacaagcactgcagagacatcgacgagtgccagcagggcaacctgtgcgtgaacggccagtgcaagaacaccgagggcagcttcagatgcacctgcggccagggctaccagctgagcgccgccaaggaccagtgcgaggacatcgacgagtgccagcacagacacctgtgcgcccacggccagtgcagaaacaccgagggcagcttccagtgcgtgtgcgaccagggctacagagccagcggcctgggcgaccactgcgaggacatcaacgagtgcctggaggacaagagcgtgtgccagagaggcgactgcatcaacaccgccggcagctacgactgcacctgccccgacggcttccagctggacgacaacaagacctgccaggacatcaacgagtgcgagcaccccggcctgtgcggcccccagggcgagtgcctgaacaccgagggcagcttccactgcgtgtgccagcagggcttcagcatcagcgccgacggcagaacctgcgaggacatcgacgagtgcgtgaacaacaccgtgtgcgacagccacggcttctgcgacaacaccgccggcagcttcagatgcctgtgctaccagggcttccaggccccccaggacggccagggctgcgtggacgtgaacgagtgcgagctgctgagcggcgtgtgcggcgaggccttctgcgagaacgtggagggcagcttcctgtgcgtgtgcgccgacgagaaccaggagtacagccccatgaccggccagtgcagaagcagaaccagcaccgacctggacgtggacgtggaccagcccaaggaggagaagaaggagtgctactacaacctgaacgacgccagcctgtgcgacaacgtgctggcccccaacgtgaccaagcaggagtgctgctgcaccagcggcgtgggctggggcgacaactgcgagatcttcccctgccccgtgctgggcaccgccgagttcaccgagatgtgccccaagggcaagggcttcgtgcccgccggcgagagcagcagcgaggccggcggcgagaactacaaggacgccgacgagtgcctgctgttcggccaggagatctgcaagaacggcttctgcctgaacaccagacccggctacgagtgctactgcaagcagggcacctactacgaccccgtgaagctgcagtgcttcgacatggacgagtgccaggaccccagcagctgcatcgacggccagtgcgtgaacaccgagggcagctacaactgcttctgcacccaccccatggtgctggacgccagcgagaagagatgcatcagacccgccgagagcaacgagcagatcgaggagaccgacgtgtaccaggacctgtgctgggagcacctgagcgacgagtacgtgtgcagcagacccctggtgggcaagcagaccacctacaccgagtgctgctgcctgtacggcgaggcctggggcatgcagtgcgccctgtgccccctgaaggacagcgacgactacgcccagctgtgcaacatccccgtgaccggcagaagacagccctacggcagagacgccctggtggacttcagcgagcagtacacccccgaggccgacccctacttcatccaggacagattcctgaacagcttcgaggagctgcaggccgaggagtgcggcatcctgaacggctgcgagaacggcagatgcgtgagagtgcaggagggctacacctgcgactgcttcgacggctaccacctggacaccgccaagatgacctgcgtggacgtgaacgagtgcgacgagctgaacaacagaatgagcctgtgcaagaacgccaagtgcatcaacaccgacggcagctacaagtgcctgtgcctgcccggctacgtgcccagcgacaagcccaactactgcacccccctgaacaccgccctgaacctggagaaggacagcgacctggagtag

SEQ ID NO: 86568 - DNA, 5466 bp, Artificial Sequence
  Description of Artificial Sequence: Synthetic coding sequence
atgagacccagaaccaaggccagaagccccggcagagccctgagaaacccctggagaggcttcctgcccctgaccctggccctgttcgtgggcgccggccacgcccagagagaccccgtgggcagatacgagcccgccggcggcgacgccaacagactgagaagacccggcggcagctaccccgccgccgccgccgccaaggtgtacagcctgttcagagagcaggacgcccccgtggccggcctgcagcccgtggagagagcccagcccggctggggcagccccagaagacccaccgaggccgaggccagaagacccagcagagcccagcagagcagaagagtgcagccccccgcccagaccagaagaagcacccccctgggccagcagcagcccgcccccagaaccagagccgcccccgccctgcccagactgggcaccccccagagaagcggcgccgccccccccaccccccccagaggcagactgaccggcagaaacgtgtgcggcggccagtgctgccccggctggaccaccgccaacagcaccaaccactgcatcaagcccgtgtgcgagcccccctgccagaacagaggcagctgcagcagaccccagctgtgcgtgtgcagaagcggcttcagaggcgccagatgcgaggaggtgatccccgacgaggagttcgacccccagaacagcagactggcccccagaagatgggccgagagaagccccaacctgagaagaagcagcgccgccggcgagggcaccctggccagagcccagccccccgccccccagagcccccccgccccccagagcccccccgccggcaccctgagcggcctgagccagacccaccccagccagcagcacgtgggcctgagcagaaccgtgagactgcaccccaccgccaccgccagcagccagctgagcagcaacgccctgccccccggccccggcctggagcagagagacggcacccagcaggccgtgcccctggagcaccccagcagcccctggggcctgaacctgaccgagaagatcaagaagatcaagatcgtgttcacccccaccatctgcaagcagacctgcgccagaggccactgcgccaacagctgcgagagaggcgacaccaccaccctgtacagccagggcggccacggccacgaccccaagagcggcttcagaatctacttctgccagatcccctgcctgaacggcggcagatgcatcggcagagacgagtgctggtgccccgccaacagcaccggcaagttctgccacctgcccatcccccagcccgacagagagccccccggcagaggcagcagacccagagccctgctggaggcccccctgaagcagagcaccttcaccctgcccctgagcaaccagctggccagcgtgaaccccagcctggtgaaggtgcacatccaccacccccccgaggccagcgtgcagatccaccaggtggcccaggtgagaggcggcgtggaggaggccctggtggagaacagcgtggagaccagaccccccccctggctgcccgccagccccggccacagcctgtgggacagcaacaacatccccgccagaagcggcgagccccccagacccctgccccccgccgcccccagacccagaggcctgctgggcagatgctacctgaacaccgtgaacggccagtgcgccaaccccctgctggagctgaccacccaggaggactgctgcggcagcgtgggcgccttctggggcgtgaccctgtgcgccccctgcccccccagacccgccagccccgtgatcgagaacggccagctggagtgcccccagggctacaagagactgaacctgacccactgccaggacatcaacgagtgcctgaccctgggcctgtgcaaggacgccgagtgcgtgaacaccagaggcagctacctgtgcacctgcagacccggcctgatgctggaccccagcagaagcagatgcgtgagcgacaaggccatcagcatgctgcagggcctgtgctacagaagcctgggccccggcacctgcaccctgcccctggcccagagaatcaccaagcagatctgctgctgcagcagagtgggcaaggcctggggcagcgagtgcgagaagtgccccctgcccggcaccgaggccttcagagagatctgccccgccggccacggctacacctacgccagcagcgacatcagactgagcatgagaaaggccgaggaggaggagctggccagaccccccagagagcagggccagagaagcagcggcgccctgcccggccccgccgagagacagcccctgagagtggtgaccgacacctggctggaggccggcaccatccccgacaagggcgacagccaggccggccaggtgaccaccagcgtgacccacgcccccgcctgggtgaccggcaacgccaccaccccccccatgcccgagcagggcatcgccgagatccaggaggagcaggtgacccccagcaccgacgtgctggtgaccctgagcacccccggcatcgacagatgcgccgccggcgccaccaacgtgtgcggccccggcacctgcgtgaacctgcccgacggctacagatgcgtgtgcagccccggctaccagctgcaccccagccaggcctactgcaccgacgacaacgagtgcctgagagacccctgcaagggcaagggcagatgcatcaacagagtgggcagctacagctgcttctgctaccccggctacaccctggccaccagcggcgccacccaggagtgccaggacatcaacgagtgcgagcagcccggcgtgtgcagcggcggccagtgcaccaacaccgagggcagctaccactgcgagtgcgaccagggctacatcatggtgagaaagggccactgccaggacatcaacgagtgcagacaccccggcacctgccccgacggcagatgcgtgaacagccccggcagctacacctgcctggcctgcgaggagggctacagaggccagagcggcagctgcgtggacgtgaacgagtgcctgacccccggcgtgtgcgcccacggcaagtgcaccaacctggagggcagcttcagatgcagctgcgagcagggctacgaggtgaccagcgacgagaagggctgccaggacgtggacgagtgcgccagcagagccagctgccccaccggcctgtgcctgaacaccgagggcagcttcgcctgcagcgcctgcgagaacggctactgggtgaacgaggacggcaccgcctgcgaggacctggacgagtgcgccttccccggcgtgtgccccagcggcgtgtgcaccaacaccgccggcagcttcagctgcaaggactgcgacggcggctacagacccagccccctgggcgacagctgcgaggacgtggacgagtgcgaggacccccagagcagctgcctgggcggcgagtgcaagaacaccgtgggcagctaccagtgcctgtgcccccagggcttccagctggccaacggcaccgtgtgcgaggacgtgaacgagtgcatgggcgaggagcactgcgccccccacggcgagtgcctgaacagccacggcagcttcttctgcctgtgcgcccccggcttcgtgagcgccgagggcggcaccagctgccaggacgtggacgagtgcgccaccaccgacccctgcgtgggcggccactgcgtgaacaccgagggcagcttcaactgcctgtgcgagaccggcttccagcccagccccgagagcggcgagtgcgtggacatcgacgagtgcgaggactacggcgaccccgtgtgcggcacctggaagtgcgagaacagccccggcagctacagatgcgtgctgggctgccagcccggcttccacatggcccccaacggcgactgcatcgacatcgacgagtgcgccaacgacaccatgtgcggcagccacggcttctgcgacaacaccgacggcagcttcagatgcctgtgcgaccagggcttcgagatcagccccagcggctgggactgcgtggacgtgaacgagtgcgagctgatgctggccgtgtgcggcgccgccctgtgcgagaacgtggagggcagcttcctgtgcctgtgcgccagcgacctggaggagtacgacgcccaggagggccactgcagacccagaggcgccggcggccagagcatgagcgaggcccccaccggcgaccacgcccccgcccccaccagaatggactgctacagcggccagaagggccacgccccctgcagcagcgtgctgggcagaaacaccacccaggccgagtgctgctgcacccagggcgccagctggggcgacgcctgcgacctgtgccccagcgaggacagcgccgagttcagcgagatctgccccagcggcaagggctacatccccgtggagggcgcctggaccttcggccagaccatgtacaccgacgccgacgagtgcgtgatcttcggccccggcctgtgccccaacggcagatgcctgaacaccgtgcccggctacgtgtgcctgtgcaaccccggcttccactacgacgccagccacaagaagtgcgaggaccacgacgagtgccaggacctggcctgcgagaacggcgagtgcgtgaacaccgagggcagcttccactgcttctgcagcccccccctgaccctggacctgagccagcagagatgcatgaacagcaccagcagcaccgaggacctgcccgaccacgacatccacatggacatctgctggaagaaggtgaccaacgacgtgtgcagcgagcccctgagaggccacagaaccacctacaccgagtgctgctgccaggacggcgaggcctggagccagcagtgcgccctgtgcccccccagaagcagcgaggtgtacgcccagctgtgcaacgtggccagaatcgaggccgagagagaggccggcgtgcacttcagacccggctacgagtacggccccggccccgacgacctgcactacagcatctacggccccgacggcgcccccttctacaactacctgggccccgaggacaccgtgcccgagcccgccttccccaacaccgccggccacagcgccgacagaacccccatcctggagagccccctgcagcccagcgagctgcagccccactacgtggccagccaccccgagccccccgccggcttcgagggcctgcaggccgaggagtgcggcatcctgaacggctgcgagaacggcagatgcgtgagagtgagagagggctacacctgcgactgcttcgagggcttccagctggacgccgcccacatggcctgcgtggacgtgaacgagtgcgacgacctgaacggccccgccgtgctgtgcgtgcacggctactgcgagaacaccgagggcagctacagatgccactgcagccccggctacgtggccgaggccggccccccccactgcaccgccaaggagtag

SEQ ID NO: 86569 - DNA, 3912 bp, Artificial Sequence
  Description of Artificial Sequence: Synthetic coding sequence
atgcccggccccagaggcgccgccggcggcctggcccccgagatgagaggcgccggcgccgccggcctgctggccctgctgctgctgctgctgctgctgctgctgggcctgggcggcagagtggagggcggccccgccggcgagagaggcgccggcggcggcggcgccctggccagagagagattcaaggtggtgttcgcccccgtgatctgcaagagaacctgcctgaagggccagtgcagagacagctgccagcagggcagcaacatgaccctgatcggcgagaacggccacagcaccgacaccctgaccggcagcggcttcagagtggtggtgtgccccctgccctgcatgaacggcggccagtgcagcagcagaaaccagtgcctgtgcccccccgacttcaccggcagattctgccaggtgcccgccggcggcgccggcggcggcaccggcggcagcggccccggcctgagcagaaccggcgccctgagcaccggcgccctgccccccctggcccccgagggcgacagcgtggccagcaagcacgccatctacgccgtgcaggtgatcgccgacccccccggccccggcgagggcccccccgcccagcacgccgccttcctggtgcccctgggccccggccagatcagcgccgaggtgcaggcccccccccccgtggtgaacgtgagagtgcaccacccccccgaggccagcgtgcaggtgcacagaatcgagagcagcaacgccgagagcgccgcccccagccagcacctgctgccccaccccaagcccagccaccccagaccccccacccagaagcccctgggcagatgcttccaggacaccctgcccaagcagccctgcggcagcaaccccctgcccggcctgaccaagcaggaggactgctgcggcagcatcggcaccgcctggggccagagcaagtgccacaagtgcccccagctgcagtacaccggcgtgcagaagcccggccccgtgagaggcgaggtgggcgccgactgcccccagggctacaagagactgaacagcacccactgccaggacatcaacgagtgcgccatgcccggcgtgtgcagacacggcgactgcctgaacaaccccggcagctacagatgcgtgtgcccccccggccacagcctgggccccagcagaacccagtgcatcgccgacaagcccgaggagaagagcctgtgcttcagactggtgagccccgagcaccagtgccagcaccccctgaccaccagactgaccagacagctgtgctgctgcagcgtgggcaaggcctggggcgccagatgccagagatgccccaccgacggcaccgccgccttcaaggagatctgccccgccggcaagggctaccacatcctgaccagccaccagaccctgaccatccagggcgagagcgacttcagcctgttcctgcaccccgacggcccccccaagccccagcagctgcccgagagccccagccaggcccccccccccgaggacaccgaggaggagagaggcgtgaccaccgacagccccgtgagcgaggagagaagcgtgcagcagagccaccccaccgccaccaccacccccgccagaccctaccccgagctgatcagcagacccagcccccccaccatgagatggttcctgcccgacctgccccccagcagaagcgccgtggagatcgcccccacccaggtgaccgagaccgacgagtgcagactgaaccagaacatctgcggccacggcgagtgcgtgcccggcccccccgactacagctgccactgcaaccccggctacagaagccacccccagcacagatactgcgtggacgtgaacgagtgcgaggccgagccctgcggccccggcagaggcatctgcatgaacaccggcggcagctacaactgccactgcaacagaggctacagactgcacgtgggcgccggcggcagaagctgcgtggacctgaacgagtgcgccaagccccacctgtgcggcgacggcggcttctgcatcaacttccccggccactacaagtgcaactgctaccccggctacagactgaaggccagcagaccccccgtgtgcgaggacatcgacgagtgcagagaccccagcagctgccccgacggcaagtgcgagaacaagcccggcagcttcaagtgcatcgcctgccagcccggctacagaagccagggcggcggcgcctgcagagacgtgaacgagtgcgccgagggcagcccctgcagccccggctggtgcgagaacctgcccggcagcttcagatgcacctgcgcccagggctacgcccccgcccccgacggcagaagctgcctggacgtggacgagtgcgaggccggcgacgtgtgcgacaacggcatctgcagcaacacccccggcagcttccagtgccagtgcctgagcggctaccacctgagcagagacagaagccactgcgaggacatcgacgagtgcgacttccccgccgcctgcatcggcggcgactgcatcaacaccaacggcagctacagatgcctgtgcccccagggccacagactggtgggcggcagaaagtgccaggacatcgacgagtgcagccaggaccccagcctgtgcctgccccacggcgcctgcaagaacctgcagggcagctacgtgtgcgtgtgcgacgagggcttcacccccacccaggaccagcacggctgcgaggaggtggagcagccccaccacaagaaggagtgctacctgaacttcgacgacaccgtgttctgcgacagcgtgctggccaccaacgtgacccagcaggagtgctgctgcagcctgggcgccggctggggcgaccactgcgagatctacccctgccccgtgtacagcagcgccgagttccacagcctgtgccccgacggcaagggctacacccaggacaacaacatcgtgaactacggcatccccgcccacagagacatcgacgagtgcatgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggacgtggacgagtgccaggaccccgccgcctgcagacccggcagatgcgtgaacctgcccggcagctacagatgcgagtgcagacccccctgggtgcccggccccagcggcagagactgccagctgcccgagagccccgccgagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggcagatgcgtgcccagacccggcggcgccgtgtgcgagtgccccggcggcttccagctggacgccagcagagccagatgcgtggacatcgacgagtgcagagagctgaaccagagaggcctgctgtgcaagagcgagagatgcgtgaacaccagcggcagcttcagatgcgtgtgcaaggccggcttcgccagaagcagaccccacggcgcctgcgtgccccagagaagaagatag

SEQ ID NO: 86570 - DNA, 792 bp, Artificial Sequence
  Description of Artificial Sequence: Synthetic coding sequence
atgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggacgtggacgagtgccaggaccccgccgcctgcagacccggcagatgcgtgaacctgcccggcagctacagatgcgagtgcagacccccctgggtgcccggccccagcggcagagactgccagctgcccgagagccccgccgagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcgccgccgcctgcagaggcagagccgccccctgcgccagcgtgcccgccgccagcagcagcaccccccccgcccccgccgcctggatcagcaccagcgccgagagctag

SEQ ID NO: 86571 - DNA, 3771 bp, Artificial Sequence
  Description of Artificial Sequence: Synthetic coding sequence
atgcccggccccagaggcgccgccggcggcctggcccccgagatgagaggcgccggcgccgccggcctgctggccctgctgctgctgctgctgctgctgctgctgggcctgggcggcagagtggagggcggccccgccggcgagagaggcgccggcggcggcggcgccctggccagagagagattcaaggtggtgttcgcccccgtgatctgcaagagaacctgcctgaagggccagtgcagagacagctgccagcagggcagcaacatgaccctgatcggcgagaacggccacagcaccgacaccctgaccggcagcggcttcagagtggtggtgtgccccctgccctgcatgaacggcggccagtgcagcagcagaaaccagtgcctgtgcccccccgacttcaccggcagattctgccaggtgcccgccggcggcgccggcggcggcaccggcggcagcggccccggcctgagcagaaccggcgccctgagcaccggcgccctgccccccctggcccccgagggcgacagcgtggccagcaagcacgccatctacgccgtgcaggtgatcgccgacccccccggccccggcgagggcccccccgcccagcacgccgccttcctggtgcccctgggccccggccagatcagcgccgaggtgcaggcccccccccccgtggtgaacgtgagagtgcaccacccccccgaggccagcgtgcaggtgcacagaatcgagagcagcaacgccgagagcgccgcccccagccagcacctgctgccccaccccaagcccagccaccccagaccccccacccagaagcccctgggcagatgcttccaggacaccctgcccaagcagccctgcggcagcaaccccctgcccggcctgaccaagcaggaggactgctgcggcagcatcggcaccgcctggggccagagcaagtgccacaagtgcccccagctgcagtacaccggcgtgcagaagcccggccccgtgagaggcgaggtgggcgccgactgcccccagggctacaagagactgaacagcacccactgccaggacatcaacgagtgcgccatgcccggcgtgtgcagacacggcgactgcctgaacaaccccggcagctacagatgcgtgtgcccccccggccacagcctgggccccagcagaacccagtgcatcgccgacaagcccgaggagaagagcctgtgcttcagactggtgagccccgagcaccagtgccagcaccccctgaccaccagactgaccagacagctgtgctgctgcagcgtgggcaaggcctggggcgccagatgccagagatgccccaccgacggcaccgccgccttcaaggagatctgccccgccggcaagggctaccacatcctgaccagccaccagaccctgaccatccagggcgagagcgacttcagcctgttcctgcaccccgacggcccccccaagccccagcagctgcccgagagccccagccaggcccccccccccgaggacaccgaggaggagagaggcgtgaccaccgacagccccgtgagcgaggagagaagcgtgcagcagagccaccccaccgccaccaccacccccgccagaccctaccccgagctgatcagcagacccagcccccccaccatgagatggttcctgcccgacctgccccccagcagaagcgccgtggagatcgcccccacccaggtgaccgagaccgacgagtgcagactgaaccagaacatctgcggccacggcgagtgcgtgcccggcccccccgactacagctgccactgcaaccccggctacagaagccacccccagcacagatactgcgtggacgtgaacgagtgcgaggccgagccctgcggccccggcagaggcatctgcatgaacaccggcggcagctacaactgccactgcaacagaggctacagactgcacgtgggcgccggcggcagaagctgcgtggacctgaacgagtgcgccaagccccacctgtgcggcgacggcggcttctgcatcaacttccccggccactacaagtgcaactgctaccccggctacagactgaaggccagcagaccccccgtgtgcgaggacatcgacgagtgcagagaccccagcagctgccccgacggcaagtgcgagaacaagcccggcagcttcaagtgcatcgcctgccagcccggctacagaagccagggcggcggcgcctgcagagacgtgaacgagtgcgccgagggcagcccctgcagccccggctggtgcgagaacctgcccggcagcttcagatgcacctgcgcccagggctacgcccccgcccccgacggcagaagctgcctggacgtggacgagtgcgaggccggcgacgtgtgcgacaacggcatctgcagcaacacccccggcagcttccagtgccagtgcctgagcggctaccacctgagcagagacagaagccactgcgaggacatcgacgagtgcgacttccccgccgcctgcatcggcggcgactgcatcaacaccaacggcagctacagatgcctgtgcccccagggccacagactggtgggcggcagaaagtgccaggacatcgacgagtgcagccaggaccccagcctgtgcctgccccacggcgcctgcaagaacctgcagggcagctacgtgtgcgtgtgcgacgagggcttcacccccacccaggaccagcacggctgcgaggaggtggagcagccccaccacaagaaggagtgctacctgaacttcgacgacaccgtgttctgcgacagcgtgctggccaccaacgtgacccagcaggagtgctgctgcagcctgggcgccggctggggcgaccactgcgagatctacccctgccccgtgtacagcagcgccgagttccacagcctgtgccccgacggcaagggctacacccaggacaacaacatcgtgaactacggcatccccgcccacagagacatcgacgagtgcatgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggcagatgcgtgcccagacccggcggcgccgtgtgcgagtgccccggcggcttccagctggacgccagcagagccagatgcgtggacatcgacgagtgcagagagctgaaccagagaggcctgctgtgcaagagcgagagatgcgtgaacaccagcggcagcttcagatgcgtgtgcaaggccggcttcgccagaagcagaccccacggcgcctgcgtgccccagagaagaagatag

SEQ ID NO: 86572 - DNA, 921 bp, Artificial Sequence
  Description of Artificial Sequence: Synthetic coding sequence
atgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggacgtggacgagtgccaggaccccgccgcctgcagacccggcagatgcgtgaacctgcccggcagctacagatgcgagtgcagacccccctgggtgcccggccccagcggcagagactgccagctgcccgagagccccgccgagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggcagatgcgtgcccagacccggcggcgccgtgtgcgagtgccccggcggcttccagctggacgccagcagagccagatgcgtggacatcgacgagtgcagagagctgaaccagagaggcctgctgtgcaagagcgagagatgcgtgaacaccagcggcagcttcagatgcgtgtgcaaggccggcttcgccagaagcagaccccacggcgcctgcgtgccccagagaagaagatag

SEQ ID NO: 86573 - DNA, 3414 bp, Artificial Sequence
  Description of Artificial Sequence: Synthetic coding sequence
atgaccctgatcggcgagaacggccacagcaccgacaccctgaccggcagcggcttcagagtggtggtgtgccccctgccctgcatgaacggcggccagtgcagcagcagaaaccagtgcctgtgcccccccgacttcaccggcagattctgccaggtgcccgccggcggcgccggcggcggcaccggcggcagcggccccggcctgagcagaaccggcgccctgagcaccggcgccctgccccccctggcccccgagggcgacagcgtggccagcaagcacgccatctacgccgtgcaggtgatcgccgacccccccggccccggcgagggcccccccgcccagcacgccgccttcctggtgcccctgggccccggccagatcagcgccgaggtgcaggcccccccccccgtggtgaacgtgagagtgcaccacccccccgaggccagcgtgcaggtgcacagaatcgagagcagcaacgccgagagcgccgcccccagccagcacctgctgccccaccccaagcccagccaccccagaccccccacccagaagcccctgggcagatgcttccaggacaccctgcccaagcagccctgcggcagcaaccccctgcccggcctgaccaagcaggaggactgctgcggcagcatcggcaccgcctggggccagagcaagtgccacaagtgcccccagctgcagtacaccggcgtgcagaagcccggccccgtgagaggcgaggtgggcgccgactgcccccagggctacaagagactgaacagcacccactgccaggacatcaacgagtgcgccatgcccggcgtgtgcagacacggcgactgcctgaacaaccccggcagctacagatgcgtgtgcccccccggccacagcctgggccccagcagaacccagtgcatcgccgacaagcccgaggagaagagcctgtgcttcagactggtgagccccgagcaccagtgccagcaccccctgaccaccagactgaccagacagctgtgctgctgcagcgtgggcaaggcctggggcgccagatgccagagatgccccaccgacggcaccgccgccttcaaggagatctgccccgccggcaagggctaccacatcctgaccagccaccagaccctgaccatccagggcgagagcgacttcagcctgttcctgcaccccgacggcccccccaagccccagcagctgcccgagagccccagccaggcccccccccccgaggacaccgaggaggagagaggcgtgaccaccgacagccccgtgagcgaggagagaagcgtgcagcagagccaccccaccgccaccaccacccccgccagaccctaccccgagctgatcagcagacccagcccccccaccatgagatggttcctgcccgacctgccccccagcagaagcgccgtggagatcgcccccacccaggtgaccgagaccgacgagtgcagactgaaccagaacatctgcggccacggcgagtgcgtgcccggcccccccgactacagctgccactgcaaccccggctacagaagccacccccagcacagatactgcgtggacgtgaacgagtgcgaggccgagccctgcggccccggcagaggcatctgcatgaacaccggcggcagctacaactgccactgcaacagaggctacagactgcacgtgggcgccggcggcagaagctgcgtggacctgaacgagtgcgccaagccccacctgtgcggcgacggcggcttctgcatcaacttccccggccactacaagtgcaactgctaccccggctacagactgaaggccagcagaccccccgtgtgcgaggacatcgacgagtgcagagaccccagcagctgccccgacggcaagtgcgagaacaagcccggcagcttcaagtgcatcgcctgccagcccggctacagaagccagggcggcggcgcctgcagagacgtgaacgagtgcgccgagggcagcccctgcagccccggctggtgcgagaacctgcccggcagcttcagatgcacctgcgcccagggctacgcccccgcccccgacggcagaagctgcctggacgtggacgagtgcgaggccggcgacgtgtgcgacaacggcatctgcagcaacacccccggcagcttccagtgccagtgcctgagcggctaccacctgagcagagacagaagccactgcgaggacatcgacgagtgcgacttccccgccgcctgcatcggcggcgactgcatcaacaccaacggcagctacagatgcctgtgcccccagggccacagactggtgggcggcagaaagtgccaggacatcgacgagtgcagccaggaccccagcctgtgcctgccccacggcgcctgcaagaacctgcagggcagctacgtgtgcgtgtgcgacgagggcttcacccccacccaggaccagcacggctgcgaggaggtggagcagccccaccacaagaaggagtgctacctgaacttcgacgacaccgtgttctgcgacagcgtgctggccaccaacgtgacccagcaggagtgctgctgcagcctgggcgccggctggggcgaccactgcgagatctacccctgccccgtgtacagcagcgccgagttccacagcctgtgccccgacggcaagggctacacccaggacaacaacatcgtgaactacggcatccccgcccacagagacatcgacgagtgcatgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggacgtggacgagtgccaggaccccgccgcctgcagacccggcagatgcgtgaacctgcccggcagctacagatgcgagtgcagacccccctgggtgcccggccccagcggcagagactgccagctgcccgagagccccgccgagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggctag

SEQ ID NO: 86574 - DNA, 2202 bp, Artificial Sequence
  Description of Artificial Sequence: Synthetic coding sequence
atgcccgccgagaccgacgagtgcagactgaaccagaacatctgcggccacggcgagtgcgtgcccggcccccccgactacagctgccactgcaaccccggctacagaagccacccccagcacagatactgcgtggacgtgaacgagtgcgaggccgagccctgcggccccggcagaggcatctgcatgaacaccggcggcagctacaactgccactgcaacagaggctacagactgcacgtgggcgccggcggcagaagctgcgtggacctgaacgagtgcgccaagccccacctgtgcggcgacggcggcttctgcatcaacttccccggccactacaagtgcaactgctaccccggctacagactgaaggccagcagaccccccgtgtgcgaggacatcgacgagtgcagagaccccagcagctgccccgacggcaagtgcgagaacaagcccggcagcttcaagtgcatcgcctgccagcccggctacagaagccagggcggcggcgcctgcagagacgtgaacgagtgcgccgagggcagcccctgcagccccggctggtgcgagaacctgcccggcagcttcagatgcacctgcgcccagggctacgcccccgcccccgacggcagaagctgcctggacgtggacgagtgcgaggccggcgacgtgtgcgacaacggcatctgcagcaacacccccggcagcttccagtgccagtgcctgagcggctaccacctgagcagagacagaagccactgcgaggacatcgacgagtgcgacttccccgccgcctgcatcggcggcgactgcatcaacaccaacggcagctacagatgcctgtgcccccagggccacagactggtgggcggcagaaagtgccaggacatcgacgagtgcagccaggaccccagcctgtgcctgccccacggcgcctgcaagaacctgcagggcagctacgtgtgcgtgtgcgacgagggcttcacccccacccaggaccagcacggctgcgaggaggtggagcagccccaccacaagaaggagtgctacctgaacttcgacgacaccgtgttctgcgacagcgtgctggccaccaacgtgacccagcaggagtgctgctgcagcctgggcgccggctggggcgaccactgcgagatctacccctgccccgtgtacagcagcgccgagttccacagcctgtgccccgacggcaagggctacacccaggacaacaacatcgtgaactacggcatccccgcccacagagacatcgacgagtgcatgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggacgtggacgagtgccaggaccccgccgcctgcagacccggcagatgcgtgaacctgcccggcagctacagatgcgagtgcagacccccctgggtgcccggccccagcggcagagactgccagctgcccgagagccccgccgagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggcagatgcgtgcccagacccggcggcgccgtgtgcgagtgccccggcggcttccagctggacgccagcagagccagatgcgtggacatcgacgagtgcagagagctgaaccagagaggcctgctgtgcaagagcgagagatgcgtgaacaccagcggcagcttcagatgcgtgtgcaaggccggcttcgccagaagcagaccccacggcgcctgcgtgccccagagaagaagatag

SEQ ID NO: 86575 - DNA, 2649 bp, Artificial Sequence
  Description of Artificial Sequence: Synthetic coding sequence
atgaccctgatcggcgagaacggccacagcaccgacaccctgaccggcagcggcttcagagtggccgacaagcccgaggagaagagcctgtgcttcagactggtgagccccgagcaccagtgccagcaccccctgaccaccagactgaccagacagctgtgctgctgcagcgtgggcaaggcctggggcgccagatgccagagatgccccaccgacggcaccgccgccttcaaggagatctgccccgccggcaagggctaccacatcctgaccagccaccagaccctgaccatccagggcgagagcgacttcagcctgttcctgcaccccgacggcccccccaagccccagcagctgcccgagagccccagccaggcccccccccccgaggacaccgaggaggagagaggcgtgaccaccgacagccccgtgagcgaggagagaagcgtgcagcagagccaccccaccgccaccaccacccccgccagaccctaccccgagctgatcagcagacccagcccccccaccatgagatggttcctgcccgacctgccccccagcagaagcgccgtggagatcgcccccacccaggtgaccgagaccgacgagtgcagactgaaccagaacatctgcggccacggcgagtgcgtgcccggcccccccgactacagctgccactgcaaccccggctacagaagccacccccagcacagatactgcgtggacgtgaacgagtgcgaggccgagccctgcggccccggcagaggcatctgcatgaacaccggcggcagctacaactgccactgcaacagaggctacagactgcacgtgggcgccggcggcagaagctgcgtggacctgaacgagtgcgccaagccccacctgtgcggcgacggcggcttctgcatcaacttccccggccactacaagtgcaactgctaccccggctacagactgaaggccagcagaccccccgtgtgcgaggacatcgacgagtgcagagaccccagcagctgccccgacggcaagtgcgagaacaagcccggcagcttcaagtgcatcgcctgccagcccggctacagaagccagggcggcggcgcctgcagagacgtgaacgagtgcgccgagggcagcccctgcagccccggctggtgcgagaacctgcccggcagcttcagatgcacctgcgcccagggctacgcccccgcccccgacggcagaagctgcctggacgtggacgagtgcgaggccggcgacgtgtgcgacaacggcatctgcagcaacacccccggcagcttccagtgccagtgcctgagcggctaccacctgagcagagacagaagccactgcgaggacatcgacgagtgcgacttccccgccgcctgcatcggcggcgactgcatcaacaccaacggcagctacagatgcctgtgcccccagggccacagactggtgggcggcagaaagtgccaggacatcgacgagtgcagccaggaccccagcctgtgcctgccccacggcgcctgcaagaacctgcagggcagctacgtgtgcgtgtgcgacgagggcttcacccccacccaggaccagcacggctgcgaggaggtggagcagccccaccacaagaaggagtgctacctgaacttcgacgacaccgtgttctgcgacagcgtgctggccaccaacgtgacccagcaggagtgctgctgcagcctgggcgccggctggggcgaccactgcgagatctacccctgccccgtgtacagcagcgccgagttccacagcctgtgccccgacggcaagggctacacccaggacaacaacatcgtgaactacggcatccccgcccacagagacatcgacgagtgcatgctgttcggcagcgagatctgcaaggagggcaagtgcgtgaacacccagcccggctacgagtgctactgcaagcagggcttctactacgacggcaacctgctggagtgcgtggacgtggacgagtgcctggacgagagcaactgcagaaacggcgtgtgcgagaacaccagaggcggctacagatgcgcctgcaccccccccgccgagtacagccccgcccagagacagtgcctgagccccgaggagatggagagagcccccgagagaagagacgtgtgctggagccagagaggcgaggacggcatgtgcgccggccccctggccggccccgccctgaccttcgacgactgctgctgcagacagggcagaggctggggcgcccagtgcagaccctgcccccccagaggcgccggcagccactgccccaccagccagagcgagagcaacagcttctgggacaccagccccctgctgctgggcaagccccccagagacgaggacagcagcgaggaggacagcgacgagtgcagatgcgtgagcggcagatgcgtgcccagacccggcggcgccgtgtgcgagtgccccggcggcttccagctggacgccagcagagccagatgcgtggacatcgacgagtgcagagagctgaaccagagaggcctgctgtgcaagagcgagagatgcgtgaacaccagcggcagcttcagatgcgtgtgcaaggccggcttcgccagaagcagaccccacggcgcctgcgtgccccagagaagaagatag

SEQ ID NO: 86576 - DNA, 4761 bp, Artificial Sequence
  Description of Artificial Sequence: Synthetic coding sequence
atgggcgacgtgaaggccctgctgttcgtggccgccgccagagccagaagactgggcggcgccgccgccagcgagagcctggccgtgagcgaggccttctgcagagtgagaagctgccagcccaagaagtgcgccggcccccagagatgcctgaaccccgtgcccgccgtgcccagccccagccccagcgtgagaaagagacaggtgagcctgaactggcagcccctgaccctgcaggaggccagagccctgctgaagagaagaagacccagaggccccggcggcagaggcctgctgagaagaagacccccccagagagcccccgccggcaaggcccccgtgctgtgccccctgatctgccacaacggcggcgtgtgcgtgaagcccgacagatgcctgtgcccccccgacttcgccggcaagttctgccagctgcacagcagcggcgccagaccccccgcccccgccgtgcccggcctgaccagaagcgtgtacaccatgcccctggccaaccacagagacgacgagcacggcgtggccagcatggtgagcgtgcacgtggagcacccccaggaggccagcgtggtggtgcaccaggtggagagagtgagcggcccctgggaggaggccgacgccgaggccgtggccagagccgaggccgccgccagagccgaggccgccgccccctacaccgtgctggcccagagcgcccccagagaggacggctacagcgacgccagcggcttcggctactgcttcagagagctgagaggcggcgagtgcgccagccccctgcccggcctgagaacccaggaggtgtgctgcagaggcgccggcctggcctggggcgtgcacgactgccagctgtgcagcgagagactgggcaacagcgagagagtgagcgcccccgacggcccctgccccaccggcttcgagagagtgaacggcagctgcgaggacgtggacgagtgcgccaccggcggcagatgccagcacggcgagtgcgccaacaccagaggcggctacacctgcgtgtgccccgacggcttcctgctggacagcagcagaagcagctgcatcagccagcacgtgatcagcgaggccaagggcccctgcttcagagtgctgagagacggcggctgcagcctgcccatcctgagaaacatcaccaagcagatctgctgctgcagcagagtgggcaaggcctggggcagaggctgccagctgtgcccccccttcggcagcgagggcttcagagagatctgccccgccggccccggctaccactacagcgccagcgacctgagatacaacaccagacccctgggccaggagccccccagagtgagcctgagccagcccagaaccctgcccgccaccagcagacccagcgccggcttcctgcccacccacagactggagcccagacccgagcccagacccgaccccagacccggccccgagctgcccctgcccagcatccccgcctggaccggccccgagatccccgagagcggccccagcagcggcatgtgccagagaaacccccaggtgtgcggccccggcagatgcatcagcagacccagcggctacacctgcgcctgcgacagcggcttcagactgagcccccagggcaccagatgcatcgacgtggacgagtgcagaagagtgccccccccctgcgcccccggcagatgcgagaacagccccggcagcttcagatgcgtgtgcggccccggcttcagagccggccccagagccgccgagtgcctggacgtggacgagtgccacagagtgccccccccctgcgacctgggcagatgcgagaacacccccggcagcttcctgtgcgtgtgccccgccggctaccaggccgccccccacggcgccagctgccaggacgtggacgagtgcacccagagccccggcctgtgcggcagaggcgcctgcaagaacctgcccggcagcttcagatgcgtgtgccccgccggcttcagaggcagcgcctgcgaggaggacgtggacgagtgcgcccaggagccccccccctgcggccccggcagatgcgacaacaccgccggcagcttccactgcgcctgccccgccggcttcagaagcagaggccccggcgccccctgccaggacgtggacgagtgcgccagaagcccccccccctgcacctacggcagatgcgagaacaccgagggcagcttccagtgcgtgtgccccatgggcttccagcccaacaccgccggcagcgagtgcgaggacgtggacgagtgcgagaaccacctggcctgccccggccaggagtgcgtgaacagccccggcagcttccagtgcagaacctgccccagcggccaccacctgcacagaggcagatgcaccgacgtggacgagtgcagcagcggcgcccccccctgcggcccccacggccactgcaccaacaccgagggcagcttcagatgcagctgcgcccccggctacagagcccccagcggcagacccggcccctgcgccgacgtgaacgagtgcctggagggcgacttctgcttcccccacggcgagtgcctgaacaccgacggcagcttcgcctgcacctgcgcccccggctacagacccggccccagaggcgccagctgcctggacgtggacgagtgcagcgaggaggacctgtgccagagcggcatctgcaccaacaccgacggcagcttcgagtgcatctgcccccccggccacagagccggccccgacctggccagctgcctggacgtggacgagtgcagagagagaggccccgccctgtgcggcagccagagatgcgagaacagccccggcagctacagatgcgtgagagactgcgaccccggctaccacgccggccccgagggcacctgcgacgacgtggacgagtgccaggagtacggccccgagatctgcggcgcccagagatgcgagaacacccccggcagctacagatgcacccccgcctgcgaccccggctaccagcccacccccggcggcggctgccaggacgtggacgagtgcagaaacagaagcttctgcggcgcccacgccgtgtgccagaacctgcccggcagcttccagtgcctgtgcgaccagtacgagggcgccagagacggcagacactgcgtggacgtgaacgagtgcgagaccctgcagggcgtgtgcggcgccgccctgtgcgagaacgtggagggcagcttcctgtgcgtgtgccccaacagccccgaggagttcgaccccatgaccggcagatgcgtgccccccagaaccagcgccggcaccttccccggcagccagccccaggcccccgccagccccgtgctgcccgccagacccccccccccccccctgcccagaagacccagcacccccagacagggccccgtgggcagcggcagaagagagtgctacttcgacaccgccgcccccgacgcctgcgacaacatcctggccagaaacgtgacctggcaggagtgctgctgcaccgtgggcgagggctggggcagcggctgcagaatccagcagtgccccggcaccgagaccgccgagtaccagagcctgtgcccccacggcagaggctacctggcccccagcggcgacctgagcctgagaagagacgtggacgagtgccagctgttcagagaccaggtgtgcaagagcggcgtgtgcgtgaacaccgcccccggctacagctgctactgcagcaacggctactactaccacacccagagactggagtgcatcgacaacgacgagtgcgccgacgaggagcccgcctgcgagggcggcagatgcgtgaacaccgtgggcagctaccactgcacctgcgagccccccctggtgctggacggcagccagagaagatgcgtgagcaacgagagccagagcctggacgacaacctgggcgtgtgctggcaggaggtgggcgccgacctggtgtgcagccaccccagactggacagacaggccacctacaccgagtgctgctgcctgtacggcgaggcctggggcatggactgcgccctgtgccccgcccaggacagcgacgacttcgaggccctgtgcaacgtgctgagaccccccgcctacagcccccccagacccggcggcttcggcctgccctacgagtacggccccgacctgggccccccctaccagggcctgccctacggccccgagctgtaccccccccccgccctgccctacgacccctacccccccccccccggccccttcgccagaagagaggccccctacggcgcccccagattcgacatgcccgacttcgaggacgacggcggcccctacggcgagagcgaggcccccgccccccccggccccggcaccagatggccctacagaagcagagacaccagaagaagcttccccgagcccgaggagccccccgagggcggcagctacgccggcagcctggccgagccctacgaggagctggaggccgaggagtgcggcatcctggacggctgcaccaacggcagatgcgtgagagtgcccgagggcttcacctgcagatgcttcgacggctacagactggacatgaccagaatggcctgcgtggacatcaacgagtgcgacgaggccgaggccgccagccccctgtgcgtgaacgccagatgcctgaacaccgacggcagcttcagatgcatctgcagacccggcttcgcccccacccaccagccccaccactgcgcccccgccagacccagagcctag

SEQ ID NO: 86577 - DNA, 561 bp, Artificial Sequence
  Description of Artificial Sequence: Synthetic coding sequence
atgctgggcggcgccggcggcggccccggcctgagaaccccctgccccgccgacgtggacgagtgcagcgaggaggacctgtgccagagcggcatctgcaccaacaccgacggcagcttcgagtgcatctgcccccccggccacagagccggccccgacctggccagctgcctggacgtggacgagtgcagagagagaggccccgccctgtgcggcagccagagatgcgagaacagccccggcagctacagatgcgtgagagactgcgaccccggctaccacgccggccccgagggcacctgcgacgacgtggacgagtgcagaaacagaagcttctgcggcgcccacgccgtgtgccagaacctgcccggcagcttccagtgcctgtgcgaccagtacgagggcgccagagacggcagacactgcgtggacgtgaacgagtgcgagaccctgcagggcgtgtgcggcgccgccctgtgcgagaacgtggagggcagcttcctgtgcgtgtgccccaacagccccgaggagttcgaccccatgaccggcagatgcgtgtag

SEQ ID NO: 86578 - DNA, 4872 bp, Artificial Sequence
  Description of Artificial Sequence: Synthetic coding sequence
atgcccagacccggcaccagcggcagaagacccctgctgctggtgctgctgctgcccctgttcgccgccgccaccagcgccgccagccccagccccagccccagccaggtggtggaggtgcccggcgtgcccagcagacccgccagcgtggccgtgtgcagatgctgccccggccagaccagcagaagaagcagatgcatcagagccttctgcagagtgagaagctgccagcccaagaagtgcgccggcccccagagatgcctgaaccccgtgcccgccgtgcccagccccagccccagcgtgagaaagagacaggtgagcctgaactggcagcccctgaccctgcaggaggccagagccctgctgaagagaagaagacccagaggccccggcggcagaggcctgctgagaagaagacccccccagagagcccccgccggcaaggcccccgtgctgtgccccctgatctgccacaacggcggcgtgtgcgtgaagcccgacagatgcctgtgcccccccgacttcgccggcaagttctgccagctgcacagcagcggcgccagaccccccgcccccgccgtgcccggcctgaccagaagcgtgtacaccatgcccctggccaaccacagagacgacgagcacggcgtggccagcatggtgagcgtgcacgtggagcacccccaggaggccagcgtggtggtgcaccaggtggagagagtgagcggcccctgggaggaggccgacgccgaggccgtggccagagccgaggccgccgccagagccgaggccgccgccccctacaccgtgctggcccagagcgcccccagagaggacggctacagcgacgccagcggcttcggctactgcttcagagagctgagaggcggcgagtgcgccagccccctgcccggcctgagaacccaggaggtgtgctgcagaggcgccggcctggcctggggcgtgcacgactgccagctgtgcagcgagagactgggcaacagcgagagagtgagcgcccccgacggcccctgccccaccggcttcgagagagtgaacggcagctgcgaggacgtggacgagtgcgccaccggcggcagatgccagcacggcgagtgcgccaacaccagaggcggctacacctgcgtgtgccccgacggcttcctgctggacagcagcagaagcagctgcatcagccagcacgtgatcagcgaggccaagggcccctgcttcagagtgctgagagacggcggctgcagcctgcccatcctgagaaacatcaccaagcagatctgctgctgcagcagagtgggcaaggcctggggcagaggctgccagctgtgcccccccttcggcagcgagggcttcagagagatctgccccgccggccccggctaccactacagcgccagcgacctgagatacaacaccagacccctgggccaggagccccccagagtgagcctgagccagcccagaaccctgcccgccaccagcagacccagcgccggcttcctgcccacccacagactggagcccagacccgagcccagacccgaccccagacccggccccgagctgcccctgcccagcatccccgcctggaccggccccgagatccccgagagcggccccagcagcggcatgtgccagagaaacccccaggtgtgcggccccggcagatgcatcagcagacccagcggctacacctgcgcctgcgacagcggcttcagactgagcccccagggcaccagatgcatcgacgtggacgagtgcagaagagtgccccccccctgcgcccccggcagatgcgagaacagccccggcagcttcagatgcgtgtgcggccccggcttcagagccggccccagagccgccgagtgcctggacgtggacgagtgccacagagtgccccccccctgcgacctgggcagatgcgagaacacccccggcagcttcctgtgcgtgtgccccgccggctaccaggccgccccccacggcgccagctgccaggacgtggacgagtgcacccagagccccggcctgtgcggcagaggcgcctgcaagaacctgcccggcagcttcagatgcgtgtgccccgccggcttcagaggcagcgcctgcgaggaggacgtggacgagtgcgcccaggagccccccccctgcggccccggcagatgcgacaacaccgccggcagcttccactgcgcctgccccgccggcttcagaagcagaggccccggcgccccctgccaggacgtggacgagtgcgccagaagcccccccccctgcacctacggcagatgcgagaacaccgagggcagcttccagtgcgtgtgccccatgggcttccagcccaacaccgccggcagcgagtgcgaggacgtggacgagtgcgagaaccacctggcctgccccggccaggagtgcgtgaacagccccggcagcttccagtgcagaacctgccccagcggccaccacctgcacagaggcagatgcaccgacgtggacgagtgcagcagcggcgcccccccctgcggcccccacggccactgcaccaacaccgagggcagcttcagatgcagctgcgcccccggctacagagcccccagcggcagacccggcccctgcgccgacgtgaacgagtgcctggagggcgacttctgcttcccccacggcgagtgcctgaacaccgacggcagcttcgcctgcacctgcgcccccggctacagacccggccccagaggcgccagctgcctggacgtggacgagtgcagcgaggaggacctgtgccagagcggcatctgcaccaacaccgacggcagcttcgagtgcatctgcccccccggccacagagccggccccgacctggccagctgcctggacgtggacgagtgcagagagagaggccccgccctgtgcggcagccagagatgcgagaacagccccggcagctacagatgcgtgagagactgcgaccccggctaccacgccggccccgagggcacctgcgacgacgtggacgagtgccaggagtacggccccgagatctgcggcgcccagagatgcgagaacacccccggcagctacagatgcacccccgcctgcgaccccggctaccagcccacccccggcggcggctgccaggacgtggacgagtgcagaaacagaagcttctgcggcgcccacgccgtgtgccagaacctgcccggcagcttccagtgcctgtgcgaccagtacgagggcgccagagacggcagacactgcgtggacgtgaacgagtgcgagaccctgcagggcgtgtgcggcgccgccctgtgcgagaacgtggagggcagcttcctgtgcgtgtgccccaacagccccgaggagttcgaccccatgaccggcagatgcgtgccccccagaaccagcgccggcaccttccccggcagccagccccaggcccccgccagccccgtgctgcccgccagacccccccccccccccctgcccagaagacccagcacccccagacagggccccgtgggcagcggcagaagagagtgctacttcgacaccgccgcccccgacgcctgcgacaacatcctggccagaaacgtgacctggcaggagtgctgctgcaccgtgggcgagggctggggcagcggctgcagaatccagcagtgccccggcaccgagaccgccgagtaccagagcctgtgcccccacggcagaggctacctggcccccagcggcgacctgagcctgagaagagacgtggacgagtgccagctgttcagagaccaggtgtgcaagagcggcgtgtgcgtgaacaccgcccccggctacagctgctactgcagcaacggctactactaccacacccagagactggagtgcatcgacaacgacgagtgcgccgacgaggagcccgcctgcgagggcggcagatgcgtgaacaccgtgggcagctaccactgcacctgcgagccccccctggtgctggacggcagccagagaagatgcgtgagcaacgagagccagagcctggacgacaacctgggcgtgtgctggcaggaggtgggcgccgacctggtgtgcagccaccccagactggacagacaggccacctacaccgagtgctgctgcctgtacggcgaggcctggggcatggactgcgccctgtgccccgcccaggacagcgacgacttcgaggccctgtgcaacgtgctgagaccccccgcctacagcccccccagacccggcggcttcggcctgccctacgagtacggccccgacctgggccccccctaccagggcctgccctacggccccgagctgtaccccccccccgccctgccctacgacccctacccccccccccccggccccttcgccagaagagaggccccctacggcgcccccagattcgacatgcccgacttcgaggacgacggcggcccctacggcgagagcgaggcccccgccccccccggccccggcaccagatggccctacagaagcagagacaccagaagaagcttccccgagcccgaggagccccccgagggcggcagctacgccggcagcctggccgagccctacgaggagctggaggccgaggagtgcggcatcctggacggctgcaccaacggcagatgcgtgagagtgcccgagggcttcacctgcagatgcttcgacggctacagactggacatgaccagaatggcctgcgtggacatcaacgagtgcgacgaggccgaggccgccagccccctgtgcgtgaacgccagatgcctgaacaccgacggcagcttcagatgcatctgcagacccggcttcgcccccacccaccagccccaccactgcgcccccgccagacccagagcctag

SEQ ID NO: 86579 - DNA, 1155 bp, Artificial Sequence
  Description of Artificial Sequence: Synthetic coding sequence
atgaccggcagatgcgtgccccccagaaccagcgccgacgtggacgagtgccagctgttcagagaccaggtgtgcaagagcggcgtgtgcgtgaacaccgcccccggctacagctgctactgcagcaacggctactactaccacacccagagactggagtgcatcgacaacgacgagtgcgccgacgaggagcccgcctgcgagggcggcagatgcgtgaacaccgtgggcagctaccactgcacctgcgagccccccctggtgctggacggcagccagagaagatgcgtgagcaacgagagccagagcctggacgacaacctgggcgtgtgctggcaggaggtgggcgccgacctggtgtgcagccaccccagactggacagacaggccacctacaccgagtgctgctgcctgtacggcgaggcctggggcatggactgcgccctgtgccccgcccaggacagcgacgacttcgaggccctgtgcaacgtgctgagaccccccgcctacagcccccccagacccggcggcttcggcctgccctacgagtacggccccgacctgggccccccctaccagggcctgccctacggccccgagctgtaccccccccccgccctgccctacgacccctacccccccccccccggccccttcgccagaagagaggccccctacggcgcccccagattcgacatgcccgacttcgaggacgacggcggcccctacggcgagagcgaggcccccgccccccccggccccggcaccagatggccctacagaagcagagacaccagaagaagcttccccgagcccgaggagccccccgagggcggcagctacgccggcagcctggccgagccctacgaggagctggaggccgaggagtgcggcatcctggacggctgcaccaacggcagatgcgtgagagtgcccgagggcttcacctgcagatgcttcgacggctacagactggacatgaccagaatggcctgcgtggacatcaacgagtgcgacgaggccgaggccgccagccccctgtgcgtgaacgccagatgcctgaacaccgacggcagcttcagatgcatctgcagacccggcttcgcccccacccaccagccccaccactgcgcccccgccagacccagagcctag

SEQ ID NO: 86580 - DNA, 4671 bp, Artificial Sequence
  Description of Artificial Sequence: Synthetic coding sequence
atggccggcggcgtgagactgctgtgggtgagcctgctggtgctgctggcccagctgggcccccagcccggcctgggcagactgggcgagagactgagagtgagattcacccccgtggtgtgcggcctgagatgcgtgcacggccccaccggcagcagatgcacccccacctgcgcccccagaaacgccaccagcgtggacagcggcgcccccggcggcgccgcccccggcggccccggcttcagagccttcctgtgccccctgatctgccacaacggcggcgtgtgcgtgaagcccgacagatgcctgtgcccccccgacttcgccggcaagttctgccagctgcacagcagcggcgccagaccccccgcccccgccgtgcccggcctgaccagaagcgtgtacaccatgcccctggccaaccacagagacgacgagcacggcgtggccagcatggtgagcgtgcacgtggagcacccccaggaggccagcgtggtggtgcaccaggtggagagagtgagcggcccctgggaggaggccgacgccgaggccgtggccagagccgaggccgccgccagagccgaggccgccgccccctacaccgtgctggcccagagcgcccccagagaggacggctacagcgacgccagcggcttcggctactgcttcagagagctgagaggcggcgagtgcgccagccccctgcccggcctgagaacccaggaggtgtgctgcagaggcgccggcctggcctggggcgtgcacgactgccagctgtgcagcgagagactgggcaacagcgagagagtgagcgcccccgacggcccctgccccaccggcttcgagagagtgaacggcagctgcgaggacgtggacgagtgcgccaccggcggcagatgccagcacggcgagtgcgccaacaccagaggcggctacacctgcgtgtgccccgacggcttcctgctggacagcagcagaagcagctgcatcagccagcacgtgatcagcgaggccaagggcccctgcttcagagtgctgagagacggcggctgcagcctgcccatcctgagaaacatcaccaagcagatctgctgctgcagcagagtgggcaaggcctggggcagaggctgccagctgtgcccccccttcggcagcgagggcttcagagagatctgccccgccggccccggctaccactacagcgccagcgacctgagatacaacaccagacccctgggccaggagccccccagagtgagcctgagccagcccagaaccctgcccgccaccagcagacccagcgccggcttcctgcccacccacagactggagcccagacccgagcccagacccgaccccagacccggccccgagctgcccctgcccagcatccccgcctggaccggccccgagatccccgagagcggccccagcagcggcatgtgccagagaaacccccaggtgtgcggccccggcagatgcatcagcagacccagcggctacacctgcgcctgcgacagcggcttcagactgagcccccagggcaccagatgcatcgacgtggacgagtgcagaagagtgccccccccctgcgcccccggcagatgcgagaacagccccggcagcttcagatgcgtgtgcggccccggcttcagagccggccccagagccgccgagtgcctggacgtggacgagtgccacagagtgccccccccctgcgacctgggcagatgcgagaacacccccggcagcttcctgtgcgtgtgccccgccggctaccaggccgccccccacggcgccagctgccaggacgtggacgagtgcacccagagccccggcctgtgcggcagaggcgcctgcaagaacctgcccggcagcttcagatgcgtgtgccccgccggcttcagaggcagcgcctgcgaggaggacgtggacgagtgcgcccaggagccccccccctgcggccccggcagatgcgacaacaccgccggcagcttccactgcgcctgccccgccggcttcagaagcagaggccccggcgccccctgccaggacgtggacgagtgcgccagaagcccccccccctgcacctacggcagatgcgagaacaccgagggcagcttccagtgcgtgtgccccatgggcttccagcccaacaccgccggcagcgagtgcgaggacgtggacgagtgcgagaaccacctggcctgccccggccaggagtgcgtgaacagccccggcagcttccagtgcagaacctgccccagcggccaccacctgcacagaggcagatgcaccgacgtggacgagtgcagcagcggcgcccccccctgcggcccccacggccactgcaccaacaccgagggcagcttcagatgcagctgcgcccccggctacagagcccccagcggcagacccggcccctgcgccgacgtgaacgagtgcctggagggcgacttctgcttcccccacggcgagtgcctgaacaccgacggcagcttcgcctgcacctgcgcccccggctacagacccggccccagaggcgccagctgcctggacgtggacgagtgcagcgaggaggacctgtgccagagcggcatctgcaccaacaccgacggcagcttcgagtgcatctgcccccccggccacagagccggccccgacctggccagctgcctggacgtggacgagtgcagagagagaggccccgccctgtgcggcagccagagatgcgagaacagccccggcagctacagatgcgtgagagactgcgaccccggctaccacgccggccccgagggcacctgcgacgacgtggacgagtgccaggagtacggccccgagatctgcggcgcccagagatgcgagaacacccccggcagctacagatgcacccccgcctgcgaccccggctaccagcccacccccggcggcggctgccaggacgtggacgagtgcagaaacagaagcttctgcggcgcccacgccgtgtgccagaacctgcccggcagcttccagtgcctgtgcgaccagtacgagggcgccagagacggcagacactgcgtggacgtgaacgagtgcgagaccctgcagggcgtgtgcggcgccgccctgtgcgagaacgtggagggcagcttcctgtgcgtgtgccccaacagccccgaggagttcgaccccatgaccggcagatgcgtgccccccagaaccagcgccggcaccttccccggcagccagccccaggcccccgccagccccgtgctgcccgccagacccccccccccccccctgcccagaagacccagcacccccagacagggccccgtgggcagcggcagaagagagtgctacttcgacaccgccgcccccgacgcctgcgacaacatcctggccagaaacgtgacctggcaggagtgctgctgcaccgtgggcgagggctggggcagcggctgcagaatccagcagtgccccggcaccgagaccgccgagtaccagagcctgtgcccccacggcagaggctacctggcccccagcggcgacctgagcctgagaagagacgtggacgagtgccagctgttcagagaccaggtgtgcaagagcggcgtgtgcgtgaacaccgcccccggctacagctgctactgcagcaacggctactactaccacacccagagactggagtgcatcgacaacgacgagtgcgccgacgaggagcccgcctgcgagggcggcagatgcgtgaacaccgtgggcagctaccactgcacctgcgagccccccctggtgctggacggcagccagagaagatgcgtgagcaacgagagccagagcctggacgacaacctgggcgtgtgctggcaggaggtgggcgccgacctggtgtgcagccaccccagactggacagacaggccacctacaccgagtgctgctgcctgtacggcgaggcctggggcatggactgcgccctgtgccccgcccaggacagcgacgacttcgaggccctgtgcaacgtgctgagaccccccgcctacagcccccccagacccggcggcttcggcctgccctacgagtacggccccgacctgggccccccctaccagggcctgccctacggccccgagctgtaccccccccccgccctgccctacgacccctacccccccccccccggccccttcgccagaagagaggccccctacggcgcccccagattcgacatgcccgacttcgaggacgacggcggcccctacggcgagagcgaggcccccgccccccccggccccggcaccagatggccctacagaagcagagacaccagaagaagcttccccgagcccgaggagccccccgagggcggcagctacgccggcagcctggccgagccctacgaggagctggaggccgaggagtgcggcatcctggacggctgcaccaacggcagatgcgtgagagtgcccgagggcttcacctgcagatgcttcgacggctacagactggacatgaccagaatggcctgcgtggacatcaacgagtgcgacgaggccgaggccgccagccccctgtgcgtgaacgccagatgcctgaacaccgacggcagcttcagatgcatctgcagacccggcttcgcccccacccaccagccccaccactgcgcccccgccagacccagagcctag

SEQ ID NO: 86581 - DNA, 2700 bp, Artificial Sequence
  Description of Artificial Sequence: Synthetic coding sequence
atgtgccagagaaacccccaggtgtgcggccccggcagatgcatcagcagacccagcggctacacctgcgcctgcgacagcggcttcagactgagcccccagggcaccagatgcatcgacgtggacgagtgcagaagagtgccccccccctgcgcccccggcagatgcgagaacagccccggcagcttcagatgcgtgtgcggccccggcttcagagccggccccagagccgccgagtgcctggacgtggacgagtgccacagagtgccccccccctgcgacctgggcagatgcgagaacacccccggcagcttcctgtgcgtgtgccccgccggctaccaggccgccccccacggcgccagctgccaggacgtggacgagtgcacccagagccccggcctgtgcggcagaggcgcctgcaagaacctgcccggcagcttcagatgcgtgtgccccgccggcttcagaggcagcgcctgcgaggaggacgtggacgagtgcgcccaggagccccccccctgcggccccggcagatgcgacaacaccgccggcagcttccactgcgcctgccccgccggcttcagaagcagaggccccggcgccccctgccaggacgtggacgagtgcgccagaagcccccccccctgcacctacggcagatgcgagaacaccgagggcagcttccagtgcgtgtgccccatgggcttccagcccaacaccgccggcagcgagtgcgaggacgtggacgagtgcgagaaccacctggcctgccccggccaggagtgcgtgaacagccccggcagcttccagtgcagaacctgccccagcggccaccacctgcacagaggcagatgcaccgacgtggacgagtgcagcagcggcgcccccccctgcggcccccacggccactgcaccaacaccgagggcagcttcagatgcagctgcgcccccggctacagagcccccagcggcagacccggcccctgcgccgacgtgaacgagtgcctggagggcgacttctgcttcccccacggcgagtgcctgaacaccgacggcagcttcgcctgcacctgcgcccccggctacagacccggccccagaggcgccagctgcctggacgtggacgagtgcagcgaggaggacctgtgccagagcggcatctgcaccaacaccgacggcagcttcgagtgcatctgcccccccggccacagagccggccccgacctggccagctgcctggacgtggacgagtgcagagagagaggccccgccctgtgcggcagccagagatgcgagaacagccccggcagctacagatgcgtgagagactgcgaccccggctaccacgccggccccgagggcacctgcgacgacgtgaacgagtgcgagaccctgcagggcgtgtgcggcgccgccctgtgcgagaacgtggagggcagcttcctgtgcgtgtgccccaacagccccgaggagttcgaccccatgaccggcagatgcgtgccccccagaaccagcgccggcaccttccccggcagccagccccaggcccccgccagccccgtgctgcccgccagacccccccccccccccctgcccagaagacccagcacccccagacagggccccgtgggcagcggcagaagagagtgctacttcgacaccgccgcccccgacgcctgcgacaacatcctggccagaaacgtgacctggcaggagtgctgctgcaccgtgggcgagggctggggcagcggctgcagaatccagcagtgccccggcaccgagaccgccgagtaccagagcctgtgcccccacggcagaggctacctggcccccagcggcgacctgagcctgagaagagacgtggacgagtgccagctgttcagagaccaggtgtgcaagagcggcgtgtgcgtgaacaccgcccccggctacagctgctactgcagcaacggctactactaccacacccagagactggagtgcatcgacaacgacgagtgcgccgacgaggagcccgcctgcgagggcggcagatgcgtgaacaccgtgggcagctaccactgcacctgcgagccccccctggtgctggacggcagccagagaagatgcgtgagcaacgagagccagagcctggacgacaacctgggcgtgtgctggcaggaggtgggcgccgacctggtgtgcagccaccccagactggacagacaggccacctacaccgagtgctgctgcctgtacggcgaggcctggggcatggactgcgccctgtgccccgcccaggacagcgacgacttcgaggccctgtgcaacgtgctgagaccccccgcctacagcccccccagacccggcggcttcggcctgccctacgagtacggccccgacctgggccccccctaccagggcctgccctacggccccgagctgtaccccccccccgccctgccctacgacccctacccccccccccccggccccttcgccagaagagaggccccctacggcgcccccagattcgacatgcccgacttcgaggacgacggcggcccctacggcgagagcgaggcccccgccccccccggccccggcaccagatggccctacagaagcagagacaccagaagaagcttccccgagcccgaggagccccccgagggcggcagctacgccggcagcctggccgagccctacgaggagctgtag

SEQ ID NO: 86582 - DNA, 639 bp, Artificial Sequence
  Description of Artificial Sequence: Synthetic coding sequence
atgtggaccagcgccaccgcctgcagaagaagagtgaccagcggcgccgccagaaccagacaggccgccagctgcgcctgcgccccccccggcaccagactgcacagaaccgagcccgccgccagaatgtggatgagcgtgcccgaggccccccaccccgcccccaccgccggcgtgagaacccagaaggccgccagcagcgtgagcgccccctgggccagcaaccccaccctgctggcccccaacgtggacgagtgcgagaaccacctggcctgccccggccaggagtgcgtgaacagccccggcagcttccagtgcagaacctgccccagcggccaccacctgcacagaggcagatgcaccgacgtggacgagtgcagcagcggcgcccccccctgcggcccccacggccactgcaccaacaccgagggcagcttcagatgcagctgcgcccccggctacagagcccccagcggcagacccggcccctgcgccgacgtgaacgagtgcctggagggcgacttctgcttcccccacggcgagtgcctgaacaccgacggcagcttcgcctgcacctgcgcccccggctacagacccggccccagaggcgccagctgcctgggcagctaccccggctag

SEQ ID NO: 86583 - DNA, 669 bp, Artificial Sequence
  Description of Artificial Sequence: Synthetic coding sequence
atggagatcccccccaccaactaccccgccagcagagccgccctggtggcccagaactacatcaactaccagcagggcaccccccacagagtgttcgaggtgcagaaggtgaagcaggccagcatggaggacatccccggcagaggccacaagtaccacctgaagttcgccgtggaggagatcatccagaagcaggtgaaggtgaactgcaccgccgaggtgctgtaccccagcaccggccaggagaccgcccccgaggtgaacttcaccttcgagggcgagaccggcaagaaccccgacgaggaggacaacaccttctaccagagactgaagagcatgaaggagcccctggaggcccagaacatccccgacaacttcggcaacgtgagccccgagatgaccctggtgctgcacctggcctgggtggcctgcggctacatcatctggcagaacagcaccgaggacacctggtacaagatggtgaagatccagaccgtgaagcaggtgcagagaaacgacgacttcatcgagctggactacaccatcctgctgcacaacatcgccagccaggagatcatcccctggcagatgcaggtgctgtggcacccccagtacggcaccaaggtgaagcacaacagcagactgcccaaggaggtgcagctggagtag

SEQ ID NO: 86584 - DNA, 888 bp, Artificial Sequence
  Description of Artificial Sequence: Synthetic coding sequence
atgggcctgcccgtgagctgggccccccccgccctgtgggtgctgggctgctgcgccctgctgctgagcctgtgggccctgtgcaccgcctgcagaagacccgaggacgccgtggcccccagaaagagagccagaagacagagagccagactgcagggcagcgccaccgccgccgaggccagcctgctgagaagaacccacctgtgcagcctgagcaagagcgacaccagactgcacgagctgcacagaggccccagaagcagcagagccctgagacccgccagcatggacctgctgagaccccactggctggaggtgagcagagacatcaccggcccccaggccgcccccagcgccttcccccaccaggagctgcccagagccctgcccgccgccgccgccaccgccggctgcgccggcctggaggccacctacagcaacgtgggcctggccgccctgcccggcgtgagcctggccgccagccccgtggtggccgagtacgccagagtgcagaagagaaagggcacccacagaagcccccaggagccccagcagggcaagaccgaggtgacccccgccgcccaggtggacgtgctgtacagcagagtgtgcaagcccaagagaagagaccccggccccaccaccgaccccctggaccccaagggccagggcgccatcctggccctggccggcgacctggcctaccagaccctgcccctgagagccctggacgtggacagcggccccctggagaacgtgtacgagagcatcagagagctgggcgaccccgccggcagaagcagcacctgcggcgccggcaccccccccgccagcagctgccccagcctgggcagaggctggagacccctgcccgccagcctgccctag

SEQ ID NO: 86585 - DNA, 324 bp, Artificial Sequence
  Description of Artificial Sequence: Synthetic coding sequence
atgggcctgcccgtgagctgggccccccccgccctgtgggtgctgggctgctgcgccctgctgctgagcctgtgggccctgtgcaccgcctgcagaagacccgaggacgccgtggcccccagaaagagagccagaagacagagagccagactgcagggcagcgccaccgccgccgaggccagcctgctgagaagaacccacctgtgcagcctgagcaagagcgacaccagactgcacgagctgcacagaggccccagaagcagcagagccctgagacccgccagcatggacctgctgagaccccactggctggaggtgagctag

SEQ ID NO: 86586 - DNA, 2094 bp, Artificial Sequence
  Description of Artificial Sequence: Synthetic coding sequence
atgggcgagagagccggcagccccggcaccgaccaggagagaaaggccggcaagcaccactacagctacctgagcgacttcgagaccccccagagcagcggcagaagcagcctggtgagcagcagccccgccagcgtgagaagaaagaaccccaagagacagaccagcgacggccaggtgcaccaccaggcccccagaaagcccagccccaagggcctgcccaacagaaagggcgtgagagtgggcttcagaagccagagcctgaacagagagcccctgagaaaggacaccgacctggtgaccaagagaatcctgagcgccagactgctgaagatcaacgagctgcagaacgaggtgagcgagctgcaggtgaagctggccgagctgctgaaggagaacaagagcctgaagagactgcagtacagacaggagaaggccctgaacaagttcgaggacgccgagaacgagatcagccagctgatcttcagacacaacaacgagatcaccgccctgaaggagagactgagaaagagccaggagaaggagagagccaccgagaagagagtgaaggacaccgagagcgagctgttcagaaccaagttcagcctgcagaagctgaaggagatcagcgaggccagacacctgcccgagagagacgacctggccaagaagctggtgagcgccgagctgaagctggacgacaccgagagaagaatcaaggagctgagcaagaacctggagctgagcaccaacagcttccagagacagctgctggccgagagaaagagagcctacgaggcccacgacgagaacaaggtgctgcagaaggaggtgcagagactgtaccacaagctgaaggagaaggagagagagctggacatcaagaacatctacagcaacagactgcccaagagcagccccaacaaggagaaggagctggccctgagaaagaacgccgcctgccagagcgacttcgccgacctgtgcaccaagggcgtgcagaccatggaggacttcaagcccgaggagtaccccctgacccccgagaccatcatgtgctacgagaacaagtgggaggagcccggccacctgaccctggacctgcagagccagaagcaggacagacacggcgaggccggcatcctgaaccccatcatggagagagaggagaagttcgtgaccgacgaggagctgcacgtggtgaagcaggaggtggagaagctggaggacgagtgggagagagaggagctggacaagaagcagaaggagaaggccagcctgctggagagagaggagaagcccgagtgggagaccggcagataccagctgggcatgtaccccatccagaacatggacaagctgcagggcgaggaggaggagagactgaagagagagatgctgctggccaagctgaacgagatcgacagagagctgcaggacagcagaaacctgaagtaccccgtgctgcccctgctgcccgacttcgagagcaagctgcacagccccgagagaagccccaagacctacagattcagcgagagcagcgagagactgttcaacggccaccacctgcaggacatcagcttcagcacccccaagggcgagggccagaacagcggcaacgtgagaagccccgccagccccaacgagttcgccttcggcagctacgtgcccagcttcgccaagaccagcgagagaagcaaccccttcagccagaagagcagcttcctggacttccagagaaacagcatggagaagctgagcaaggacggcgtggacctgatcaccagaaaggagaagaaggccaacctgatggagcagctgttcggcgccagcggcagcagcaccatcagcagcaagagcagcgaccccaacagcgtggccagcagcaagggcgacatcgaccccctgaacttcctgcccggcaacaagggcagcagagaccaggagcacgacgaggacgagggcttcttcctgagcgagggcagaagcttcaaccccaacagacacagactgaagcacgccgacgacaagcccgccgtgaaggccgccgacagcgtggaggacgagatcgaggaggtggccctgagatag

SEQ ID NO: 86587 - DNA, 2094 bp, Artificial Sequence; identical to SEQ ID NO: 86586
  Description of Artificial Sequence: Synthetic coding sequence

SEQ ID NO: 86588 - DNA, 693 bp, Artificial Sequence
  Description of Artificial Sequence: Synthetic coding sequence
atgaagaaccccatgctggaggtggtgagcctgctgctggagaagctgctgctgatcagcaacttcaccctgttcagcagcggcgccgccggcgaggacaagggcagaaacagcttctacgagaccagcagcttccacagaggcgacgtgctggaggtgcccagaacccacctgacccactacggcatctacctgggcgacaacagagtggcccacatgatgcccgacatcctgctggccctgaccgacgacatgggcagaacccagaaggtggtgagcaacaagagactgatcctgggcgtgatcgtgaaggtggccagcatcagagtggacaccgtggaggacttcgcctacggcgccaacatcctggtgaaccacctggacgagagcctgcagaagaaggccctgctgaacgaggaggtggccagaagagccgagaagctgctgggcttcaccccctacagcctgctgtggaacaactgcgagcacttcgtgacctactgcagatacggcacccccatcagcccccagagcgacaagttctgcgagaccgtgaagatcatcatcagagaccagagaagcgtgctggccagcgccgtgctgggcctggccagcatcgtgtgcaccggcctggtgagctacaccaccctgcccgccatcttcatccccttcttcctgtggatggccggctag

SEQ ID NO: 86589 - DNA, 210 bp, Artificial Sequence
  Description of Artificial Sequence: Synthetic coding sequence
atgaagaaccccatgctggaggtggtgagcctgctgctggagaagctgctgctgatcagcaacttcaccctgttcagcagcggcgccgccggcgaggacaagggcagaaacagcttctacgagaccagcagcttccacagaggcgacgtgctggaggtgcccagaacccacctgacccactacggcatctacctgggcgacaacagatag

SEQ ID NO: 86590 - DNA, 693 bp, Artificial Sequence; identical to SEQ ID NO: 86588
  Description of Artificial Sequence: Synthetic coding sequence

SEQ ID NO: 86591 - DNA, 1110 bp, Artificial Sequence
  Description of Artificial Sequence: Synthetic coding sequence
atggtgtgggcccccctgggcccccccagaaccgactgcctgaccctgctgcacacccccagcaaggacagccccaagatgagcctggagtggctggtggcctggagctggagcctggacggcctgagagactgcatcgccaccggcatccagagcgtgagagactgcgacaccaccgccgtgatcaccgtggcctgcctgctggtgctgttcgtgtggtactgctaccacgtgggcagagagcagcccagaccctacgtgagcgtgaacagcctgatgcaggccgccgacgccaacggcctgcagaacggctacgtgtactgccagagccccgagtgcgtgagatgcacccacaacgagggcctgaaccagaagctgtaccacaacctgcaggagtacgccaagagatacagctggagcggcatgggcagaatccacaagggcatcagagagcagggcagatacctgaacagcagacccagcatccagaagcccgaggtgttcttcctgcccgacctgcccaccaccccctacttcagcagagacgcccagaagcacgacgtggaggtgctggagagaaacttccagaccatcctgtgcgagttcgagaccctgtacaaggccttcagcaactgcagcctgccccagggctggaagatgaacagcacccccagcggcgagtggttcaccttctacctggtgaaccagggcgtgtgcgtgcccagaaactgcagaaagtgccccagaacctacagactgctgggcagcctgagaacctgcatcggcaacaacgtgttcggcaacgcctgcatcagcgtgctgagccccggcaccgtgatcaccgagcactacggccccaccaacatcagaatcagatgccacctgggcctgaagacccccaacggctgcgagctggtggtgggcggcgagccccagtgctgggccgagggcagatgcctgctgttcgacgacagcttcctgcacgccgccttccacgagggcagcgccgaggacggccccagagtggtgttcatggtggacctgtggcaccccaacgtggccgccgccgagagacaggccctggacttcatcttcgcccccggcagatag

SEQ ID NO: 86592 - DNA, 984 bp, Artificial Sequence
  Description of Artificial Sequence: Synthetic coding sequence
atgagccagcccagcggcggcagagcccccggcaccagaatctacagctggagctgccccaccgtgatgagccccggcgagaagctggaccccatccccgacagcttcatcctgcagccccccgtgttccaccccgtggtgccctacgtgaccaccatcttcggcggcctgcacgccggcaagatggtgatgctgcagggcgtggtgcccctggacgcccacagattccaggtggacttccagtgcggctgcagcctgtgccccagacccgacatcgccttccacttcaaccccagattccacaccaccaagccccacgtgatctgcaacaccctgcacggcggcagatggcagagagaggccagatggccccacctggccctgagaagaggcagcagcttcctgatcctgttcctgttcggcaacgaggaggtgaaggtgagcgtgaacggccagcacttcctgcacttcagatacagactgcccctgagccacgtggacaccctgggcatcttcggcgacatcctggtggaggccgtgggcttcctgaacatcaaccccttcgtggagggcagcagagagtaccccgccggccacgaggtgccctgcagccacgccctgccccagggcctgagccccggccaggtgatcatcgtgagaggcctggtgctgcaggagcccaagcacttcaccgtgagcctgagagaccaggccgcccacgcccccgtgaccctgagagccagcttcgccgacagaaccctggcctggatcagcagatggggccagaagaagctgatcagcgcccccttcctgttctacccccagagattcttcgaggtgctgctgctgttccaggagggcggcctgaagctggccctgaacggccagggcctgggcgccaccagcatgaaccagcaggccctggagcagctgagagagctgagaatcagcggcagcgtgcagctgtactgcgtgcacagctag

SEQ ID NO: 86593 - DNA, 1014 bp, Artificial Sequence
  Description of Artificial Sequence: Synthetic coding sequence
atgagccagcccagcggcggcagagcccccggcaccagaatctacagctggagctgccccaccgtgatgagccccggcgagaagctggaccccatccccgacagcttcatcctgcagccccccgtgttccaccccgtggtgccctacgtgaccaccatcttcggcggcctgcacgccggcaagatggtgatgctgcagggcgtggtgcccctggacgcccacagcagattccaggtggacttccagtgcggctgcagcctgtgccccagacccgacatcgccttccacttcaaccccagattccacaccaccaagccccacgtgatctgcaacaccctgcacggcggcagatggcagagagaggccagatggccccacctggccctgagaagaggcagcagcttcctgatcctgttcctgttcggcaacgaggaggtgaaggtgagcgtgaacggccagcacttcctgcacttcagatacagactgcccctgagccacgtggacaccctgggcatcttcggcgacatcctggtggaggccgtgggcttcctgaacatcaaccccttcgtggagggcagcagagagtaccccgccggccaccccttcctgctgatgagccccagactggaggtgccctgcagccacgccctgccccagggcctgagccccggccaggtgatcatcgtgagaggcctggtgctgcaggagcccaagcacttcaccgtgagcctgagagaccaggccgcccacgcccccgtgaccctgagagccagcttcgccgacagaaccctggcctggatcagcagatggggccagaagaagctgatcagcgcccccttcctgttctacccccagagattcttcgaggtgctgctgctgttccaggagggcggcctgaagctggccctgaacggccagggcctgggcgccaccagcatgaaccagcaggccctggagcagctgagagagctgagaatcagcggcagcgtgcagctgtactgcgtgcacagctag

SEQ ID NO: 86594 - DNA, 1011 bp, Artificial Sequence
  Description of Artificial Sequence: Synthetic coding sequence
atgagccagcccagcggcggcagagcccccggcaccagaatctacagctggagctgccccaccgtgatgagccccggcgagaagctggaccccatccccgacagcttcatcctgcagccccccgtgttccaccccgtggtgccctacgtgaccaccatcttcggcggcctgcacgccggcaagatggtgatgctgcagggcgtggtgcccctggacgcccacagattccaggtggacttccagtgcggctgcagcctgtgccccagacccgacatcgccttccacttcaaccccagattccacaccaccaagccccacgtgatctgcaacaccctgcacggcggcagatggcagagagaggccagatggccccacctggccctgagaagaggcagcagcttcctgatcctgttcctgttcggcaacgaggaggtgaaggtgagcgtgaacggccagcacttcctgcacttcagatacagactgcccctgagccacgtggacaccctgggcatcttcggcgacatcctggtggaggccgtgggcttcctgaacatcaaccccttcgtggagggcagcagagagtaccccgccggccaccccttcctgctgatgagccccagactggaggtgccctgcagccacgccctgccccagggcctgagccccggccaggtgatcatcgtgagaggcctggtgctgcaggagcccaagcacttcaccgtgagcctgagagaccaggccgcccacgcccccgtgaccctgagagccagcttcgccgacagaaccctggcctggatcagcagatggggccagaagaagctgatcagcgcccccttcctgttctacccccagagattcttcgaggtgctgctgctgttccaggagggcggcctgaagctggccctgaacggccagggcctgggcgccaccagcatgaaccagcaggccctggagcagctgagagagctgagaatcagcggcagcgtgcagctgtactgcgtgcacagctag

SEQ ID NO: 86595 - DNA, 828 bp, Artificial Sequence
  Description of Artificial Sequence: Synthetic coding sequence
atggtgatgctgcagggcgtggtgcccctggacgcccacagattccaggtggacttccagtgcggctgcagcctgtgccccagacccgacatcgccttccacttcaaccccagattccacaccaccaagccccacgtgatctgcaacaccctgcacggcggcagatggcagagagaggccagatggccccacctggccctgagaagaggcagcagcttcctgatcctgttcctgttcggcaacgaggaggtgaaggtgagcgtgaacggccagcacttcctgcacttcagatacagactgcccctgagccacgtggacaccctgggcatcttcggcgacatcctggtggaggccgtgggcttcctgaacatcaaccccttcgtggagggcagcagagagtaccccgccggccaccccttcctgctgatgagccccagactggaggtgccctgcagccacgccctgccccagggcctgagccccggccaggtgatcatcgtgagaggcctggtgctgcaggagcccaagcacttcaccgtgagcctgagagaccaggccgcccacgcccccgtgaccctgagagccagcttcgccgacagaaccctggcctggatcagcagatggggccagaagaagctgatcagcgcccccttcctgttctacccccagagattcttcgaggtgctgctgctgttccaggagggcggcctgaagctggccctgaacggccagggcctgggcgccaccagcatgaaccagcaggccctggagcagctgagagagctgagaatcagcggcagcgtgcagctgtactgcgtgcacagctag

SEQ ID NO: 86596 - DNA, 801 bp, Artificial Sequence
  Description of Artificial Sequence: Synthetic coding sequence
atggtgatgctgcagggcgtggtgcccctggacgcccacagattccaggtggacttccagtgcggctgcagcctgtgccccagacccgacatcgccttccacttcaaccccagattccacaccaccaagccccacgtgatctgcaacaccctgcacggcggcagatggcagagagaggccagatggccccacctggccctgagaagaggcagcagcttcctgatcctgttcctgttcggcaacgaggaggtgaaggtgagcgtgaacggccagcacttcctgcacttcagatacagactgcccctgagccacgtggacaccctgggcatcttcggcgacatcctggtggaggccgtgggcttcctgaacatcaaccccttcgtggagggcagcagagagtaccccgccggccacgaggtgccctgcagccacgccctgccccagggcctgagccccggccaggtgatcatcgtgagaggcctggtgctgcaggagcccaagcacttcaccgtgagcctgagagaccaggccgcccacgcccccgtgaccctgagagccagcttcgccgacagaaccctggcctggatcagcagatggggccagaagaagctgatcagcgcccccttcctgttctacccccagagattcttcgaggtgctgctgctgttccaggagggcggcctgaagctggccctgaacggccagggcctgggcgccaccagcatgaaccagcaggccctggagcagctgagagagctgagaatcagcggcagcgtgcagctgtactgcgtgcacagctag

SEQ ID NO: 86597 - DNA, 378 bp, Artificial Sequence
  Description of Artificial Sequence: Synthetic coding sequence
atggccgacgaggagctggaggccctgagaagacagagactggccgagctgcaggccaagcacggcgaccccggcgacgccgcccagcaggaggccaagcacagagaggccgagatgagaaacagcatcctggcccaggtgctggaccagagcgccagagccagactgagcaacctggccctggtgaagcccgagaagaccaaggccgtggagaactacctgatccagatggccagatacggccagctgagcgagaaggtgagcgagcagggcctgatcgagatcctgaagaaggtgagccagcagaccgagaagaccaccaccgtgaagttcaacagaagaaaggtgatggacagcgacgaggacgacgactactag

SEQ ID NO: 86598 - DNA, 1530 bp, Artificial Sequence
  Description of Artificial Sequence: Synthetic coding sequence
atgggcgtgcaggccggcctgttcggcatgctgggcttcctgggcgtggccctgggcggcagccccgccctgagatggtacagaaccagctgccacctgaccaaggccgtgcccggcaaccccctgggctacctgagcttcctggccaaggacgcccagggcctggccctgatccacgccagatgggacgcccacagaagactgcagagctgcagctgggaggacgagcccgagctgaccgccgcctacggcgccctgtgcgcccacgagaccgcctggggcagcttcatccacacccccggccccgagctgcagagagccctggccaccctgcagagccagtgggaggcctgcagagccctggaggagagccccgccggcgccagaaagaagagagccgccggccagagcggcgtgcccggcggcggccaccagagagagaagagaggctggaccatgcccggcaccctgtggtgcggcgtgggcgacagcgccggcaacagcagcgagctgggcgtgttccagggccccgacctgtgctgcagagagcacgacagatgcccccagaacatcagccccctgcagtacaactacggcatcagaaactacagattccacaccatcagccactgcgactgcgacaccagattccagcagtgcctgcagaaccagcacgacagcatcagcgacatcgtgggcgtggccttcttcaacgtgctggagatcccctgcttcgtgctggaggagcaggaggcctgcgtggcctggtactggtggggcggctgcagaatgtacggcaccgtgcccctggccagactgcagcccagaaccttctacaacgccagctggagcagcagagccaccagccccacccccagcagcagaagccccgccccccccaagcccagacagaagcagcacctgagaaagggccccccccaccagaagggcagcaagagacccagcaaggccaacaccaccgccctgcaggaccccatggtgagccccagactggacgtggcccccaccggcctgcagggcccccagggcggcctgaagccccagggcgccagatgggtgtgcagaagcttcagaagacacctggaccagtgcgagcaccagatcggccccagagagatcgagttccagctgctgaacagcgcccaggagcccctgttccactgcaactgcaccagaagactggccagattcctgagactgcacagcccccccgaggtgaccaacatgctgtgggagctgctgggcaccacctgcttcaagctggccccccccctggactgcgtggagggcaagaactgcagcagagaccccagagccatcagagtgagcgccagacacctgagaagactgcagcagagaagacaccagctgcaggacaagggcaccgacgagagacagccctggcccagcgagcccctgagaggccccatgagcttctacaaccagtgcctgcagctgacccaggccgccagaagacccgacagacagcagaagagctggagccagtag

SEQ ID NO: 86599 - DNA, 93 bp, Artificial Sequence
  Description of Artificial Sequence: Synthetic coding sequence
atgaccggcgagctggaggtgaagaacatggacatgaagcccggcagcaccctgaagatcaccggcagcatcgccgacggcaccgacggctag

SEQ ID NO: 86600 - DNA, 1758 bp, Artificial Sequence
  Description of Artificial Sequence: Synthetic coding sequence
atgaccccccccagactgttctgggtgtggctgctggtggccggcacccagggcgtgaacgacggcgacatgagactggccgacggcggcgccaccaaccagggcagagtggagatcttctacagaggccagtggggcaccgtgtgcgacaacctgtgggacctgaccgacgccagcgtggtgtgcagagccctgggcttcgagaacgccacccaggccctgggcagagccgccttcggccagggcagcggccccatcatgctggacgaggtgcagtgcaccggcaccgaggccagcctggccgactgcaagagcctgggctggctgaagagcaactgcagacacgagagagacgccggcgtggtgtgcaccaacgagaccagaagcacccacaccctggacctgagcagagagctgagcgaggccctgggccagatcttcgacagccagagaggctgcgacctgagcatcagcgtgaacgtgcagggcgaggacgccctgggcttctgcggccacaccgtgatcctgaccgccaacctggaggcccaggccctgtggaaggagcccggcagcaacgtgaccatgagcgtggacgccgagtgcgtgcccatggtgagagacctgctgagatacttctacagcagaagaatcgacatcaccctgagcagcgtgaagtgcttccacaagctggccagcgcctacggcgccagacagctgcagggctactgcgccagcctgttcgccatcctgctgccccaggaccccagcttccagatgcccctggacctgtacgcctacgccgtggccaccggcgacgccctgctggagaagctgtgcctgcagttcctggcctggaacttcgaggccctgacccaggccgaggcctggcccagcgtgcccaccgacctgctgcagctgctgctgcccagaagcgacctggccgtgcccagcgagctggccctgctgaaggccgtggacacctggagctggggcgagagagccagccacgaggaggtggagggcctggtggagaagatcagattccccatgatgctgcccgaggagctgttcgagctgcagttcaacctgagcctgtactggagccacgaggccctgttccagaagaagaccctgcaggccctggagttccacaccgtgcccttccagctgctggccagatacaagggcctgaacctgaccgaggacacctacaagcccagaatctacaccagccccacctggagcgccttcgtgaccgacagcagctggagcgccagaaagagccagctggtgtaccagagcagaagaggccccctggtgaagtacagcagcgactacttccaggcccccagcgactacagatactacccctaccagagcttccagaccccccagcaccccagcttcctgttccaggacaagagagtgagctggagcctggtgtacctgcccaccatccagagctgctggaactacggcttcagctgcagcagcgacgagctgcccgtgctgggcctgaccaagagcggcggcagcgacagaaccatcgcctacgagaacaaggccctgatgctgtgcgagggcctgttcgtggccgacgtgaccgacttcgagggctggaaggccgccatccccagcgccctggacaccaacagcagcaagagcaccagcagcttcccctgccccgccggccacttcaacggcttcagaaccgtgatcagacccttctacctgaccaacagcagcggcgtggactag

SEQ ID NO: 86601 - DNA, 1722 bp, Artificial Sequence
  Description of Artificial Sequence: Synthetic coding sequence
atgaccccccccagactgttctgggtgtggctgctggtggccggcacccagggcgtgaacgacggcgacatgagactggccgacggcggcgccaccaaccagggcagagtggagatcttctacagaggccagtggggcaccgtgtgcgacaacctgtgggacctgaccgacgccagcgtggtgtgcagagccctgggcttcgagaacgccacccaggccctgggcagagccgccttcggccagggcagcggccccatcatgctggccgactgcaagagcctgggctggctgaagagcaactgcagacacgagagagacgccggcgtggtgtgcaccaacgagaccagaagcacccacaccctggacctgagcagagagctgagcgaggccctgggccagatcttcgacagccagagaggctgcgacctgagcatcagcgtgaacgtgcagggcgaggacgccctgggcttctgcggccacaccgtgatcctgaccgccaacctggaggcccaggccctgtggaaggagcccggcagcaacgtgaccatgagcgtggacgccgagtgcgtgcccatggtgagagacctgctgagatacttctacagcagaagaatcgacatcaccctgagcagcgtgaagtgcttccacaagctggccagcgcctacggcgccagacagctgcagggctactgcgccagcctgttcgccatcctgctgccccaggaccccagcttccagatgcccctggacctgtacgcctacgccgtggccaccggcgacgccctgctggagaagctgtgcctgcagttcctggcctggaacttcgaggccctgacccaggccgaggcctggcccagcgtgcccaccgacctgctgcagctgctgctgcccagaagcgacctggccgtgcccagcgagctggccctgctgaaggccgtggacacctggagctggggcgagagagccagccacgaggaggtggagggcctggtggagaagatcagattccccatgatgctgcccgaggagctgttcgagctgcagttcaacctgagcctgtactggagccacgaggccctgttccagaagaagaccctgcaggccctggagttccacaccgtgcccttccagctgctggccagatacaagggcctgaacctgaccgaggacacctacaagcccagaatctacaccagccccacctggagcgccttcgtgaccgacagcagctggagcgccagaaagagccagctggtgtaccagagcagaagaggccccctggtgaagtacagcagcgactacttccaggcccccagcgactacagatactacccctaccagagcttccagaccccccagcaccccagcttcctgttccaggacaagagagtgagctggagcctggtgtacctgcccaccatccagagctgctggaactacggcttcagctgcagcagcgacgagctgcccgtgctgggcctgaccaagagcggcggcagcgacagaaccatcgcctacgagaacaaggccctgatgctgtgcgagggcctgttcgtggccgacgtgaccgacttcgagggctggaaggccgccatccccagcgccctggacaccaacagcagcaagagcaccagcagcttcccctgccccgccggccacttcaacggcttcagaaccgtgatcagacccttctacctgaccaacagcagcggcgtggactag

SEQ ID NO: 86602 - DNA, 411 bp, Artificial Sequence
  Description of Artificial Sequence: Synthetic coding sequence
atgagcaacgtgccccacaagagcagcctgcccgagggcatcagacccggcaccgtgctgagaatcagaggcctggtgccccccaacgccagcagattccacgtgaacctgctgtgcggcgaggagcagggcagcgacgccgccctgcacttcaaccccagactggacaccagcgaggtggtgttcaacagcaaggagcagggcagctggggcagagaggagagaggccccggcgtgcccttccagagaggccagcccttcgaggtgctgatcatcgccagcgacgacggcttcaaggccgtggtgggcgacgcccagtaccaccacttcagacacagactgcccctggccagagtgagactggtggaggtgggcggcgacgtgcagctggacagcgtgagaatcttctag

SEQ ID NO: 86603 - DNA, 954 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtggccgtgaacggcaagcacaccctgctgtacggccacagaatcggccccgagaagatcgacaccctgggcatctacggcaaggtgaacatccacagcatcggcttcagcttcagcagcgacctgcagagcacccaggccagcagcctggagctgaccgagatcagcagagagaacgtgcccaagagcggcaccccccagctgagactgcccttcgccgccagactgaacacccccatgggccccggcagaaccgtggtggtgaagggcgaggtgaacgccaacgccaagagcttcaacgtggacctgctggccggcaagagcaaggacatcgccctgcacctgaaccccagactgaacatcaaggccttcgtgagaaacagcttcctgcaggagagctggggcgaggaggagagaaacatcaccagcttccccttcagccccggcatgtacttcgagatgatcatctactgcgacgtgagagagttcaaggtggccgtgaacggcgtgcacagcctggagtacaagcacagattcaaggagctgagcagcatcgacaccctggagatcaacggcgacatccacctgctggaggtgagaagctggtag

SEQ ID NO: 86604 - DNA, 1080 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtggccgtgaacggcaagcacaccctgctgtacggccacagaatcggccccgagaagatcgacaccctgggcatctacggcaaggtgaacatccacagcatcggcttcagcttcagcagcgacctgcagagcacccaggccagcagcctggagctgaccgagatcagcagagagaacgtgcccaagagcggcaccccccagctgcccagcaacagaggcggcgacatcagcaagatcgcccccagaaccgtgtacaccaagagcaaggacagcaccgtgaaccacaccctgacctgcaccaagatcccccccatgaactacgtgagcaagagactgcccttcgccgccagactgaacacccccatgggccccggcagaaccgtggtggtgaagggcgaggtgaacgccaacgccaagagcttcaacgtggacctgctggccggcaagagcaaggacatcgccctgcacctgaaccccagactgaacatcaaggccttcgtgagaaacagcttcctgcaggagagctggggcgaggaggagagaaacatcaccagcttccccttcagccccggcatgtacttcgagatgatcatctactgcgacgtgagagagttcaaggtggccgtgaacggcgtgcacagcctggagtacaagcacagattcaaggagctgagcagcatcgacaccctggagatcaacggcgacatccacctgctggaggtgagaagctggtag

SEQ ID NO: 86605 - DNA, 1077 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtggccgtgaacggcaagcacaccctgctgtacggccacagaatcggccccgagaagatcgacaccctgggcatctacggcaaggtgaacatccacagcatcggcttcagcttcagcagcgacctgcagagcacccaggccagcagcctggagctgaccgagatcagcagagagaacgtgcccaagagcggcaccccccagctgagactgagcctgcccagctgggacctgcagggccacggcagcgagaccttcagaagcgtgctgtggaccagagtgttcgagatcgccttctgcagacccctgggcaccgtggccagcttccagagactgcccttcgccgccagactgaacacccccatgggccccggcagaaccgtggtggtgaagggcgaggtgaacgccaacgccaagagcttcaacgtggacctgctggccggcaagagcaaggacatcgccctgcacctgaaccccagactgaacatcaaggccttcgtgagaaacagcttcctgcaggagagctggggcgaggaggagagaaacatcaccagcttccccttcagccccggcatgtacttcgagatgatcatctactgcgacgtgagagagttcaaggtggccgtgaacggcgtgcacagcctggagtacaagcacagattcaaggagctgagcagcatcgacaccctggagatcaacggcgacatccacctgctggaggtgagaagctggtag

SEQ ID NO: 86606 - DNA, 954 bp, Artificial Sequence; identical to SEQ ID NO: 86603
  Description of Artificial Sequence: Synthetic coding sequence

SEQ ID NO: 86607 - DNA, 627 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtggccgtgaacggcaagcacaccctgctgtacggccacagaatcggccccgagaagatcgacaccctgggcatctacggcaaggtgaacatccacagcatcggcttcagcttcagcagcgacctgcagagcacccaggccagcagcctggagctgaccgagatcagcagagagaacgtgcccaagagcggcaccccccagctgcccagcaacagaggcggcgacatcagcaagatcgcccccagaaccgtgtacaccaagagcaaggacagcaccgtgtag

SEQ ID NO: 86608 - DNA, 903 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtgcccaagagcggcaccccccagctgcccagcaacagaggcggcgacatcagcaagatcgcccccagaaccgtgtacaccaagagcaaggacagcaccgtgaaccacaccctgacctgcaccaagatcccccccatgaactacgtgagcaagagactgcccttcgccgccagactgaacacccccatgggccccggcagaaccgtggtggtgaagggcgaggtgaacgccaacgccaagagcttcaacgtggacctgctggccggcaagagcaaggacatcgccctgcacctgaaccccagactgaacatcaaggccttcgtgagaaacagcttcctgcaggagagctggggcgaggaggagagaaacatcaccagcttccccttcagccccggcatgtacttcgagatgatcatctactgcgacgtgagagagttcaaggtggccgtgaacggcgtgcacagcctggagtacaagcacagattcaaggagctgagcagcatcgacaccctggagatcaacggcgacatccacctgctggaggtgagaagctggtag

SEQ ID NO: 86609 - DNA, 1080 bp, Artificial Sequence; identical to SEQ ID NO: 86604
  Description of Artificial Sequence: Synthetic coding sequence

SEQ ID NO: 86610 - DNA, 507 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgatcatggtgctgaaggacaagttccaggtggccgtgaacggcaagcacaccctgctgtacggccacagaatcggccccgagaagatcgacaccctgggcatctacggcaaggtgaacatccacagcatcggcttcagcttcagcagcgacctgcagagcacccaggccagcagcctggagctgacctag

SEQ ID NO: 86611 - DNA, 321 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgccgacagattccaggtggacctgcagaacggcagcagcatgaagcccagagccgacgtggccttccacttcaaccccagattcaagagagccggctgcatcgtgtgcaacaccctgatcaacgagaagtggggcagagaggagatcacctacgacacccccttcaagagagagaagagcttcgagatcgtgtag

SEQ ID NO: 86612 - DNA, 1080 bp, Artificial Sequence; identical to SEQ ID NO: 86604
  Description of Artificial Sequence: Synthetic coding sequence

SEQ ID NO: 86613 - DNA, 954 bp, Artificial Sequence; identical to SEQ ID NO: 86603
  Description of Artificial Sequence: Synthetic coding sequence

SEQ ID NO: 86614 - DNA, 1080 bp, Artificial Sequence; identical to SEQ ID NO: 86604
  Description of Artificial Sequence: Synthetic coding sequence

SEQ ID NO: 86615 - DNA, 132 bp, Artificial Sequence
  Description of Artificial Sequence: Synthetic coding sequence
atgatgctgagcctgaacaacctgcagaacatcatctacaaccccgtgatccccttcgtgggcaccatccccgaccagctggaccccggcaccctgatcgtgatcagaggccacgtgcccagcgacgcctag

SEQ ID NO: 86616 - DNA, 972 bp, Artificial Sequence
  Description of Artificial Sequence: Synthetic coding sequence
atggccttcagcggcagccaggccccctacctgagccccgccgtgcccttcagcggcaccatccagggcggcctgcaggacggcctgcagatcaccgtgaacggcaccgtgctgagcagcagcggcaccagattcgccgtgaacttccagaccggcttcagcggcaacgacatcgccttccacttcaaccccagattcgaggacggcggctacgtggtgtgcaacaccagacagaacggcagctggggccccgaggagagaaagacccacatgcccttccagaagggcatgcccttcgacctgtgcttcctggtgcagagcagcgacttcaaggtgatggtgaacggcatcctgttcgtgcagtacttccacagagtgcccttccacagagtggacaccatcagcgtgaacggcagcgtgcagctgagctacatcagcttccagccccccggcgtgtggcccgccaaccccgcccccatcacccagaccgtgatccacaccgtgcagagcgcccccggccagatgttcagcacccccgccatcccccccatgatgtacccccaccccgcctaccccatgcccttcatcaccaccatcctgggcggcctgtaccccagcaagagcatcctgctgagcggcaccgtgctgcccagcgcccagagattccacatcaacctgtgcagcggcaaccacatcgccttccacctgaaccccagattcgacgagaacgccgtggtgagaaacacccagatcgacaacagctggggcagcgaggagagaagcctgcccagaaagatgcccttcgtgagaggccagagcttcagcgtgtggatcctgtgcgaggcccactgcctgaaggtggccgtggacggccagcacctgttcgagtactaccacagactgagaaacctgcccaccatcaacagactggaggtgggcggcgacatccagctgacccacgtgcagacctag

SEQ ID NO: 86617 - DNA, 936 bp, Artificial Sequence
  Description of Artificial Sequence: Synthetic coding sequence
atggccttcagcggcagccaggccccctacctgagccccgccgtgcccttcagcggcaccatccagggcggcctgcaggacggcctgcagatcaccgtgaacggcaccgtgctgagcagcagcggcaccagattcgccgtgaacttccagaccggcttcagcggcaacgacatcgccttccacttcaaccccagattcgaggacggcggctacgtggtgtgcaacaccagacagaacggcagctggggccccgaggagagaaagacccacatgcccttccagaagggcatgcccttcgacctgtgcttcctggtgcagagcagcgacttcaaggtgatggtgaacggcatcctgttcgtgcagtacttccacagagtgcccttccacagagtggacaccatcagcgtgaacggcagcgtgcagctgagctacatcagcttccagacccagaccgtgatccacaccgtgcagagcgcccccggccagatgttcagcacccccgccatcccccccatgatgtacccccaccccgcctaccccatgcccttcatcaccaccatcctgggcggcctgtaccccagcaagagcatcctgctgagcggcaccgtgctgcccagcgcccagagattccacatcaacctgtgcagcggcaaccacatcgccttccacctgaaccccagattcgacgagaacgccgtggtgagaaacacccagatcgacaacagctggggcagcgaggagagaagcctgcccagaaagatgcccttcgtgagaggccagagcttcagcgtgtggatcctgtgcgaggcccactgcctgaaggtggccgtggacggccagcacctgttcgagtactaccacagactgagaaacctgcccaccatcaacagactggaggtgggcggcgacatccagctgacccacgtgcagacctag

SEQ ID NO: 86618 - DNA, 741 bp, Artificial Sequence
  Description of Artificial Sequence: Synthetic coding sequence
atggccttcagcggcagccaggccccctacctgagccccgccgtgcccttcagcggcaccatccagggcggcctgcaggacggcctgcagatcaccgtgaacggcaccgtgctgagcagcagcggcaccagattcgccgtgaacttccagaccggcttcagcggcaacgacatcgccttccacttcaaccccagattcgaggacggcggctacgtggtgtgcaacaccagacagaacggcagctggggccccgaggagagaaagacccacatgcccttccagaagggcatgcccttcgacctgtgcttcctggtgcagagcagcgacttcaaggtgatggtgaacggcatcctgttcgtgcagtacttccacagagtgcccttccacagagtggacaccatcagcgtgaacggcagcgtgcagctgagctacatcagcttccagccccccggcgtgtggcccgccaaccccgcccccatcacccagaccgtgatccacaccgtgcagagcgcccccggccagatgttcagcacccccgccatcccccccatgatgtacccccaccccgcctaccccatgcccttcatcaccaccatcctgggcggcctgtaccccagcaagagcatcctgctgagcggcaccgtgctgcccagcgcccagagatgcggcagctgcgtgaagctgaccgccagcagatggccctggatggtgagcacctgcctgaacaccaccatcgcctag

SEQ ID NO: 86619 - DNA, 1068 bp, Artificial Sequence
  Description of Artificial Sequence: Synthetic coding sequence
atggccttcagcggcagccaggccccctacctgagccccgccgtgcccttcagcggcaccatccagggcggcctgcaggacggcctgcagatcaccgtgaacggcaccgtgctgagcagcagcggcaccagattcgccgtgaacttccagaccggcttcagcggcaacgacatcgccttccacttcaaccccagattcgaggacggcggctacgtggtgtgcaacaccagacagaacggcagctggggccccgaggagagaaagacccacatgcccttccagaagggcatgcccttcgacctgtgcttcctggtgcagagcagcgacttcaaggtgatggtgaacggcatcctgttcgtgcagtacttccacagagtgcccttccacagagtggacaccatcagcgtgaacggcagcgtgcagctgagctacatcagcttccagaaccccagaaccgtgcccgtgcagcccgccttcagcaccgtgcccttcagccagcccgtgtgcttcccccccagacccagaggcagaagacagaagccccccggcgtgtggcccgccaaccccgcccccatcacccagaccgtgatccacaccgtgcagagcgcccccggccagatgttcagcacccccgccatcccccccatgatgtacccccaccccgcctaccccatgcccttcatcaccaccatcctgggcggcctgtaccccagcaagagcatcctgctgagcggcaccgtgctgcccagcgcccagagattccacatcaacctgtgcagcggcaaccacatcgccttccacctgaaccccagattcgacgagaacgccgtggtgagaaacacccagatcgacaacagctggggcagcgaggagagaagcctgcccagaaagatgcccttcgtgagaggccagagcttcagcgtgtggatcctgtgcgaggcccactgcctgaaggtggccgtggacggccagcacctgttcgagtactaccacagactgagaaacctgcccaccatcaacagactggaggtgggcggcgacatccagctgacccacgtgcagacctag

SEQ ID NO: 86620 - DNA, 666 bp, Artificial Sequence
  Description of Artificial Sequence: Synthetic coding sequence
atgggccccttcagcgcccccgtggagcccgacggcggctacgtggtgtgcaacaccagacagaacggcagctggggccccgaggagagaaagacccacatgcccttccagaagggcatgcccttcgacctgtgcttcctggtgcagagcagcgacttcaaggtgatggtgaacggcatcctgttcgtgcagtacttccacagagtgcccttccacagagtggacaccatcagcgtgaacggcagcgtgcagctgagctacatcagcttccagaaccccagaaccgtgcccgtgcagcccgccttcagcaccgtgcccttcagccagcccgtgtgcttcccccccagacccagaggcagaagacagaagccccccggcgtgtggcccgccaaccccgcccccatcacccagaccgtgatccacaccgtgcagagcgcccccggccagatgttcagcacccccgccatcccccccatgatgtacccccaccccgcctaccccatgcccttcatcaccaccatcctgggcggcctgtaccccagcaagagcatcctgctgagcggcaccgtgctgcccagcgcccagagatgcggcagctgcgtgaagctgaccgccagcagatggccctggatggtgagcacctgcctgaacaccaccatcgcctag

SEQ ID NO: 86621 - DNA, 360 bp, Artificial Sequence
  Description of Artificial Sequence: Synthetic coding sequence
atggccttcagcggcagccaggccccctacctgagccccgccgtgcccttcagcggcaccatccagggcggcctgcaggacggcctgcagatcaccgtgaacggcaccgtgctgagcagcagcggcaccagattcgccgtgaacttccagaccggcttcagcggcaacgacatcgccttccacttcaaccccagattcgaggacggcggctacgtggtgtgcaacaccagacagaacggcagctggggccccgaggagagaaagacccacatgcccttccagaagggcatgcccttcgacctgtgcttcctggtgcagagcagcgacttcaaggtgcacctgctgctgctgctgctgtag

SEQ ID NO: 86622 - DNA, 1533 bp, Artificial Sequence
  Description of Artificial Sequence: Synthetic coding sequence
atggccggcagcagacagagaggcctgagagccagagtgagacccctgttctgcgccctgctgctgagcctgggcagattcgtgagaggcgacggcgtgggcggcgaccccgccgtggccctgccccacagaagattcgagtacaagtacagcttcaagggcccccacctggtgcagagcgacggcaccgtgcccttctgggcccacgccggcaacgccatccccagcagcgaccagatcagagtggcccccagcctgaagagccagagaggcagcgtgtggaccaagaccaaggccgccttcgagaactgggaggtggaggtgaccttcagagtgaccggcagaggcagaatcggcgccgacggcctggccatctggtacgccgagaaccagggcctggagggccccgtgttcggcagcgccgacctgtggaacggcgtgggcatcttcttcgacagcttcgacaacgacggcaagaagaacaaccccgccatcgtgatcatcggcaacaacggccagatccactacgaccaccagaacgacggcgccagccaggccctggccagctgccagagagacttcagaaacaagccctaccccgtgagagccaagatcacctactaccagaacaccctgaccgtgatgatcaacaacggcttcacccccgacaagaacgactacgagttctgcgccaaggtggagaacatgatcatccccgcccagggccacttcggcatcagcgccgccaccggcggcctggccgacgaccacgacgtgctgagcttcctgaccttccagctgaccgagcccggcaaggagccccccacccccgacaaggagatcagcgagaaggagaaggagaagtaccaggaggagttcgagcacttccagcaggagctggacaagaagaaggaggagttccagaagggccaccccgacctgcagggccagcccgccgaggagatcttcgagagcgtgggcgacagagagctgagacaggtgttcgagggccagaacagaatccacctggagatcaagcagctgaacagacagctggacatgatcctggacgagcagagaagatacgtgagcagcctgaccgaggagatcagcaagagaggcgccggcatgcccggccagcacggccagatcacccagcaggagctggacaccgtggtgaagacccagcacgagatcctgagacaggtgaacgagatgaagaacagcatgagcgagaccgtgagactggtgagcggcatgcagcaccccggcagcgccggcggcgtgtacgagaccacccagcacttcatcgacatcaaggagcacctgcacatcgtgaagagagacatcgacaacctggtgcagagaaacatgcccagcaacgagaagcccaagtgccccgagctgccccccttccccagctgcctgagcaccgtgcacttcatcatcttcgtggtggtgcagaccgtgctgttcatcggctacatcatgtacagaagccagcaggaggccgccgccaagaagttcttctag

SEQ ID NO: 86623 - DNA, 1101 bp, Artificial Sequence
  Description of Artificial Sequence: Synthetic coding sequence
atgcagcccctgtggctgtgctgggccctgtgggtgctgcccctggccagccccggcgccgccctgaccggcgagcagctgctgggcagcctgctgagacagctgcagctgaaggaggtgcccaccctggacagagccgacatggaggagctggtgatccccacccacgtgagagcccagtacgtggccctgctgcagagaagccacggcgacagaagcagaggcaagagattcagccagagcttcagagaggtggccggcagattcctggccctggaggccagcacccacctgctggtgttcggcatggagcagagactgccccccaacagcgagctggtgcaggccgtgctgagactgttccaggagcccgtgcccaaggccgccctgcacagacacggcagactgagccccagaagcgccagagccagagtgaccgtggagtggctgagagtgagagacgacggcagcaacagaaccagcctgatcgacagcagactggtgagcgtgcacgagagcggctggaaggccttcgacgtgaccgaggccgtgaacttctggcagcagctgagcagacccagacagcccctgctgctgcaggtgagcgtgcagagagagcacctgggccccctggccagcggcgcccacaagctggtgagattcgccagccagggcgcccccgccggcctgggcgagccccagctggagctgcacaccctggacctgggcgactacggcgcccagggcgactgcgaccccgaggcccccatgaccgagggcaccagatgctgcagacaggagatgtacatcgacctgcagggcatgaagtgggccgagaactgggtgctggagccccccggcttcctggcctacgagtgcgtgggcacctgcagacagccccccgaggccctggccttcaagtggcccttcctgggccccagacagtgcatcgccagcgagaccgacagcctgcccatgatcgtgagcatcaaggagggcggcagaaccagaccccaggtggtgagcctgcccaacatgagagtgcagaagtgcagctgcgccagcgacggcgccctggtgcccagaagactgcagccctag

SEQ ID NO: 86624 - DNA, 1101 bp, Artificial Sequence
  Description of Artificial Sequence: Synthetic coding sequence
atgtggcccctgtggctgtgctgggccctgtgggtgctgcccctggccggccccggcgccgccctgaccgaggagcagctgctgggcagcctgctgagacagctgcagctgagcgaggtgcccgtgctggacagagccgacatggagaagctggtgatccccgcccacgtgagagcccagtacgtggtgctgctgagaagaagccacggcgacagaagcagaggcaagagattcagccagagcttcagagaggtggccggcagattcctggccagcgaggccagcacccacctgctggtgttcggcatggagcagagactgccccccaacagcgagctggtgcaggccgtgctgagactgttccaggagcccgtgcccaaggccgccctgcacagacacggcagactgagccccagaagcgcccaggccagagtgaccgtggagtggctgagagtgagagacgacggcagcaacagaaccagcctgatcgacagcagactggtgagcgtgcacgagagcggctggaaggccttcgacgtgaccgaggccgtgaacttctggcagcagctgagcagacccagacagcccctgctgctgcaggtgagcgtgcagagagagcacctgggccccctggccagcggcgcccacaagctggtgagattcgccagccagggcgcccccgccggcctgggcgagccccagctggagctgcacaccctggacctgagagactacggcgcccagggcgactgcgaccccgaggcccccatgaccgagggcaccagatgctgcagacaggagatgtacatcgacctgcagggcatgaagtgggccaagaactgggtgctggagccccccggcttcctggcctacgagtgcgtgggcacctgccagcagccccccgaggccctggccttcaactggcccttcctgggccccagacagtgcatcgccagcgagaccgccagcctgcccatgatcgtgagcatcaaggagggcggcagaaccagaccccaggtggtgagcctgcccaacatgagagtgcagaagtgcagctgcgccagcgacggcgccctggtgcccagaagactgcagccctag

SEQ ID NO: 86625 - DNA, 999 bp, Artificial Sequence
  Description of Artificial Sequence: Synthetic coding sequence
atgtggcccctgtggctgtgctgggccctgtgggtgctgcccctggccggccccggcgccgccctgaccgaggagcagctgctgggcagcctgctgagacagctgcagctgagcgaggtgcccgtgctggacagagccgacatggagaagctggtgatccccgcccacgtgagagcccagtacgtggtgctgctgagaagaagccacggcgacagaagcagaggcaagagattcagccagagcttcagagaggtggccggcagattcctggccagcgaggccgccctgcacagacacggcagactgagccccagaagcgcccaggccagagtgaccgtggagtggctgagagtgagagacgacggcagcaacagaaccagcctgatcgacagcagactggtgagcgtgcacgagagcggctggaaggccttcgacgtgaccgaggccgtgaacttctggcagcagctgagcagacccagacagcccctgctgctgcaggtgagcgtgcagagagagcacctgggccccctggccagcggcgcccacaagctggtgagattcgccagccagggcgcccccgccggcctgggcgagccccagctggagctgcacaccctggacctgagagactacggcgcccagggcgactgcgaccccgaggcccccatgaccgagggcaccagatgctgcagacaggagatgtacatcgacctgcagggcatgaagtgggccaagaactgggtgctggagccccccggcttcctggcctacgagtgcgtgggcacctgccagcagccccccgaggccctggccttcaactggcccttcctgggccccagacagtgcatcgccagcgagaccgccagcctgcccatgatcgtgagcatcaaggagggcggcagaaccagaccccaggtggtgagcctgcccaacatgagagtgcagaagtgcagctgcgccagcgacggcgccctggtgcccagaagactgcagccctag

SEQ ID NO: 86626 - DNA, 1131 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagaaacggcatccccgacgagcagatcgtggtgatgatgtacgacgacatcgcctacagcgaggacaaccccacccccggcatcgtgatcaacagacccaacggcaccgacgtgtaccagggcgtgcccaaggactacaccggcgaggacgtgaccccccagaacttcctggccgtgctgagaggcgacgccgaggccgtgaagggcatcggcagcggcaaggtgctgaagagcggcccccaggaccacgtgttcatctacttcaccgaccacggcagcaccggcatcctggtgttccccaacgaggacctgcacgtgaaggacctgaacgagaccatccactacatgtacaagcacaagatgtacagaaagatggtgttctacatcgaggcctgcgagagcggcagcatgatgaaccacctgcccgacaacatcaacgtgtacgccaccaccgccgccaaccccagagagagcagctacgcctgctactacgacgagaagagaagcacctacctgggcgactggtacagcgtgaactggatggaggacagcgacgtggaggacctgaccaaggagaccctgcacaagcagtaccacctggtgaagagccacaccaacaccagccacgtgatgcagtacggcaacaagaccatcagcaccatgaaggtgatgcagttccagggcatgaagagaaaggccagcagccccgtgcccctgccccccgtgacccacctggacctgacccccagccccgacgtgcccctgaccatcatgaagagaaagctgatgaacaccaacgacctggaggagagcagacagctgaccgaggagatccagagacacctggactacgagtacgccctgagacacctgtacgtgctggtgaacctgtgcgagaagccctaccccctgcacagaatcaagctgagcatggaccacgtgtgcctgggccactactag

SEQ ID NO: 86627 - DNA, 1119 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagaaacggcatccccgacgagcagatcgtggtgatgatgtacgacgacatcgcctacagcgaggacaaccccacccccggcatcgtgatcaacagacccaacggcaccgacgtgtaccagggcgtgcccaaggactacaccggcgaggacgtgaccccccagaacttcctggccgtgctgagaggcgacgccgaggccgtgaagggcatcggcagcggcaaggtgctgaagagcggcccccaggaccacgtgttcatctacttcaccgaccacggcagcaccggcatcctggtgttccccaacgaggacctgcacgtgaaggacctgaacgagaccatccactacatgtacaagcacaagatgtacagaaagatggtgttctacatcgaggcctgcgagagcggcagcatgatgaaccacctgcccgacaacatcaacgtgtacgccaccaccgccgccaaccccagagagagcagctacgcctgctactacgacgagaagagaagcacctacctgggcgactggtacagcgtgaactggatggaggacagcgacgtggaggacctgaccaaggagaccctgcacaagcagtaccacctggtgaagagccacaccaacaccagccacgtgatgcagtacggcaacaagaccatcagcaccatgaaggtgatgcagttccagggcatgaagagaaaggccagcagccccgtgcccctgccccccgtgacccacctggacctgacccccagccccgacgtgcccctgaccatcatgaagagaaagctgatgaacaccaacgacctggaggagagcagacagctgaccgaggagatccagagacacctggacgacaagatcgtgcacggccccagagtgccctggagcctgctgaagagctgcctgctggaggccttccccagcgtgagcgccccccccaccgtgtgctag

SEQ ID NO: 86628 - DNA, 1302 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagaaacggcatccccgacgagcagatcgtggtgatgatgtacgacgacatcgcctacagcgaggacaaccccacccccggcatcgtgatcaacagacccaacggcaccgacgtgtaccagggcgtgcccaaggactacaccggcgaggacgtgaccccccagaacttcctggccgtgctgagaggcgacgccgaggccgtgaagggcatcggcagcggcaaggtgctgaagagcggcccccaggaccacgtgttcatctacttcaccgaccacggcagcaccggcatcctggtgttccccaacgaggacctgcacgtgaaggacctgaacgagaccatccactacatgtacaagcacaagatgtacagaaagatggtgttctacatcgaggcctgcgagagcggcagcatgatgaaccacctgcccgacaacatcaacgtgtacgccaccaccgccgccaaccccagagagagcagctacgcctgctactacgacgagaagagaagcacctacctgggcgactggtacagcgtgaactggatggaggacagcgacgtggaggacctgaccaaggagaccctgcacaagcagtaccacctggtgaagagccacaccaacaccagccacgtgatgcagtacggcaacaagaccatcagcaccatgaaggtgatgcagttccagggcatgaagagaaaggccagcagccccgtgcccctgccccccgtgacccacctggacctgacccccagccccgacgtgcccctgaccatcatgaagagaaagctgatgaacaccaacgacctggaggagagcagacagctgaccgaggagatccagagacacctggacgccagacacctgatcgagaagagcgtgagaaagatcgtgagcctgctggccgccagcgaggccgaggtggagcagctgctgagcgagagagcccccctgaccggccacagctgctaccccgaggccctgctgcacttcagaacccactgcttcaactggcacagccccacctacgagtacgccctgagacacctgtacgtgctggtgaacctgtgcgagaagccctaccccctgcacagaatcaagctgagcatggaccacgtgtgcctgggccactactag

SEQ ID NO: 86629 - DNA, 1302 bp, Artificial Sequence; identical to SEQ ID NO: 86628
  Description of Artificial Sequence: Synthetic coding sequence

SEQ ID NO: 86630 - DNA, 1197 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagaaacggcatccccgacgagcagatcgtggtgatgatgtacgacgtgaccccccagaacttcctggccgtgctgagaggcgacgccgaggccgtgaagggcatcggcagcggcaaggtgctgaagagcggcccccaggaccacgtgttcatctacttcaccgaccacggcagcaccggcatcctggtgttccccaacgaggacctgcacgtgaaggacctgaacgagaccatccactacatgtacaagcacaagatgtacagaaagatggtgttctacatcgaggcctgcgagagcggcagcatgatgaaccacctgcccgacaacatcaacgtgtacgccaccaccgccgccaaccccagagagagcagctacgcctgctactacgacgagaagagaagcacctacctgggcgactggtacagcgtgaactggatggaggacagcgacgtggaggacctgaccaaggagaccctgcacaagcagtaccacctggtgaagagccacaccaacaccagccacgtgatgcagtacggcaacaagaccatcagcaccatgaaggtgatgcagttccagggcatgaagagaaaggccagcagccccgtgcccctgccccccgtgacccacctggacctgacccccagccccgacgtgcccctgaccatcatgaagagaaagctgatgaacaccaacgacctggaggagagcagacagctgaccgaggagatccagagacacctggacgccagacacctgatcgagaagagcgtgagaaagatcgtgagcctgctggccgccagcgaggccgaggtggagcagctgctgagcgagagagcccccctgaccggccacagctgctaccccgaggccctgctgcacttcagaacccactgcttcaactggcacagccccacctacgagtacgccctgagacacctgtacgtgctggtgaacctgtgcgagaagccctaccccctgcacagaatcaagctgagcatggaccacgtgtgcctgggccactactag

SEQ ID NO: 86631 - DNA, 1233 bp, Artificial Sequence
  Description of Artificial Sequence: Synthetic coding sequence
atggtgtggaaggtggccgtgttcctgagcgtggccggcagcaacggctggtacaactacagacaccaggccgacgcctgccacgcctaccagatcatccacagaaacggcatccccgacgagcagatcgtggtgatgatgtacgacgacatcgcctacagcgaggacaaccccacccccggcatcgtgatcaacagacccaacggcaccgacgtgtaccagggcgtgcccaaggactacaccggcgaggacgtgaccccccagaacttcctggccgtgctgagaggcgacgccgaggccgtgaagggcatcggcagcggcaaggtgctgaagagcggcccccaggaccacgtgttcatctacttcaccgaccacggcagcaccggcatcctggtgttccccaacgaggacctgcacgtgaaggacctgaacgagaccatccactacatgtacaagcacaagatgtacagaaagatggtgttctacatcgaggcctgcgagagcggcagcatgatgaaccacctgcccgacaacatcaacgtgtacgccaccaccgccgccaaccccagagagagcagctacgcctgctactacgacgagaagagaagcacctacctgggcgactggtacagcgtgaactggatggaggacagcgacgtggaggacctgaccaaggagaccctgcacaagcagtaccacctggtgaagagccacaccaacaccagccacgtgatgcagtacggcaacaagaccatcagcaccatgaaggtgatgcagttccagggcatgaagagaaaggccagcagccccgtgcccctgccccccgtgacccacctggacctgacccccagccccgacgtgcccctgaccatcatgaagagaaagctgatgaacaccaacgacctggaggagagcagacagctgaccgaggagatccagagacacctggacgccagacacctgatcgagaagagcgtgagaaagatcgtgagcctgctggccgccagcgaggccgaggtggagcagctgctgagcgagagagcccccctgaccggccacagctgctaccccgaggccctgctgcacttcagaacccactgcttcaactggcacagccccacctacgagtacgccctgagacacctgtacgtgctggtgaacctgtgcgagaagccctaccccctgcacagaatcaagctgagcatggaccacgtgtgcctgggccactactag

SEQ ID NO: 86632 - DNA, 174 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccactag

SEQ ID NO: 86633 - DNA, 60 bp, Artificial Sequence
  Description of Artificial Sequence: Synthetic coding sequence
atggtgtggaaggtggccgtgttcctgagcgtggccctgggcatcggcgccgtgccctag

SEQ ID NO: 86634 - DNA, 177 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagatag

SEQ ID NO: 86635 - DNA, 237 bp, Artificial Sequence
  Description of Artificial Sequence: Synthetic coding sequence
atggtgtggaaggtggccgtgttcctgagcgtggccctgggcatcggcgccgtgcccatcgacgaccccgaggacggcggcaagcactgggtggtgatcgtggccggcagcaacggctggtacaactacagacaccaggccgacgcctgccacgcctaccagatcatccacagaaacggcatccccgacgagcagatcgtggtgatgatgtacgacgacatcgcctacagcgagtag

SEQ ID NO: 86636 - DNA, 237 bp, Artificial Sequence; identical to SEQ ID NO: 86635
  Description of Artificial Sequence: Synthetic coding sequence

SEQ ID NO: 86637 - DNA, 2736 bp, Artificial Sequence
  Description of Artificial Sequence: Synthetic coding sequence
atggccgccgccgccgccagcgccccccagcagctgagcgacgaggagctgttcagccagctgagaagatacggcctgagccccggccccgtgaccgagagcaccagacccgtgtacctgaagaagctgaagaagctgagagaggaggagcagcagcagcacagaagcggcggcagaggcaacaagaccagaaacagcaacaacaacaacaccgccgccgccaccgtggccgccgccggccccgccgccgccgccgccgccggcatgggcgtgagacccgtgagcggcgacctgagctacctgagaacccccggcggcctgtgcagaatcagcgccagcggccccgagagcctgctgggcggccccggcggcgccagcgccgcccccgccgccggcagcaaggtgctgctgggcttcagcagcgacgagagcgacgtggaggccagccccagagaccaggccggcggcggcggcagaaaggacagagccagcctgcagtacagaggcctgaaggccccccccgcccccctggccgccagcgaggtgaccaacagcaacagcgccgagagaagaaagccccacagctggtggggcgccagaagacccgccggccccgagctgcagaccccccccggcaaggacggcgccgtggaggacgaggagggcgagggcgaggacggcgaggagagagaccccgagaccgaggagcccctgtgggccagcagaaccgtgaacggcagcagactggtgccctacagctgcagagagaactacagcgacagcgaggaggaggacgacgacgacgtggccagcagcagacaggtgctgaaggacgacagcctgagcagacacagacccagaagaacccacagcaagcccctgccccccctgaccgccaagagcgccggcggcagactggagaccagcgtgcagggcggcggcggcctggccatgaacgacagagccgccgccgccggcagcctggacagaagcagaaacctggaggaggccgccgccgccgagcagggcggcggctgcgaccaggtggacagcagccccgtgcccagatacagagtgaacgccaagaagctgacccccctgctgcccccccccctgaccgacatggacagcaccctggacagcagcaccggcagcctgctgaagaccaacaaccacatcggcggcggcgccttcagcgtggacagccccagaatctacagcaacagcctgccccccagcgccgccgtggccgccagcagcagcctgagaatcaaccacgccaaccacaccggcagcaaccacacctacctgaagaacacctacaacaagcccaagctgagcgagcccgaggaggagctgctgcagcagttcaagagagaggaggtgagccccaccggcagcttcagcgcccactacctgagcatgttcctgctgaccgccgcctgcctgttcttcctgatcctgggcctgacctacctgggcatgagaggcaccggcgtgagcgaggacggcgagctgagcatcgagaaccccttcggcgagaccttcggcaagatccaggagagcgagaagaccctgatgatgaacaccctgtacaagctgcacgacagactggcccagctggccggcgaccacgagtgcggcagcagcagccagagaaccctgagcgtgcaggaggccgccgcctacctgaaggacctgggccccgagtacgagggcatcttcaacaccagcctgcagtggatcctggagaacggcaaggacgtgggcatcagatgcgtgggcttcggccccgaggaggagctgaccaacatcaccgacgtgcagttcctgcagagcaccagacccctgatgagcttctggtgcagattcagaagagccttcgtgaccgtgacccacagactgctgctgctgtgcctgggcgtggtgatggtgtgcgtggtgctgagatacatgaagtacagatggaccaaggaggaggaggagaccagacagatgtacgacatggtggtgaagatcatcgacgtgctgagaagccacaacgaggcctgccaggagaacaaggacctgcagccctacatgcccatcccccacgtgagagacagcctgatccagccccacgacagaaagaagatgaagaaggtgtgggacagagccgtggacttcctggccgccaacgagagcagagtgagaaccgagaccagaagaatcggcggcgccgacttcctggtgtggagatggatccagcccagcgccagctgcgacaagatcctggtgatccccagcaaggtgtggcagggccaggccttccacctggacagaagaaacagcccccccaacagcctgaccccctgcctgaagatcagaaacatgttcgaccccgtgatggagatcggcgaccagtggcacctggccatccaggaggccatcctggagaagtgcagcgacaacgacggcatcgtgcacatcgccgtggacaagaacagcagagagggctgcgtgtacgtgaagtgcctgagccccgagtacgccggcaaggccttcaaggccctgcacggcagctggttcgacggcaagctggtgaccgtgaagtacctgagactggacagataccaccacagattcccccaggccctgaccagcaacacccccctgaagcccagcaacaagcacatgaacagcatgagccacctgagactgagaaccggcctgaccaacagccagggcagcagctag

SEQ ID NO: 86638 - DNA, 4512 bp, Artificial Sequence
  Description of Artificial Sequence: Synthetic coding sequence
atgcccggcccccccgccctgagaagaagactgctgctgctgctgctggtgctgctgatcgccggcagcgccggcgccgcccccctgccccagaccggcgccggcgaggccccccccgccgccgaggtgagcagcagcttcgtgatcctgtgcgtgtgcagcctgatcatcctgatcgtgctgatcgccaactgcgtgagctgctgcaaggaccccgagatcgacttcaaggagttcgaggacaacttcgacgacgagatcgacttcaccccccccgccgaggacacccccagcgtgcagagccccgccgaggtgttcaccctgagcgtgcccaacatcagcctgcccgcccccagccagttccagcccagcgtggagggcctgaagagccaggtggccagacacagcctgaactacatccaggagatcggcaacggctggttcggcaaggtgctgctgggcgagatctacaccggcaccagcgtggccagagtgatcgtgaaggagctgaaggccagcgccaaccccaaggagcaggacaccttcctgaagaacggcgagccctactacatcctgcagcaccccaacatcctgcagtgcgtgggccagtgcgtggaggccatcccctacctgctggtgttcgagttctgcgacctgggcgacctgaaggcctacctgagaagcgagcaggagcacatgagaggcgacagccagaccatgctgctgcagagaatggcctgcgaggtggccgccggcctggccgccatgcacaagctgcacttcctgcacagcgacctggccctgagaaactgcttcctgaccagcgacctgaacgtgaaggtgggcgactacggcatcggcttcagcagatacaaggaggactacatcgagaccgacgacaagaaggtgttccccctgagatggaccgcccccgagctggtgaccagcttccaggacagactgctgaccgccgaccagaccaagtacagcaacatctggagcctgggcgtgaccctgtgggagctgttcgacaacgccgcccagccctacagcaacctgagcaacctggacgtgctgaaccaggtgatcagagagagagacaccaagctgcccaagccccagctggagcagccctacagcgacagatggtacgaggtgctgcagttctgctggctgagccccgagaagagacccgccgccgaggacgtgcacagactgctgacctacctgagactgcagagccagagagacagcgaggtggacttcgagcagcagtggaacgccctgaagcccaacaccaacagcagagacagcagcaacaacgccgccttccccatcctggaccacttcgccagagacagactgggcagagagatggaggaggtgctgaccgtgaccgagaccagccagggcctgagcttcgagtacgtgtgggaggccgccaagcacgaccacttcgacgagagaagcagaggccacctggacgagggcctgagctacaccagcatcttctaccccgtggaggtgttcgagagcagcctgagcgaccccggccccggcaagcaggacgacagcggccaggacgtgcccctgagagtgcccggcgtggtgcccgtgttcgacgcccacaacctgagcgtgggcagcgactactacatccagctggaggagaagagcggcagcaacctggagctggactacccccccgccctgctgaccaccgacatggacaaccccgagagaaccggccccgagctgagccagctgaccgccctgagaagcgtggagctggaggagagcagcaccgacgaggacttcttccagagcagcaccgaccccaaggacagcagcctgcccggcgacctgcacgtgaccagcggccccgagagccccttcaacaacatcttcaacgacgtggacaagagcgaggacctgcccagccaccagaagatcttcgacctgatggagctgaacggcgtgcaggccgacttcaagcccgccaccctgagcagcagcctggacaaccccaaggagagcgtgatcaccggccacttcgagaaggagaagcccagaaagatcttcgacagcgagcccctgtgcctgagcgacaacctgatgcaccaggacaacttcgaccccctgaacgtgcaggagctgagcgagaacttcctgttcctgcaggagaagaacctgctgaagggcagcctgagcagcaaggagcacatcaacgacctgcagaccgagctgaagaacgccggcttcaccgaggccatgctggagaccagctgcagaaacagcctggacaccgagctgcagttcgccgagaacaagcccggcctgagcctgctgcaggagaacgtgagcaccaagggcgacgacaccgacgtgatgctgaccggcgacaccctgagcaccagcctgcagagcagccccgaggtgcaggtgccccccaccagcttcgagaccgaggagacccccagaagagtgccccccgacagcctgcccacccagggcgagacccagcccacctgcctggacgtgatcgtgcccgaggactgcctgcaccaggacatcagccccgacgccgtgaccgtgcccgtggagatcctgagcaccgacgccagaacccacagcctggacaacagaagccaggacagccccggcgagagcgaggagaccctgagactgaccgagagcgacagcgtgctggccgacgacatcctggccagcagagtgagcgtgggcagcagcctgcccgagctgggccaggagctgcacaacaagcccttcagcgaggaccaccacagccacagaagactggagaagaacctggaggccgtggagaccctgaaccagctgaacagcaaggacgccgccaaggaggccggcctggtgagcgccctgagcagcgacagcaccagccaggacagcctgctggaggacagcctgagcgcccccttccccgccagcgagcccagcctggagacccccgacagcctggagagcgtggacgtgcacgaggccctgctggacagcctgggcagccacaccccccagaagctggtgccccccgacaagcccgccgacagcggctacgagaccgagaacctggagagccccgagtggaccctgcaccccgcccccgagggcaccgccgacagcgagcccgccaccaccggcgacggcggccacagcggcctgccccccaaccccgtgatcgtgatcagcgacgccggcgacggccacagaggcaccgaggtgacccccgagaccttcaccgccggcagccagggcagctacagagacagcgcctacttcagcgacaacgacagcgagcccgagaagagaagcgaggaggtgcccggcaccagccccagcgccctggtgctggtgcaggagcagcccctgcccgagcccgtgctgcccgagcagagccccgccgcccaggacagctgcctggaggccagaaagagccagcccgacgagagctgcctgagcgccctgcacaacagcagcgacctggagctgagagccacccccgagcccgcccagaccggcgtgccccagcaggtgcaccccaccgaggacgaggccagcagcccctggagcgtgctgaacgccgagctgagcagcggcgacgacttcgagacccaggacgacagaccctgcaccctggccagcaccggcaccaacaccaacgagctgctggcctacaccaacagcgccctggacaagagcctgagcagccacagcgagggccccaagctgaaggagcccgacatcgagggcaagtacctgggcaagctgggcgtgagcggcatgctggacctgagcgaggacggcatggacgccgacgaggaggacgagaacagcgacgacagcgacgaggacctgagagccttcaacctgcacagcctgagcagcgagagcgaggacgagaccgagcaccccgtgcccatcatcctgagcaacgaggacggcagacacctgagaagcctgctgaagcccaccgccgccaacgcccccgaccccctgcccgaggactggaagaaggagaagaaggccgtgaccttcttcgacgacgtgaccgtgtacctgttcgaccaggagacccccaccaaggagctgggcccctgcggcggcgaggcctgcggccccgacctgagcggccccgcccccgccagcggcagcccctacctgagcagatgcatcaacagcgagagcagcaccgacgaggagggcggcggcttcgagtgggacgacgacttcagccccgaccccttcatgagcaagaccaccagcaacctgctgagcagcaagcccagcctgcagaccagcaagtacttcagcccccccccccccgccagaagcaccgagcagagctggccccacagcgccccctacagcagattcagcatcagccccgccaacatcgccagcttcagcctgacccacctgaccgacagcgacatcgagcagggcggcagcagcgaggacggcgagaaggactag

SEQ ID NO: 86639 - DNA, 186 bp, Artificial Sequence
  Description of Artificial Sequence: Synthetic coding sequence
atgcagcccagaacccagcccctggcccagaccctgcccttcttcctgggcggcgcccccagagacaccggcctgagagtgcccgtgatcaagatgggcaccggctgggagggcttccagagaaccctgaaggaggtggcctacatcctgctgtgctgctggtgcatcaaggagctgctggactag

SEQ ID NO: 86640 - DNA, 186 bp, Artificial Sequence; identical to SEQ ID NO: 86639
  Description of Artificial Sequence: Synthetic coding sequence

SEQ ID NO: 86641 - DNA, 522 bp, Artificial Sequence
  Description of Artificial Sequence: Synthetic coding sequence
atgtacagcttcatgggcggcggcctgttctgcgcctgggtgggcaccatcctgctggtggtggccatggccaccgaccactggatgcagtacagactgagcggcagcttcgcccaccagggcctgtggagatactgcctgggcaacaagtgctacctgcagaccgacagcatcgcctactggaacgccaccagagccttcatgatcctgagcgccctgtgcgccatcagcggcatcatcatgggcatcatggccttcgcccaccagcccaccttcagcagaatcagcagacccttcagcgccggcatcatgttcttcagcagcaccctgttcgtggtgctggccctggccatctacaccggcgtgaccgtgagcttcctgggcagaagattcggcgactggagattcagctggagctacatcctgggctgggtggccgtgctgatgaccttcttcgccggcatcttctacatgtgcgcctacagagtgcacgagtgcagaagactgagcacccccagatag

SEQ ID NO: 86642 - DNA, 681 bp, Artificial Sequence
  Description of Artificial Sequence: Synthetic coding sequence
atgcccggcggccccggcgtgctgcaggccctgcccgccaccatcttcctgctgttcctgctgagcgccgtgtacctgggccccggctgccaggccctgtggatgcacaaggtgcccgccagcctgatggtgagcctgggcgaggacgcccacttccagtgcccccacaacagcagcaacaacgccaacgtgacctggtggagagtgctgcacggcaactacacctggccccccgagttcctgggccccggcgaggaccccaacggcaccctgatcatccagaacgtgaacaagagccacggcggcatctacgtgtgcagagtgcaggagggcaacgagagctaccagcagagctgcggcacctacctgagagtgagacagcccccccccagacccttcctggacatgggcgagggcaccaagaacagaatcatcaccgccgagggcatcatcctgctgttctgcgccgtggtgcccggcaccctgctgctgttcagaaagagatggcagaacgagaagctgggcctggacgccggcgacgagtacgaggacgagaacctgtacgagggcctgaacctggacgactgcagcatgtacgaggacatcagcagaggcctgcagggcacctaccaggacgtgggcagcctgaacatcggcgacgtgcagctggagaagccctag

SEQ ID NO: 86643 - DNA, 2001 bp, Artificial Sequence
  Description of Artificial Sequence: Synthetic coding sequence
atggccgacatggaggacctgttcggcagcgacgccgacagcgaggccgagagaaaggacagcgacagcggcagcgacagcgacagcgaccaggagaacgccgccagcggcagcaacgccagcggcagcgagagcgaccaggacgagagaggcgacagcggccagcccagcaacaaggagctgttcggcgacgacagcgaggacgagggcgccagccaccacagcggcagcgacaaccacagcgagagaagcgacaacagaagcgaggccagcgagagaagcgaccacgaggacaacgaccccagcgacgtggaccagcacagcggcagcgaggcccccaacgacgacgaggacgagggccacagaagcgacggcggcagccaccacagcgaggccgagggcagcgagaaggcccacagcgacgacgagaagtggggcagagaggacaagagcgaccagagcgacgacgagaagatccagaacagcgacgacgaggagagagcccagggcagcgacgaggacaagctgcagaacagcgacgacgacgagaagatgcagaacaccgacgacgaggagagaccccagctgagcgacgacgagagacagcagctgagcgaggaggagaaggccaacagcgacgacgagagacccgtggccagcgacaacgacgacgagaagcagaacagcgacgacgaggagcagccccagctgagcgacgaggagaagatgcagaacagcgacgacgagagaccccaggccagcgacgaggagcacagacacagcgacgacgaggaggagcaggaccacaagagcgagagcgccagaggcagcgacagcgaggacgaggtgctgagaatgaagagaaagaacgccatcgccagcgacagcgaggccgacagcgacaccgaggtgcccaaggacaacagcggcaccatggacctgttcggcggcgccgacgacatcagcagcggcagcgacggcgaggacaagccccccacccccggccagcccgtggacgagaacggcctgccccaggaccagcaggaggaggagcccatccccgagaccagaatcgaggtggagatccccaaggtgaacaccgacctgggcaacgacctgtacttcgtgaagctgcccaacttcctgagcgtggagcccagacccttcgacccccagtactacgaggacgagttcgaggacgaggagatgctggacgaggagggcagaaccagactgaagctgaaggtggagaacaccatcagatggagaatcagaagagacgaggagggcaacgagatcaaggagagcaacgccagaatcgtgaagtggagcgacggcagcatgagcctgcacctgggcaacgaggtgttcgacgtgtacaaggcccccctgcagggcgaccacaaccacctgttcatcagacagggcaccggcctgcagggccaggccgtgttcaagaccaagctgaccttcagaccccacagcaccgacagcgccacccacagaaagatgaccctgagcctggccgacagatgcagcaagacccagaagatcagaatcctgcccatggccggcagagaccccgagtgccagagaaccgagatgatcaagaaggaggaggagagactgagagccagcatcagaagagagagccagcagagaagaatgagagagaagcagcaccagagaggcctgagcgccagctacctggagcccgacagatacgacgaggaggaggagggcgaggagagcatcagcctggccgccatcaagaacagatacaagggcggcatcagagaggagagagccagaatctacagcagcgacagcgacgagggcagcgaggaggacaaggcccagagactgctgaaggccaagaagctgaccagcgacgaggagggcgagcccagcggcaagagaaaggccgaggacgacgacaaggccaacaagaagcacaagaagtacgtgatcagcgacgaggaggaggaggacgacgactag

SEQ ID NO: 86644 - DNA, 1821 bp, Artificial Sequence
  Description of Artificial Sequence: Synthetic coding sequence
atggccgacatggaggacctgttcggcagcgacgccgacagcgaggccgagagaaaggacagcgacagcggcagcgacagcgacagcgaccaggagaacgccgccagcggcagcaacgccagcggcagcgagagcgaccaggacgagagaggcgacagcggccagcccagcaacaaggagctgttcggcgacgacagcgaggacgagggcgccagccaccacagcggcagcgacaaccacagcgagagaagcgacaacagaagcgaggccagcgagagaagcgaccacgaggacaacgaccccagcgacgtggaccagcacagcggcagcgaggcccccaacgacgacgaggacgagggccacagaagcgacggcggcagccaccacagcgaggccgagggcagcgagaaggcccacagcgacgacgagaagtggggcagagaggacaagagcgaccagagcgacgacgagaagatccagaacagcgacgacgaggagagagcccagggcagcgacgaggacaagctgcagaacagcgacgacgacgagaagatgcagaacaccgacgacgaggagagaccccagctgagcgacgacgagagacagcagctgagcgaggaggagaaggccaacagcgacgacgagagacccgtggccagcgacaacgacgacgagaagcagaacagcgacgacgaggagcagccccagctgagcgacgaggagaagatgcagaacagcgacgacgagagaccccaggccagcgacgaggagcacagacacagcgacgacgaggaggagcaggaccacaagagcgagagcgccagaggcagcgacagcgaggacgaggtgctgagaatgaagagaaagaacgccatcgccagcgacagcgaggccgacagcgacaccgaggtgcccaaggacaacagcggcaccatggacctgttcggcggcgccgacgacatcagcagcggcagcgacggcgaggacaagccccccacccccggccagcccgtggacgagaacggcctgccccaggaccagcaggaggaggagcccatccccgagaccagaatcgaggtggagatccccaaggtgaacaccgacctgggcaacgacctgtacttcgtgaagctgcccaacttcctgagcgtggagcccagcatgagcctgcacctgggcaacgaggtgttcgacgtgtacaaggcccccctgcagggcgaccacaaccacctgttcatcagacagggcaccggcctgcagggccaggccgtgttcaagaccaagctgaccttcagaccccacagcaccgacagcgccacccacagaaagatgaccctgagcctggccgacagatgcagcaagacccagaagatcagaatcctgcccatggccggcagagaccccgagtgccagagaaccgagatgatcaagaaggaggaggagagactgagagccagcatcagaagagagagccagcagagaagaatgagagagaagcagcaccagagaggcctgagcgccagctacctggagcccgacagatacgacgaggaggaggagggcgaggagagcatcagcctggccgccatcaagaacagatacaagggcggcatcagagaggagagagccagaatctacagcagcgacagcgacgagggcagcgaggaggacaaggcccagagactgctgaaggccaagaagctgaccagcgacgaggagggcgagcccagcggcaagagaaaggccgaggacgacgacaaggccaacaagaagcacaagaagtacgtgatcagcgacgaggaggaggaggacgacgactag

SEQ ID NO: 86645 - DNA, 1935 bp, Artificial Sequence
  Description of Artificial Sequence: Synthetic coding sequence
atggccgacatggaggacctgttcggcagcgacgccgacagcgaggccgagagaaaggacagcgacagcggcagcgacagcgacagcgaccaggagaacgccgccagcggcagcaacgccagcggcagcgagagcgaccaggacgagagaggcgacagcggccagcccagcaacaaggagctgttcggcgacgacagcgaggacgagggcgccagccaccacagcggcagcgacaaccacagcgagagaagcgacaacagaagcgaggccagcgagagaagcgaccacgaggacaacgaccccagcgacgtggaccagcacagcggcagcgaggcccccaacgacgacgaggacgagggccacagaagcgacggcggcagccaccacagcgaggccgagggcagcgagaaggcccacagcgacgacgagaagtggggcagagaggacaagagcgaccagagcgacgacgagaagatccagaacagcgacgacgaggagagagcccagggcagcgacgaggacaagctgcagaacagcgacgacgacgagaagatgcagaacaccgacgacgaggagagaccccagctgagcgacgacgagagacagcagctgagcgaggaggagaaggccaacagcgacgacgagagacccgtggccagcgacaacgacgacgacgacgagagaccccaggccagcgacgaggagcacagacacagcgacgacgaggaggagcaggaccacaagagcgagagcgccagaggcagcgacagcgaggacgaggtgctgagaatgaagagaaagaacgccatcgccagcgacagcgaggccgacagcgacaccgaggtgcccaaggacaacagcggcaccatggacctgttcggcggcgccgacgacatcagcagcggcagcgacggcgaggacaagccccccacccccggccagcccgtggacgagaacggcctgccccaggaccagcaggaggaggagcccatccccgagaccagaatcgaggtggagatccccaaggtgaacaccgacctgggcaacgacctgtacttcgtgaagctgcccaacttcctgagcgtggagcccagacccttcgacccccagtactacgaggacgagttcgaggacgaggagatgctggacgaggagggcagaaccagactgaagctgaaggtggagaacaccatcagatggagaatcagaagagacgaggagggcaacgagatcaaggagagcaacgccagaatcgtgaagtggagcgacggcagcatgagcctgcacctgggcaacgaggtgttcgacgtgtacaaggcccccctgcagggcgaccacaaccacctgttcatcagacagggcaccggcctgcagggccaggccgtgttcaagaccaagctgaccttcagaccccacagcaccgacagcgccacccacagaaagatgaccctgagcctggccgacagatgcagcaagacccagaagatcagaatcctgcccatggccggcagagaccccgagtgccagagaaccgagatgatcaagaaggaggaggagagactgagagccagcatcagaagagagagccagcagagaagaatgagagagaagcagcaccagagaggcctgagcgccagctacctggagcccgacagatacgacgaggaggaggagggcgaggagagcatcagcctggccgccatcaagaacagatacaagggcggcatcagagaggagagagccagaatctacagcagcgacagcgacgagggcagcgaggaggacaaggcccagagactgctgaaggccaagaagctgaccagcgacgaggagggcgagcccagcggcaagagaaaggccgaggacgacgacaaggccaacaagaagcacaagaagtacgtgatcagcgacgaggaggaggaggacgacgactag

SEQ ID NO: 86646 - DNA, 2127 bp, Artificial Sequence
  Description of Artificial Sequence: Synthetic coding sequence
atgagagagagaatctgggccccccccctgctgctgctgctgcccctgctgctgcccccccccctgtggggcggcccccccgacagccccagaagagagctggagctggagcccggccccctgcagcccttcgacctgctgtacgccagcggcgccgccgcctactacagcggcgactacgagagagccgtgagagacctggaggccgccctgagaagccacagaagactgagagagatcagaaccagatgcgccagacactgcgccgccagacaccccctgcccccccccccccccggcgagggccccggcgccgagctgcccctgttcagaagcctgctgggcagagccagatgctacagaagctgcgagacccagagactgggcggccccgccagcagacacagagtgagcgaggacgtgagaagcgacttccagagaagagtgccctacaactacctgcagagagcctacatcaagctgaaccagctggagaaggccgtggaggccgcccacaccttcttcgtggccaaccccgagcacatggagatgcagcagaacatcgagaactacagagccaccgccggcgtggaggccctgcagctggtggacagagaggccaagccccacatggagagctacaacgccggcgtgaagcactacgaggccgacgacttcgagatggccatcagacacttcgagcaggccctgagagagtacttcgtggaggacaccgagtgcagaaccctgtgcgagggcccccagagattcgaggagtacgagtacctgggctacaaggccggcctgtacgaggccatcgccgaccactacatgcaggtgctggtgtgccagcacgagtgcgtgagagagctggccaccagacccggcagactgagccccatcgagaacttcctgcccctgcactacgactacctgcagttcgcctactacagagtgggcgagtacgtgaaggccctggagtgcgccaaggcctacctgctgtgccaccccgacgacgaggacgtgctggacaacgtggactactacgagagcctgctggacgacagcatcgaccccgccagcatcgaggccagagaggacctgaccatgttcgtgaagagacacaagctggagagcgagctgatcaagagcgccgccgagggcctgggcttcagctacaccgagcccaactactggatcagatacggcggcagacaggacgagaacagagtgcccagcggcgtgaacgtggagggcgccgaggtgcacggcttcagcatgggcaagaagctgagccccaagatcgacagagacctgagagagggcggccccctgctgtacgagaacatcaccttcgtgtacaacagcgagcagctgaacggcacccagagagtgctgctggacaacgtgctgagcgaggagcagtgcagagagctgcacagcgtggccagcggcatcatgctggtgggcgacggctacagaggcaagaccagcccccacacccccaacgagaagttcgagggcgccaccgtgctgaaggccctgaagagcggctacgagggcagagtgcccctgaagagcgccagactgttctacgacatcagcgagaaggccagaagaatcgtggagagctacttcatgctgaacagcaccctgtacttcagctacacccacatggtgtgcagaaccgccctgagcggccagcaggacagaagaaacgacctgagccaccccatccacgccgacaactgcctgctggaccccgaggccaacgagtgctggaaggagccccccgcctacaccttcagagactacagcgccctgctgtacatgaacgacgacttcgagggcggcgagttcatcttcaccgagatggacgccaagaccgtgaccgccagcatcaagcccaagtgcggcagaatgatcagcttcagcagcggcggcgagaacccccacggcgtgaaggccgtgaccaagggcaagagatgcgccgtggccctgtggttcaccctggaccccctgtacagagagctggagagaatccaggccgacgaggtgatcgccatcctggaccaggagcagcagggcaagcacgagctgaacatcaaccccaaggacgagctgtag

SEQ ID NO: 86647 - DNA, 1584 bp, Artificial Sequence
  Description of Artificial Sequence: Synthetic coding sequence
atggagatgcagcagaacatcgagaactacagagccaccgccggcgtggaggccctgcagctggtggacagagaggccaagccccacatggagagctacaacgccggcgtgaagcactacgaggccgacgacttcgagatggccatcagacacttcgagcaggccctgagagagtacttcgtggaggacaccgagtgcagaaccctgtgcgagggcccccagagattcgaggagtacgagtacctgggctacaaggccggcctgtacgaggccatcgccgaccactacatgcaggtgctggtgtgccagcacgagtgcgtgagagagctggccaccagacccggcagactgagccccatcgagaacttcctgcccctgcactacgactacctgcagttcgcctactacagagtgggcgagtacgtgaaggccctggagtgcgccaaggcctacctgctgtgccaccccgacgacgaggacgtgctggacaacgtggactactacgagagcctgctggacgacagcatcgaccccgccagcatcgaggccagagaggacctgaccatgttcgtgaagagacacaagctggagagcgagctgatcaagagcgccgccgagggcctgggcttcagctacaccgagcccaactactggatcagatacggcggcagacaggacgagaacagagtgcccagcggcgtgaacgtggagggcgccgaggtgcacggcttcagcatgggcaagaagctgagccccaagatcgacagagacctgagagagggcggccccctgctgtacgagaacatcaccttcgtgtacaacagcgagcagctgaacggcacccagagagtgctgctggacaacgtgctgagcgaggagcagtgcagagagctgcacagcgtggccagcggcatcatgctggtgggcgacggctacagaggcaagaccagcccccacacccccaacgagaagttcgagggcgccaccgtgctgaaggccctgaagagcggctacgagggcagagtgcccctgaagagcgccagactgttctacgacatcagcgagaaggccagaagaatcgtggagagctacttcatgctgaacagcaccctgtacttcagctacacccacatggtgtgcagaaccgccctgagcggccagcaggacagaagaaacgacctgagccaccccatccacgccgacaactgcctgctggaccccgaggccaacgagtgctggaaggagccccccgcctacaccttcagagactacagcgccctgctgtacatgaacgacgacttcgagggcggcgagttcatcttcaccgagatggacgccaagaccgtgaccgccagcatcaagcccaagtgcggcagaatgatcagcttcagcagcggcggcgagaacccccacggcgtgaaggccgtgaccaagggcaagagatgcgccgtggccctgtggttcaccctggaccccctgtacagagagctggagagaatccaggccgacgaggtgatcgccatcctggaccaggagcagcagggcaagcacgagctgaacatcaaccccaaggacgagctgtag

SEQ ID NO: 86648 - DNA, 2721 bp, Artificial Sequence
  Description of Artificial Sequence: Synthetic coding sequence
atgatctgccagaagttctgcgtggtgctgctgcactgggagttcatctacgtgatcaccgccttcaacctgagctaccccatcaccccctggagattcaagctgagctgcatgccccccaacagcacctacgactacttcctgctgcccgccggcctgagcaagaacaccagcaacagcaacggccactacgagaccgccgtggagcccaagttcaacagcagcggcacccacttcagcaacctgagcaagaccaccttccactgctgcttcagaagcgagcaggacagaaactgcagcctgtgcgccgacaacatcgagggcaagaccttcgtgagcaccgtgaacagcctggtgttccagcagatcgacgccaactggaacatccagtgctggctgaagggcgacctgaagctgttcatctgctacgtggagagcctgttcaagaacctgttcagaaactacaactacaaggtgcacctgctgtacgtgctgcccgaggtgctggaggacagccccctggtgccccagaagggcagcttccagatggtgcactgcaactgcagcgtgcacgagtgctgcgagtgcctggtgcccgtgcccaccgccaagctgaacgacaccctgctgatgtgcctgaagatcaccagcggcggcgtgatcttccagagccccctgatgagcgtgcagcccatcaacatggtgaagcccgacccccccctgggcctgcacatggagatcaccgacgacggcaacctgaagatcagctggagcagcccccccctggtgcccttccccctgcagtaccaggtgaagtacagcgagaacagcaccaccgtgatcagagaggccgacaagatcgtgagcgccaccagcctgctggtggacagcatcctgcccggcagcagctacgaggtgcaggtgagaggcaagagactggacggccccggcatctggagcgactggagcacccccagagtgttcaccacccaggacgtgatctacttcccccccaagatcctgaccagcgtgggcagcaacgtgagcttccactgcatctacaagaaggagaacaagatcgtgcccagcaaggagatcgtgtggtggatgaacctggccgagaagatcccccagagccagtacgacgtggtgagcgaccacgtgagcaaggtgaccttcttcaacctgaacgagaccaagcccagaggcaagttcacctacgacgccgtgtactgctgcaacgagcacgagtgccaccacagatacgccgagctgtacgtgatcgacgtgaacatcaacatcagctgcgagaccgacggctacctgaccaagatgacctgcagatggagcaccagcaccatccagagcctggccgagagcaccctgcagctgagataccacagaagcagcctgtactgcagcgacatccccagcatccaccccatcagcgagcccaaggactgctacctgcagagcgacggcttctacgagtgcatcttccagcccatcttcctgctgagcggctacaccatgtggatcagaatcaaccacagcctgggcagcctggacagcccccccacctgcgtgctgcccgacagcgtggtgaagcccctgccccccagcagcgtgaaggccgagatcaccatcaacatcggcctgctgaagatcagctgggagaagcccgtgttccccgagaacaacctgcagttccagatcagatacggcctgagcggcaaggaggtgcagtggaagatgtacgaggtgtacgacgccaagagcaagagcgtgagcctgcccgtgcccgacctgtgcgccgtgtacgccgtgcaggtgagatgcaagagactggacggcctgggctactggagcaactggagcaaccccgcctacaccgtggtgatggacatcaaggtgcccatgagaggccccgagttctggagaatcatcaacggcgacaccatgaagaaggagaagaacgtgaccctgctgtggaagcccctgatgaagaacgacagcctgtgcagcgtgcagagatacgtgatcaaccaccacaccagctgcaacggcacctggagcgaggacgtgggcaaccacaccaagttcaccttcctgtggaccgagcaggcccacaccgtgaccgtgctggccatcaacagcatcggcgccagcgtggccaacttcaacctgaccttcagctggcccatgagcaaggtgaacatcgtgcagagcctgagcgcctaccccctgaacagcagctgcgtgatcgtgagctggatcctgagccccagcgactacaagctgatgtacttcatcatcgagtggaagaacctgaacgaggacggcgagatcaagtggctgagaatcagcagcagcgtgaagaagtactacatccacgaccacttcatccccatcgagaagtaccagttcagcctgtaccccatcttcatggagggcgtgggcaagcccaagatcatcaacagcttcacccaggacgacatcgagaagcaccagagcgacgccggcctgtacgtgatcgtgcccgtgatcatcagcagcagcatcctgctgctgggcaccctgctgatcagccaccagagaatgaagaagctgttctgggaggacgtgcccaaccccaagaactgcagctgggcccagggcctgaacttccagaagaagatgcccggcaccaaggagctgctgggcggcggctggctgacctag

SEQ ID NO: 86649 - DNA, 3498 bp, Artificial Sequence
  Description of Artificial Sequence: Synthetic coding sequence
atgatctgccagaagttctgcgtggtgctgctgcactgggagttcatctacgtgatcaccgccttcaacctgagctaccccatcaccccctggagattcaagctgagctgcatgccccccaacagcacctacgactacttcctgctgcccgccggcctgagcaagaacaccagcaacagcaacggccactacgagaccgccgtggagcccaagttcaacagcagcggcacccacttcagcaacctgagcaagaccaccttccactgctgcttcagaagcgagcaggacagaaactgcagcctgtgcgccgacaacatcgagggcaagaccttcgtgagcaccgtgaacagcctggtgttccagcagatcgacgccaactggaacatccagtgctggctgaagggcgacctgaagctgttcatctgctacgtggagagcctgttcaagaacctgttcagaaactacaactacaaggtgcacctgctgtacgtgctgcccgaggtgctggaggacagccccctggtgccccagaagggcagcttccagatggtgcactgcaactgcagcgtgcacgagtgctgcgagtgcctggtgcccgtgcccaccgccaagctgaacgacaccctgctgatgtgcctgaagatcaccagcggcggcgtgatcttccagagccccctgatgagcgtgcagcccatcaacatggtgaagcccgacccccccctgggcctgcacatggagatcaccgacgacggcaacctgaagatcagctggagcagcccccccctggtgcccttccccctgcagtaccaggtgaagtacagcgagaacagcaccaccgtgatcagagaggccgacaagatcgtgagcgccaccagcctgctggtggacagcatcctgcccggcagcagctacgaggtgcaggtgagaggcaagagactggacggccccggcatctggagcgactggagcacccccagagtgttcaccacccaggacgtgatctacttcccccccaagatcctgaccagcgtgggcagcaacgtgagcttccactgcatctacaagaaggagaacaagatcgtgcccagcaaggagatcgtgtggtggatgaacctggccgagaagatcccccagagccagtacgacgtggtgagcgaccacgtgagcaaggtgaccttcttcaacctgaacgagaccaagcccagaggcaagttcacctacgacgccgtgtactgctgcaacgagcacgagtgccaccacagatacgccgagctgtacgtgatcgacgtgaacatcaacatcagctgcgagaccgacggctacctgaccaagatgacctgcagatggagcaccagcaccatccagagcctggccgagagcaccctgcagctgagataccacagaagcagcctgtactgcagcgacatccccagcatccaccccatcagcgagcccaaggactgctacctgcagagcgacggcttctacgagtgcatcttccagcccatcttcctgctgagcggctacaccatgtggatcagaatcaaccacagcctgggcagcctggacagcccccccacctgcgtgctgcccgacagcgtggtgaagcccctgccccccagcagcgtgaaggccgagatcaccatcaacatcggcctgctgaagatcagctgggagaagcccgtgttccccgagaacaacctgcagttccagatcagatacggcctgagcggcaaggaggtgcagtggaagatgtacgaggtgtacgacgccaagagcaagagcgtgagcctgcccgtgcccgacctgtgcgccgtgtacgccgtgcaggtgagatgcaagagactggacggcctgggctactggagcaactggagcaaccccgcctacaccgtggtgatggacatcaaggtgcccatgagaggccccgagttctggagaatcatcaacggcgacaccatgaagaaggagaagaacgtgaccctgctgtggaagcccctgatgaagaacgacagcctgtgcagcgtgcagagatacgtgatcaaccaccacaccagctgcaacggcacctggagcgaggacgtgggcaaccacaccaagttcaccttcctgtggaccgagcaggcccacaccgtgaccgtgctggccatcaacagcatcggcgccagcgtggccaacttcaacctgaccttcagctggcccatgagcaaggtgaacatcgtgcagagcctgagcgcctaccccctgaacagcagctgcgtgatcgtgagctggatcctgagccccagcgactacaagctgatgtacttcatcatcgagtggaagaacctgaacgaggacggcgagatcaagtggctgagaatcagcagcagcgtgaagaagtactacatccacgaccacttcatccccatcgagaagtaccagttcagcctgtaccccatcttcatggagggcgtgggcaagcccaagatcatcaacagcttcacccaggacgacatcgagaagcaccagagcgacgccggcctgtacgtgatcgtgcccgtgatcatcagcagcagcatcctgctgctgggcaccctgctgatcagccaccagagaatgaagaagctgttctgggaggacgtgcccaaccccaagaactgcagctgggcccagggcctgaacttccagaagcccgagaccttcgagcacctgttcatcaagcacaccgccagcgtgacctgcggccccctgctgctggagcccgagaccatcagcgaggacatcagcgtggacaccagctggaagaacaaggacgagatgatgcccaccaccgtggtgagcctgctgagcaccaccgacctggagaagggcagcgtgtgcatcagcgaccagttcaacagcgtgaacttcagcgaggccgagggcaccgaggtgacctacgaggacgagagccagagacagcccttcgtgaagtacgccaccctgatcagcaacagcaagcccagcgagaccggcgaggagcagggcctgatcaacagcagcgtgaccaagtgcttcagcagcaagaacagccccctgaaggacagcttcagcaacagcagctgggagatcgaggcccaggccttcttcatcctgagcgaccagcaccccaacatcatcagcccccacctgaccttcagcgagggcctggacgagctgctgaagctggagggcaacttccccgaggagaacaacgacaagaagagcatctactacctgggcgtgaccagcatcaagaagagagagagcggcgtgctgctgaccgacaagagcagagtgagctgccccttccccgccccctgcctgttcaccgacatcagagtgctgcaggacagctgcagccacttcgtggagaacaacatcaacctgggcaccagcagcaagaagaccttcgccagctacatgccccagttccagacctgcagcacccagacccacaagatcatggagaacaagatgtgcgacctgaccgtgtag

SEQ ID NO: 86650 - DNA, 2721 bp, Artificial Sequence; identical to SEQ ID NO: 86648
  Description of Artificial Sequence: Synthetic coding sequence

SEQ ID NO: 86651 - DNA, 2877 bp, Artificial Sequence
  Description of Artificial Sequence: Synthetic coding sequence
atgatctgccagaagttctgcgtggtgctgctgcactgggagttcatctacgtgatcaccgccttcaacctgagctaccccatcaccccctggagattcaagctgagctgcatgccccccaacagcacctacgactacttcctgctgcccgccggcctgagcaagaacaccagcaacagcaacggccactacgagaccgccgtggagcccaagttcaacagcagcggcacccacttcagcaacctgagcaagaccaccttccactgctgcttcagaagcgagcaggacagaaactgcagcctgtgcgccgacaacatcgagggcaagaccttcgtgagcaccgtgaacagcctggtgttccagcagatcgacgccaactggaacatccagtgctggctgaagggcgacctgaagctgttcatctgctacgtggagagcctgttcaagaacctgttcagaaactacaactacaaggtgcacctgctgtacgtgctgcccgaggtgctggaggacagccccctggtgccccagaagggcagcttccagatggtgcactgcaactgcagcgtgcacgagtgctgcgagtgcctggtgcccgtgcccaccgccaagctgaacgacaccctgctgatgtgcctgaagatcaccagcggcggcgtgatcttccagagccccctgatgagcgtgcagcccatcaacatggtgaagcccgacccccccctgggcctgcacatggagatcaccgacgacggcaacctgaagatcagctggagcagcccccccctggtgcccttccccctgcagtaccaggtgaagtacagcgagaacagcaccaccgtgatcagagaggccgacaagatcgtgagcgccaccagcctgctggtggacagcatcctgcccggcagcagctacgaggtgcaggtgagaggcaagagactggacggccccggcatctggagcgactggagcacccccagagtgttcaccacccaggacgtgatctacttcccccccaagatcctgaccagcgtgggcagcaacgtgagcttccactgcatctacaagaaggagaacaagatcgtgcccagcaaggagatcgtgtggtggatgaacctggccgagaagatcccccagagccagtacgacgtggtgagcgaccacgtgagcaaggtgaccttcttcaacctgaacgagaccaagcccagaggcaagttcacctacgacgccgtgtactgctgcaacgagcacgagtgccaccacagatacgccgagctgtacgtgatcgacgtgaacatcaacatcagctgcgagaccgacggctacctgaccaagatgacctgcagatggagcaccagcaccatccagagcctggccgagagcaccctgcagctgagataccacagaagcagcctgtactgcagcgacatccccagcatccaccccatcagcgagcccaaggactgctacctgcagagcgacggcttctacgagtgcatcttccagcccatcttcctgctgagcggctacaccatgtggatcagaatcaaccacagcctgggcagcctggacagcccccccacctgcgtgctgcccgacagcgtggtgaagcccctgccccccagcagcgtgaaggccgagatcaccatcaacatcggcctgctgaagatcagctgggagaagcccgtgttccccgagaacaacctgcagttccagatcagatacggcctgagcggcaaggaggtgcagtggaagatgtacgaggtgtacgacgccaagagcaagagcgtgagcctgcccgtgcccgacctgtgcgccgtgtacgccgtgcaggtgagatgcaagagactggacggcctgggctactggagcaactggagcaaccccgcctacaccgtggtgatggacatcaaggtgcccatgagaggccccgagttctggagaatcatcaacggcgacaccatgaagaaggagaagaacgtgaccctgctgtggaagcccctgatgaagaacgacagcctgtgcagcgtgcagagatacgtgatcaaccaccacaccagctgcaacggcacctggagcgaggacgtgggcaaccacaccaagttcaccttcctgtggaccgagcaggcccacaccgtgaccgtgctggccatcaacagcatcggcgccagcgtggccaacttcaacctgaccttcagctggcccatgagcaaggtgaacatcgtgcagagcctgagcgcctaccccctgaacagcagctgcgtgatcgtgagctggatcctgagccccagcgactacaagctgatgtacttcatcatcgagtggaagaacctgaacgaggacggcgagatcaagtggctgagaatcagcagcagcgtgaagaagtactacatccacgaccacttcatccccatcgagaagtaccagttcagcctgtaccccatcttcatggagggcgtgggcaagcccaagatcatcaacagcttcacccaggacgacatcgagaagcaccagagcgacgccggcctgtacgtgatcgtgcccgtgatcatcagcagcagcatcctgctgctgggcaccctgctgatcagccaccagagaatgaagaagctgttctgggaggacgtgcccaaccccaagaactgcagctgggcccagggcctgaacttccagaagatgctggagggcagcatgttcgtgaagagccaccaccacagcctgatcagcagcacccagggccacaagcactgcggcagaccccagggccccctgcacagaaagaccagagacctgtgcagcctggtgtacctgctgaccctgccccccctgctgagctacgaccccgccaagagccccagcgtgagaaacacccaggagtag

SEQ ID NO: 86652 - DNA, 2691 bp, Artificial Sequence
  Description of Artificial Sequence: Synthetic coding sequence
atgatctgccagaagttctgcgtggtgctgctgcactgggagttcatctacgtgatcaccgccttcaacctgagctaccccatcaccccctggagattcaagctgagctgcatgccccccaacagcacctacgactacttcctgctgcccgccggcctgagcaagaacaccagcaacagcaacggccactacgagaccgccgtggagcccaagttcaacagcagcggcacccacttcagcaacctgagcaagaccaccttccactgctgcttcagaagcgagcaggacagaaactgcagcctgtgcgccgacaacatcgagggcaagaccttcgtgagcaccgtgaacagcctggtgttccagcagatcgacgccaactggaacatccagtgctggctgaagggcgacctgaagctgttcatctgctacgtggagagcctgttcaagaacctgttcagaaactacaactacaaggtgcacctgctgtacgtgctgcccgaggtgctggaggacagccccctggtgccccagaagggcagcttccagatggtgcactgcaactgcagcgtgcacgagtgctgcgagtgcctggtgcccgtgcccaccgccaagctgaacgacaccctgctgatgtgcctgaagatcaccagcggcggcgtgatcttccagagccccctgatgagcgtgcagcccatcaacatggtgaagcccgacccccccctgggcctgcacatggagatcaccgacgacggcaacctgaagatcagctggagcagcccccccctggtgcccttccccctgcagtaccaggtgaagtacagcgagaacagcaccaccgtgatcagagaggccgacaagatcgtgagcgccaccagcctgctggtggacagcatcctgcccggcagcagctacgaggtgcaggtgagaggcaagagactggacggccccggcatctggagcgactggagcacccccagagtgttcaccacccaggacgtgatctacttcccccccaagatcctgaccagcgtgggcagcaacgtgagcttccactgcatctacaagaaggagaacaagatcgtgcccagcaaggagatcgtgtggtggatgaacctggccgagaagatcccccagagccagtacgacgtggtgagcgaccacgtgagcaaggtgaccttcttcaacctgaacgagaccaagcccagaggcaagttcacctacgacgccgtgtactgctgcaacgagcacgagtgccaccacagatacgccgagctgtacgtgatcgacgtgaacatcaacatcagctgcgagaccgacggctacctgaccaagatgacctgcagatggagcaccagcaccatccagagcctggccgagagcaccctgcagctgagataccacagaagcagcctgtactgcagcgacatccccagcatccaccccatcagcgagcccaaggactgctacctgcagagcgacggcttctacgagtgcatcttccagcccatcttcctgctgagcggctacaccatgtggatcagaatcaaccacagcctgggcagcctggacagcccccccacctgcgtgctgcccgacagcgtggtgaagcccctgccccccagcagcgtgaaggccgagatcaccatcaacatcggcctgctgaagatcagctgggagaagcccgtgttccccgagaacaacctgcagttccagatcagatacggcctgagcggcaaggaggtgcagtggaagatgtacgaggtgtacgacgccaagagcaagagcgtgagcctgcccgtgcccgacctgtgcgccgtgtacgccgtgcaggtgagatgcaagagactggacggcctgggctactggagcaactggagcaaccccgcctacaccgtggtgatggacatcaaggtgcccatgagaggccccgagttctggagaatcatcaacggcgacaccatgaagaaggagaagaacgtgaccctgctgtggaagcccctgatgaagaacgacagcctgtgcagcgtgcagagatacgtgatcaaccaccacaccagctgcaacggcacctggagcgaggacgtgggcaaccacaccaagttcaccttcctgtggaccgagcaggcccacaccgtgaccgtgctggccatcaacagcatcggcgccagcgtggccaacttcaacctgaccttcagctggcccatgagcaaggtgaacatcgtgcagagcctgagcgcctaccccctgaacagcagctgcgtgatcgtgagctggatcctgagccccagcgactacaagctgatgtacttcatcatcgagtggaagaacctgaacgaggacggcgagatcaagtggctgagaatcagcagcagcgtgaagaagtactacatccacgaccacttcatccccatcgagaagtaccagttcagcctgtaccccatcttcatggagggcgtgggcaagcccaagatcatcaacagcttcacccaggacgacatcgagaagcaccagagcgacgccggcctgtacgtgatcgtgcccgtgatcatcagcagcagcatcctgctgctgggcaccctgctgatcagccaccagagaatgaagaagctgttctgggaggacgtgcccaaccccaagaactgcagctgggcccagggcctgaacttccagaagagaaccgacatcctgtag

SEQ ID NO: 86653 - DNA, 699 bp, Artificial Sequence
  Description of Artificial Sequence: Synthetic coding sequence
atgatgcccaccaccgtggtgagcctgctgagcaccaccgacctggagaagggcagcgtgtgcatcagcgaccagttcaacagcgtgaacttcagcgaggccgagggcaccgaggtgacctacgaggacgagagccagagacagcccttcgtgaagtacgccaccctgatcagcaacagcaagcccagcgagaccggcgaggagcagggcctgatcaacagcagcgtgaccaagtgcttcagcagcaagaacagccccctgaaggacagcttcagcaacagcagctgggagatcgaggcccaggccttcttcatcctgagcgaccagcaccccaacatcatcagcccccacctgaccttcagcgagggcctggacgagctgctgaagctggagggcaacttccccgaggagaacaacgacaagaagagcatctactacctgggcgtgaccagcatcaagaagagagagagcggcgtgctgctgaccgacaagagcagagtgagctgccccttccccgccccctgcctgttcaccgacatcagagtgctgcaggacagctgcagccacttcgtggagaacaacatcaacctgggcaccagcagcaagaagaccttcgccagctacatgccccagttccagacctgcagcacccagacccacaagatcatggagaacaagatgtgcgacctgaccgtgtag

SEQ ID NO: 86654 - DNA, 396 bp, Artificial Sequence
  Description of Artificial Sequence: Synthetic coding sequence
atggccggcgtgaaggccctggtggccctgagcttcagcggcgccatcggcctgaccttcctgatgctgggctgcgccctggaggactacggcgtgtactggcccctgttcgtgctgatcttccacgccatcagccccatcccccacttcatcgccaagagagtgacctacgacagcgacgccaccagcagcgcctgcagagagctggcctacttcttcaccaccggcatcgtggtgagcgccttcggcttccccgtgatcctggccagagtggccgtgatcaagtggggcgcctgcggcctggtgctggccggcaacgccgtgatcttcctgaccatccagggcttcttcctgatcttcggcagaggcgacgacttcagctgggagcagtggtag

SEQ ID NO: 86655 - DNA, 396 bp, Artificial Sequence
  Description of Artificial Sequence: Synthetic coding sequence
atggccggcatcaaggccctgatcagcctgagcttcggcggcgccatcggcctgatgttcctgatgctgggctgcgccctgcccatctacaacaagtactggcccctgttcgtgctgttcttctacatcctgagccccatcccctactgcatcgccagaagactggtggacgacaccgacgccatgagcaacgcctgcaaggagctggccatcttcctgaccaccggcatcgtggtgagcgccttcggcctgcccatcgtgttcgccagagcccacctgatcgagtggggcgcctgcgccctggtgctgaccggcaacaccgtgatcttcgccaccatcctgggcttcttcctggtgttcggcagcaacgacgacttcagctggcagcagtggtag

SEQ ID NO: 86656 - DNA, 510 bp, Artificial Sequence
  Description of Artificial Sequence: Synthetic coding sequence
atggccggcatcaaggccctgatcagcctgagcttcggcggcgccatcggcctgatgttcctgatgctgggctgcgccctgcccatctacaacaagtactggcccctgttcgtgctgttcttctacatcctgagccccatcccctactgcatcgccagaagactggtggacgacaccgacgccatgagcaacgcctgcaaggagctggccatcttcctgaccaccggcatcgtggtgagcgccttcggcctgcccatcgtgttcgccagagcccacctgatgggcagactgcccttcttcagcaagatgggcaccgccgagagcgagggcagagagaccctgacccagcagctgcccctgcccgccgccgccatgagaagactgctgcccgccagcagagtgagcacccagcccgtgctgagactggccgacagcgccgagagcctgctgggcagacccgccctgtgggccctgggcttcctgctgtgcccccccagccaggcccagtag

SEQ ID NO: 86657 - DNA, 3195 bp, Artificial Sequence
  Description of Artificial Sequence: Synthetic coding sequence
atgatgaagttcagattcagaagacagggcgccgacccccagagagagaagctgaagcaggagctgttcgccttcaacaagaccgtggagcacggcttccccaaccagcccagcgccctggccttcgaccccgagctgagaatcatggccatcggcaccagaagcggcgccgtgaagatctacggcgcccccggcgtggagttcaccggcctgcacagagacgccgccaccgtgacccagatgcacttcctgaccggccagggcagactgctgagcctgctggacgacagcagcctgcacctgtgggagatcgtgcaccacaacggctgcgcccacctggaggaggccctgagcttccagctgcccagcagacccggcttcgacggcgccagcgcccccctgagcctgaccagagtgaccgtggtgctgctggtggccgccagcgacatcgccgccctgggcaccgagggcagcagcgtgttcttcctggacgtgaccaccctgaccctgctggagggccagaccctggcccccggcgaggtgctgagaagcgtgcccgacgactacagatgcggcaaggccctgggccccgtggagagcctgcagggccacctgagagaccccaccaagatcctgatcggctacagcagaggcctgctggtgatctggaaccaggccagccagtgcgtggaccacatcttcctgggcaaccagcagctggagagcctgtgctggggcagagacagcagcaccgtggtgagcagccacagcgacggcagctacgccgtgtggagcgtggacgccggcagcttccccaccctgcagcccaccgtggccaccaccccctacggccccttcccctgcaaggccatcaacaagatcctgtggagaaactgcgagagcggcggccacttcatcatcttcagcggcggcatgcccagagccagctacggcgacagacactgcgtgagcgtgctgagagccgagaccctggtgaccctggacttcaccagcagaatcatcgacttcttcaccgtgcacagcaccagacccgaggacgagttcgacgacccccaggccctggccgtgctgctggaggaggagctggtggtgctggacctgcagacccccggctggcccgccgtgcccgccccctacctggcccccctgcacagcagcgccatcacctgcagcgcccacgtggccagcgtgcccgccaagctgtgggccagaatcgtgagcgccggcgagcagcagagcccccagcccgtgagcagcgccctgagctggcccatcaccggcggcagaaacctggcccaggagcccagccagagaggcctgctgctgaccggccacgaggacggcaccgtgagattctgggacgccagcggcgtggccctgagacccctgtacaagctgagcaccgccggcctgttccagaccgactgcgagcacgccgacagcctggcccaggccgccgaggacgactggccccccttcagaaaggtgggctgcttcgacccctacagcgacgaccccagactgggcgtgcagaaggtggccctgtgcaagtacaccgcccagatggtggtggccggcaccgccggccaggtgctggtgctggagctgagcgacgtgcccgtggagcaggccgtgagcgtggccatcatcgacctgctgcaggacagagagggcttcacctggaagggccacgagagactgagccccagaaccggccccctgccctggcccgccggcttccagcccagagtgctggtgcagtgcctgccccccgccgccgtgaccgccgtgaccctgcacaccgagtggagcctggtggccttcggcaccagccacggcttcggcctgttcgactaccagagaaagagccccgtgctggccagatgcaccctgcaccccaacgacagcctggccatggagggccccctgagcagagtgaagagcctgaagaagagcctgagacagagcttcagaagaatcagaaagagcagagtgagcggcaagaagagagccgccaacgccagcagcaagctgcaggaggccaacgcccagctggccgagcaggcctgcccccacgacgtggagatgacccccgtgcagagaagaatcgagcccagaagcgccgacgacagcctgagcggcgtggtgagatgcctgtacttcgccgacaccttcctgagagacggcgcccaccacggccccaccatgtgggccggcaccaacagcggcagcgtgttcgcctacgccctggaggtgcccgccgccgccgtgggcggcgagaagagacccgagcaggccgtggaggccgtgctgggcaaggaggtgcagctgatgcacagagcccccgtggtggccatcgccgtgctggacggcagaggcagacccctgcccgagccctacgaggccagcagagacctggcccaggcccccgacatgcagggcggccacgccgtgctgatcgccagcgaggagcagttcaaggtgttcaccctgcccaaggtgagcgccaagaccaagttcaagctgaccgcccacgagggctgcagagtgagaaaggtggccctggccaccttcgccagcgtggcctgcgaggactacgccgagacctgcctggcctgcctgaccaacctgggcgacgtgcacgtgttcagcgtgcccggcctgagaccccaggtgcactacagctgcatcagaaaggaggacatcagcggcatcgccagctgcgtgttcaccagacacggccagggcttctacctgatcagccccagcgagttcgagagattcagcctgagcgccagaaacatcaccgagcccctgtgcagcctggacatcaactggcccagagacgccacccaggccagctacagaatcagagagagccccaagctgagccaggccaacggcacccccagcatcctgctggccccccagagcctggacggcagccccgaccccgcccacagcatgggccccgacacccccgagccccccgaggccgccctgagccccatgagcatcgacagcgccaccagcgccgacaccaccctggacaccaccggcgacgtgaccgtggaggacgtgaaggacttcctgggcagcagcgaggagagcgagaagaacctgagaaacctggccgaggacgaggcccacgcctgcgccatcctgatcaagtag

SEQ ID NO: 86658 - DNA, 1056 bp, Artificial Sequence
  Description of Artificial Sequence: Synthetic coding sequence
gagctgcccagcgccgcccccgacagcaccctgctgctgaccgcccagcactgggtggccaacctgttcatcctggccaccctgatcggctggaccgtgagaagcttcttcctgggcagaatggagacctgctgcagccacctgggcctgagaagcggcagaagattcgccgtgagcatcggctactggcacgacccctacatccagcacttcgtgagactgagcaaggagagaaaggcccccgagatcaacagaggctacttcgccagagtgcacggcgtgagccagctgatcaaggccttcctgagaaagaccgagtgccactgccagatcgtgaacctgggcgccggcatggacaccaccttctggagactgaaggacgaggacctgctgcccagcaagtacttcgaggtggacttccccatgatcgtgaccagaaagctgcacagcatcaagtgcaagccccccctgagcagccccatcctggagctgcacagcgaggacaccctgcagatggacggccacatcctggacagcaagagatacgccgtgatcggcgccgacctgagagacctgagcgagctggaggagaagctgaagaagtgcaacatgaacacccagctgcccaccctgctgatcgccgagtgcgtgctggtgtacatgacccccgagcagagcgccaacctgctgaagtgggccgccaacagcttcgagagagccatgttcatcaactacgagcaggtgaacatgggcgacagattcggccagatcatgatcgagaacctgagaagaagacagtgcgacctggccggcgtggagacctgcaagagcctggagagccagaaggagagactgctgagcaacggctgggagaccgccagcgccgtggacatgatggagctgtacaacagactgcccagagccgaggtgagcagaatcgagagcctggagttcctggacgagatggagctgctggagcagctgatgagacactactgcctgtgctgggccaccaagggcggcaacgagctgggcctgaaggagatcacctactag

SEQ ID NO: 86659 - DNA, 840 bp, Artificial Sequence
  Description of Artificial Sequence: Synthetic coding sequence
atggccaccagacagagagagagcagcatcaccagctgctgcagcaccagcagctgcgacgccgacgacgagggcgtgagaggcacctgcgaggacgccagcctgtgcaagagattcgccgtgagcatcggctactggcacgacccctacatccagcacttcgtgagactgagcaaggagagaaaggcccccgagatcaacagaggctacttcgccagagtgcacggcgtgagccagctgatcaaggccttcctgagaaagaccgagtgccactgccagatcgtgaacctgggcgccggcatggacaccaccttctggagactgaaggacgaggacctgctgcccagcaagtacttcgaggtggacttccccatgatcgtgaccagaaagctgcacagcatcaagctgcccaccctgctgatcgccgagtgcgtgctggtgtacatgacccccgagcagagcgccaacctgctgaagtgggccgccaacagcttcgagagagccatgttcatcaactacgagcaggtgaacatgggcgacagattcggccagatcatgatcgagaacctgagaagaagacagtgcgacctggccggcgtggagacctgcaagagcctggagagccagaaggagagactgctgagcaacggctgggagaccgccagcgccgtggacatgatggagctgtacaacagactgcccagagccgaggtgagcagaatcgagagcctggagttcctggacgagatggagctgctggagcagctgatgagacactactgcctgtgctgggccaccaagggcggcaacgagctgggcctgaaggagatcacctactag

SEQ ID NO: 86660 - DNA, 1005 bp, Artificial Sequence
  Description of Artificial Sequence: Synthetic coding sequence
atggccaccagacagagagagagcagcatcaccagctgctgcagcaccagcagctgcgacgccgacgacgagggcgtgagaggcacctgcgaggacgccagcctgtgcaagagattcgccgtgagcatcggctactggcacgacccctacatccagcacttcgtgagactgagcaaggagagaaaggcccccgagatcaacagaggctacttcgccagagtgcacggcgtgagccagctgatcaaggccttcctgagaaagaccgagtgccactgccagatcgtgaacctgggcgccggcatggacaccaccttctggagactgaaggacgaggacctgctgcccagcaagtacttcgaggtggacttccccatgatcgtgaccagaaagctgcacagcatcaagtgcaagccccccctgagcagccccatcctggagctgcacagcgaggacaccctgcagatggacggccacatcctggacagcaagagatacgccgtgatcggcgccgacctgagagacctgagcgagctggaggagaagctgaagaagtgcaacatgaacacccagctgcccaccctgctgatcgccgagtgcgtgctggtgtacatgacccccgagcagagcgccaacctgctgaagtgggccgccaacagcttcgagagagccatgttcatcaactacgagcaggtgaacatgggcgacagattcggccagatcatgatcgagaacctgagaagaagacagtgcgacctggccggcgtggagacctgcaagagcctggagagccagaaggagagactgctgagcaacggctgggagaccgccagcgccgtggacatgatggagctgtacaacagactgcccagagccgaggtgagcagaatcgagagcctggagttcctggacgagatggagctgctggagcagctgatgagacactactgcctgtgctgggccaccaagggcggcaacgagctgggcctgaaggagatcacctactag

SEQ ID NO: 86661 - DNA, 2415 bp, Artificial Sequence
  Description of Artificial Sequence: Synthetic coding sequence
atggccgtgagagccctgaagctgctgaccaccctgctggccgtggtggccgccgccagccaggccgaggtggagagcgaggccggctggggcatggtgacccccgacctgctgttcgccgagggcaccgccgcctacgccagaggcgactggcccggcgtggtgctgagcatggagagagccctgagaagcagagccgccctgagagccctgagactgagatgcagaacccagtgcgccgccgacttcccctgggagctggaccccgactggagccccagccccgcccaggccagcggcgccgccgccctgagagacctgagcttcttcggcggcctgctgagaagagccgcctgcctgagaagatgcctgggcccccccgccgcccacagcctgagcgaggagatggagctggagttcagaaagagaagcccctacaactacctgcaggtggcctacttcaagatcaacaagctggagaaggccgtggccgccgcccacaccttcttcgtgggcaaccccgagcacatggagatgcagcagaacctggactactaccagaccatgagcggcgtgaaggaggccgacttcaaggacctggagacccagccccacatgcaggagttcagactgggcgtgagactgtacagcgaggagcagccccaggaggccgtgccccacctggaggccgccctgcaggagtacttcgtggcctacgaggagtgcagagccctgtgcgagggcccctacgactacgacggctacaactacctggagtacaacgccgacctgttccaggccatcaccgaccactacatccaggtgctgaactgcaagcagaactgcgtgaccgagctggccagccaccccagcagagagaagcccttcgaggacttcctgcccagccactacaactacctgcagttcgcctactacaacatcggcaactacacccaggccgtggagtgcgccaagacctacctgctgttcttccccaacgacgaggtgatgaaccagaacctggcctactacgccgccatgctgggcgaggagcacaccagaagcatcggccccagagagagcgccaaggagtacagacagagaagcctgctggagaaggagctgctgttcttcgcctacgacgtgttcggcatccccttcgtggaccccgacagctggacccccgaggaggtgatccccaagagactgcaggagaagcagaagagcgagagagagaccgccgtgagaatcagccaggagatcggcaacctgatgaaggagatcgagaccctggtggaggagaagaccaaggagagcctggacgtgagcagactgaccagagagggcggccccctgctgtacgagggcatcagcctgaccatgaacagcaagctgctgaacggcagccagagagtggtgatggacggcgtgatcagcgaccacgagtgccaggagctgcagagactgaccaacgtggccgccaccagcggcgacggctacagaggccagaccagcccccacacccccaacgagaagttctacggcgtgaccgtgttcaaggccctgaagctgggccaggagggcaaggtgcccctgcagagcgcccacctgtactacaacgtgaccgagaaggtgagaagaatcatggagagctacttcagactggacacccccctgtacttcagctacagccacctggtgtgcagaaccgccatcgaggaggtgcaggccgagagaaaggacgacagccaccccgtgcacgtggacaactgcatcctgaacgccgagaccctggtgtgcgtgaaggagccccccgcctacaccttcagagactacagcgccatcctgtacctgaacggcgacttcgacggcggcaacttctacttcaccgagctggacgccaagaccgtgaccgccgaggtgcagccccagtgcggcagagccgtgggcttcagcagcggcaccgagaacccccacggcgtgaaggccgtgaccagaggccagagatgcgccatcgccctgtggttcaccctggaccccagacacagcgagagagtgagagccgccagagccggcgagagcagctggtgctgcggcgaccccttccccgagagaccctggttcgccttcctgttccccaagagccactgccagtggctgagacacgagagaagcacctgggacaccagcagcaacgccctgagcctgtggagccactgcctggtgctgcccggccccgccgtgaacggcatccaggtgggcaaggaggtgaagaccggcagcgacgccgagttcctggtgcccagcctgggccccaccagcgccgtgctgttccagagagtgggccccgccggcaaggagatgagcctgggccccctgagaaacctgccctgccccctgggcagcagcagctag

SEQ ID NO: 86662 - DNA, 2211 bp, Artificial Sequence
  Description of Artificial Sequence: Synthetic coding sequence
atggccgtgagagccctgaagctgctgaccaccctgctggccgtggtggccgccgccagccaggccgaggtggagagcgaggccggctggggcatggtgacccccgacctgctgttcgccgagggcaccgccgcctacgccagaggcgactggcccggcgtggtgctgagcatggagagagccctgagaagcagagccgccctgagagccctgagactgagatgcagaacccagtgcgccgccgacttcccctgggagctggaccccgactggagccccagccccgcccaggccagcggcgccgccgccctgagagacctgagcttcttcggcggcctgctgagaagagccgcctgcctgagaagatgcctgggcccccccgccgcccacagcctgagcgaggagatggagctggagttcagaaagagaagcccctacaactacctgcaggtggcctacttcaagatcaacaagctggagaaggccgtggccgccgcccacaccttcttcgtgggcaaccccgagcacatggagatgcagcagaacctggactactaccagaccatgagcggcgtgaaggaggccgacttcaaggacctggagacccagccccacatgcaggagttcagactgggcgtgagactgtacagcgaggagcagccccaggaggccgtgccccacctggaggccgccctgcaggagtacttcgtggcctacgaggagtgcagagccctgtgcgagggcccctacgactacgacggctacaactacctggagtacaacgccgacctgttccaggccatcaccgaccactacatccaggtgctgaactgcaagcagaactgcgtgaccgagctggccagccaccccagcagagagaagcccttcgaggacttcctgcccagccactacaactacctgcagttcgcctactacaacatcggcaactacacccaggccgtggagtgcgccaagacctacctgctgttcttccccaacgacgaggtgatgaaccagaacctggcctactacgccgccatgctgggcgaggagcacaccagaagcatcggccccagagagagcgccaaggagtacagacagagaagcctgctggagaaggagctgctgttcttcgcctacgacgtgttcggcatccccttcgtggaccccgacagctggacccccgaggaggtgatccccaagagactgcaggagaagcagaagagcgagagagagaccgccgtgagaatcagccaggagatcggcaacctgatgaaggagatcgagaccctggtggaggagaagaccaaggagagcctggacgtgagcagactgaccagagagggcggccccctgctgtacgagggcatcagcctgaccatgaacagcaagctgctgaacggcagccagagagtggtgatggacggcgtgatcagcgaccacgagtgccaggagctgcagagactgaccaacgtggccgccaccagcggcgacggctacagaggccagaccagcccccacacccccaacgagaagttctacggcgtgaccgtgttcaaggccctgaagctgggccaggagggcaaggtgcccctgcagagcgcccacctgtactacaacgtgaccgagaaggtgagaagaatcatggagagctacttcagactggacacccccctgtacttcagctacagccacctggtgtgcagaaccgccatcgaggaggtgcaggccgagagaaaggacgacagccaccccgtgcacgtggacaactgcatcctgaacgccgagaccctggtgtgcgtgaaggagccccccgcctacaccttcagagactacagcgccatcctgtacctgaacggcgacttcgacggcggcaacttctacttcaccgagctggacgccaagaccgtgaccgccgaggtgcagccccagtgcggcagagccgtgggcttcagcagcggcaccgagaacccccacggcgtgaaggccgtgaccagaggccagagatgcgccatcgccctgtggttcaccctggaccccagacacagcgagagagacagagtgcaggccgacgacctggtgaagatgctgttcagccccgaggagatggacctgagccaggagcagcccctggacgcccagcagggcccccccgagcccgcccaggagagcctgagcggcagcgagagcaagcccaaggacgagctgtag

SEQ ID NO: 86663 - DNA, 2094 bp, Artificial Sequence
  Description of Artificial Sequence: Synthetic coding sequence
atggccgtgagagccctgaagctgctgaccaccctgctggccgtggtggccgccgccagccaggccgaggtggagagcgaggccggctggggcatggtgacccccgacctgctgttcgccgagggcaccgccgcctacgccagaggcgactggcccggcgtggtgctgagcatggagagagccctgagaagcagagccgccctgagagccctgagactgagatgcagaacccagtgcgccgccgacttcccctgggagctggaccccgactggagccccagccccgcccaggccagcggcgccgccgccctgagagacctgagcttcttcggcggcctgctgagaagagccgcctgcctgagaagatgcctgggcccccccgccgcccacagcctgagcgaggagatggagctggagttcagaaagagaagcccctacaactacctgcaggtggcctacttcaagatcaacaagctggagaaggccgtggccgccgcccacaccttcttcgtgggcaaccccgagcacatggagatgcagcagaacctggactactaccagaccatgagcggcgtgaaggaggccgacttcaaggacctggagacccagccccacatgcaggagttcagactgggcgtgagactgtacagcgaggagcagccccaggaggccgtgccccacctggaggccgccctgcaggagtacttcgtggcctacgaggagtgcagagccctgtgcgagggcccctacgactacgacggctacaactacctggagtacaacgccgacctgttccaggccatcaccgaccactacatccaggtgctgaactgcaagcagaactgcgtgaccgagctggccagccaccccagcagagagaagcccttcgaggacttcctgcccagccactacaactacctgcagttcgcctactacaacatcggcaactacacccaggccgtggagtgcgccaagacctacctgctgttcttccccaacgacgaggtgatgaaccagaacctggcctactacgccgccatgctgggcgaggagcacaccagaagcatcggccccagagagagcgccaaggagtacagacagagaagcctgctggagaaggagctgctgttcttcgcctacgacgtgttcggcatccccttcgtggaccccgacagctggacccccgaggaggtgatccccaagagactgcaggagaagcagaagagcgagagagagaccgccgtgagaatcagccaggagatcggcaacctgatgaaggagatcgagaccctggtggaggagaagaccaaggagagcctggacgtgagcagactgaccagagagggcggccccctgctgtacgagggcatcagcctgaccatgaacagcaagctgctgaacggcagccagagagtggtgatggacggcgtgatcagcgaccacgagtgccaggagctgcagagactgaccaacgtggccgccaccagcggcgacggctacagaggccagaccagcccccacacccccaacgagaagttctacggcgtgaccgtgttcaaggccctgaagctgggccaggagggcaaggtgcccctgcagagcgcccacctgtactacaacgtgaccgagaaggtgagaagaatcatggagagctacttcagactggacacccccctgtacttcagctacagccacctggtgtgcagaaccgccatcgaggaggtgcaggccgagagaaaggacgacagccaccccgtgcacgtggacaactgcatcctgaacgccgagaccctggtgtgcgtgaaggagccccccgcctacaccttcagagactacagcgccatcctgtacctgaacggcgacttcgacggcggcaacttctacttcaccgagctggacgccaagaccgtgaccgccgaggtgcagccccagtgcggcagagccgtgggcttcagcagcggcaccgagaacccccacggcgtgaaggccgtgaccagaggccagagatgcgccatcgccctgtggttcaccctggaccccagacacagcgagagagtgagagccgccagagccggccagggcgccggcagatag

SEQ ID NO: 86664 - DNA, 459 bp, Artificial Sequence
  Description of Artificial Sequence: Synthetic coding sequence
tgagagagagagaccgccgtgagaatcagccaggagatcggcaacctgatgaaggagatcgagaccctggtggaggagaagaccaaggagagcctggacgtgagcagactgaccagagagggcggccccctgctgtacgagggcatcagcctgaccatgaacagcaagctgctgaacggcagccagagagtggtgatggacggcgtgatcagcgaccacgagtgccaggagctgcagagactgaccaacgtggccgccaccagcggcgacggctacagaggccagaccagcccccacacccccaacgagaagttctacggcgtgaccgtgttcaaggccctgaagagaggcgtggtgctggtgagattccacaccgccgacaaggacgtgcccgagaccggccagttcaccaaggagagaggcctgctgggcctgaccgtgccctgcggctggggctag

SEQ ID NO: 86665 - DNA, 1806 bp, Artificial Sequence
  Description of Artificial Sequence: Synthetic coding sequence
atggagctggagttcagaaagagaagcccctacaactacctgcaggtggcctacttcaagatcaacaagctggagaaggccgtggccgccgcccacaccttcttcgtgggcaaccccgagcacatggagatgcagcagaacctggactactaccagaccatgagcggcgtgaaggaggccgacttcaaggacctggagacccagccccacatgcaggagttcagactgggcgtgagactgtacagcgaggagcagccccaggaggccgtgccccacctggaggccgccctgcaggagtacttcgtggcctacgaggagtgcagagccctgtgcgagggcccctacgactacgacggctacaactacctggagtacaacgccgacctgttccaggccatcaccgaccactacatccaggtgctgaactgcaagcagaactgcgtgaccgagctggccagccaccccagcagagagaagcccttcgaggacttcctgcccagccactacaactacctgcagttcgcctactacaacatcggcaactacacccaggccgtggagtgcgccaagacctacctgctgttcttccccaacgacgaggtgatgaaccagaacctggcctactacgccgccatgctgggcgaggagcacaccagaagcatcggccccagagagagcgccaaggagtacagacagagaagcctgctggagaaggagctgctgttcttcgcctacgacgtgttcggcatccccttcgtggaccccgacagctggacccccgaggaggtgatccccaagagactgcaggagaagcagaagagcgagagagagaccgccgtgagaatcagccaggagatcggcaacctgatgaaggagatcgagaccctggtggaggagaagaccaaggagagcctggacgtgagcagactgaccagagagggcggccccctgctgtacgagggcatcagcctgaccatgaacagcaagctgctgaacggcagccagagagtggtgatggacggcgtgatcagcgaccacgagtgccaggagctgcagagactgaccaacgtggccgccaccagcggcgacggctacagaggccagaccagcccccacacccccaacgagaagttctacggcgtgaccgtgttcaaggccctgaagctgggccaggagggcaaggtgcccctgcagagcgcccacctgtactacaacgtgaccgagaaggtgagaagaatcatggagagctacttcagactggacacccccctgtacttcagctacagccacctggtgtgcagaaccgccatcgaggaggtgcaggccgagagaaaggacgacagccaccccgtgcacgtggacaactgcatcctgaacgccgagaccctggtgtgcgtgaaggagccccccgcctacaccttcagagactacagcgccatcctgtacctgaacggcgacttcgacggcggcaacttctacttcaccgagctggacgccaagaccgtgaccgccgaggtgcagccccagtgcggcagagccgtgggcttcagcagcggcaccgagaacccccacggcgtgaaggccgtgaccagaggccagagatgcgccatcgccctgtggttcaccctggaccccagacacagcgagagagacagagtgcaggccgacgacctggtgaagatgctgttcagccccgaggagatggacctgagccaggagcagcccctggacgcccagcagggcccccccgagcccgcccaggagagcctgagcggcagcgagagcaagcccaaggacgagctgtag

SEQ ID NO: 86666 - DNA, 2355 bp, Artificial Sequence
  Description of Artificial Sequence: Synthetic coding sequence
atgaccagccccgccgccgcccagagcagagagatcgactgcctgagccccgaggcccagaagctggccgaggccagactggccgccaagagagccgccagagccgaggccagagagatcagaatgaaggagctggagagacagcagaaggaggaggacagcgagagatacagcagaagaagcagaagaaacaccagcgccagcgacgaggacgagagaatgagcgtgggcagcagaggcagcctgagagtggaggagagacccgagaaggacttcaccgagaagggcagcagaaacatgcccggcctgagcgccgccaccctggccagcctgggcggcaccagcagcagaagaggcagcggcgacaccagcatcagcatcgacaccgaggccagcatcagagagatcaaggacagcctggccgaggtggaggagaagtacaagaaggccatggtgagcaacgcccagctggacaacgagaagaccaacttcatgtaccaggtggacaccctgaaggacatgctgctggagctggaggagcagctggccgagagcagaagacagtacgaggagaagaacaaggagttcgagagagagaagcacgcccacagcatcctgcagttccagttcgccgaggtgaaggaggccctgaagcagagagaggagatgctggagaagcacggcatcatcctgaacagcgagatcgccaccaacggcgagaccagcgacaccctgaacaacgtgggctaccagggccccaccaagatgaccaaggaggagctgaacgccctgaagagcaccggcgacggcaccctgggcagagccagcgaggtggaggtgaagaacgagatcgtggccaacgtgggcaagagagagatcctgcacaacaccgagaaggagcagcacaccgaggacaccgtgaaggactgcgtggacatcgaggtgttccccgccggcgagaacaccgaggaccagaagagcagcgaggacaccgcccccttcctgggcaccctggccggcgccacctacgaggagcaggtgcagagccagatcctggagagcagcagcctgcccgagaacaccgtgcaggtggagagcaacgaggtgatgggcgcccccgacgacagaaccagaacccccctggagcccagcaactgctggagcgacctggacggcggcaaccacaccgagaacgtgggcgaggccgccgtgacccaggtggaggagcaggccggcaccgtggccagctgccccctgggccacagcgacgacaccgtgtaccacgacgacaagtgcatggtggaggtgccccaggagctggagaccagcaccggccacagcctggagaaggagttcaccaaccaggaggccgccgagcccaaggaggtgcccgcccacagcaccgaggtgggcagagaccacaacgaggaggagggcgaggagaccggcctgagagacgagaagcccatcaagaccgaggtgcccggcagccccgccggcaccgagggcaactgccaggaggccaccggccccagcaccgtggacacccagaacgagcccctggacatgaaggagcccgacgaggagaagagcgaccagcagggcgaggccctggacagcagccagaagaagaccaagaacaagaagaagaagaacaagaagaagaagagccccgtgcccgtggagaccctgaaggacgtgaagaaggagctgacctaccagaacaccgacctgagcgagatcaaggaggaggagcaggtgaagagcaccgacagaaagagcgccgtggaggcccagaacgaggtgaccgagaaccccaagcagaagatcgccgccgagagcagcgagaacgtggactgccccgagaaccccaagatcaagctggacggcaagctggaccaggagggcgacgacgtgcagaccgccgccgaggaggtgctggccgacggcgacaccctggacttcgaggacgacaccgtgcagagcagcggccccagagccggcggcgaggagctggacgagggcgtggccaaggacaacgccaagatcgacggcgccacccagagcagccccgccgagcccaagagcgaggacgccgacagatgcaccctgcccgagcacgagagccccagccaggacatcagcgacgcctgcgaggccgagagcaccgagagatgcgagatgagcgagcaccccagccagaccgtgagaaaggccctggacagcaacagcctggagaacgacgacctgagcgcccccggcagagagcccggccacttcaaccccgagagcagagaggacaccagaggcggcaacgagaagggcaagagcaaggaggactgcaccatgagctag

SEQ ID NO: 86667 - DNA, 2259 bp, Artificial Sequence
  Description of Artificial Sequence: Synthetic coding sequence
atgaccagccccgccgccgcccagagcagagagatcgactgcctgagccccgaggcccagaagctggccgaggccagactggccgccaagagagccgccagagccgaggccagagagatcagaatgaaggagctggagagacagcagaaggaggtggaggagagacccgagaaggacttcaccgagaagggcagcagaaacatgcccggcctgagcgccgccaccctggccagcctgggcggcaccagcagcagaagaggcagcggcgacaccagcatcagcatcgacaccgaggccagcatcagagagatcaaggacagcctggccgaggtggaggagaagtacaagaaggccatggtgagcaacgcccagctggacaacgagaagaccaacttcatgtaccaggtggacaccctgaaggacatgctgctggagctggaggagcagctggccgagagcagaagacagtacgaggagaagaacaaggagttcgagagagagaagcacgcccacagcatcctgcagttccagttcgccgaggtgaaggaggccctgaagcagagagaggagatgctggagaagcacggcatcatcctgaacagcgagatcgccaccaacggcgagaccagcgacaccctgaacaacgtgggctaccagggccccaccaagatgaccaaggaggagctgaacgccctgaagagcaccggcgacggcaccctgggcagagccagcgaggtggaggtgaagaacgagatcgtggccaacgtgggcaagagagagatcctgcacaacaccgagaaggagcagcacaccgaggacaccgtgaaggactgcgtggacatcgaggtgttccccgccggcgagaacaccgaggaccagaagagcagcgaggacaccgcccccttcctgggcaccctggccggcgccacctacgaggagcaggtgcagagccagatcctggagagcagcagcctgcccgagaacaccgtgcaggtggagagcaacgaggtgatgggcgcccccgacgacagaaccagaacccccctggagcccagcaactgctggagcgacctggacggcggcaaccacaccgagaacgtgggcgaggccgccgtgacccaggtggaggagcaggccggcaccgtggccagctgccccctgggccacagcgacgacaccgtgtaccacgacgacaagtgcatggtggaggtgccccaggagctggagaccagcaccggccacagcctggagaaggagttcaccaaccaggaggccgccgagcccaaggaggtgcccgcccacagcaccgaggtgggcagagaccacaacgaggaggagggcgaggagaccggcctgagagacgagaagcccatcaagaccgaggtgcccggcagccccgccggcaccgagggcaactgccaggaggccaccggccccagcaccgtggacacccagaacgagcccctggacatgaaggagcccgacgaggagaagagcgaccagcagggcgaggccctggacagcagccagaagaagaccaagaacaagaagaagaagaacaagaagaagaagagccccgtgcccgtggagaccctgaaggacgtgaagaaggagctgacctaccagaacaccgacctgagcgagatcaaggaggaggagcaggtgaagagcaccgacagaaagagcgccgtggaggcccagaacgaggtgaccgagaaccccaagcagaagatcgccgccgagagcagcgagaacgtggactgccccgagaaccccaagatcaagctggacggcaagctggaccaggagggcgacgacgtgcagaccgccgccgaggaggtgctggccgacggcgacaccctggacttcgaggacgacaccgtgcagagcagcggccccagagccggcggcgaggagctggacgagggcgtggccaaggacaacgccaagatcgacggcgccacccagagcagccccgccgagcccaagagcgaggacgccgacagatgcaccctgcccgagcacgagagccccagccaggacatcagcgacgcctgcgaggccgagagcaccgagagatgcgagatgagcgagcaccccagccagaccgtgagaaaggccctggacagcaacagcctggagaacgacgacctgagcgcccccggcagagagcccggccacttcaaccccgagagcagagaggacaccagaggcggcaacgagaagggcaagagcaaggaggactgcaccatgagctag

SEQ ID NO: 86668 - DNA, 1893 bp, Artificial Sequence
  Description of Artificial Sequence: Synthetic coding sequence
atgaccagccccgccgccgcccagagcagagagatcgactgcctgagccccgaggcccagaagctggccgaggccagactggccgccaagagagccgccagagccgaggccagagagatcagaatgaaggagctggagagacagcagaaggaggtgaccagcgcccaggagaagtactacggcctggacaccaagtggggcgacatcgagcagtggatggaggacagcgagagatacagcagaagaagcagaagaaacaccagcgccagcgacgaggacgagagaatgagcgtgggcagcagaggcagcctgagaagccagcccgacctggagtacggcggcccctacgcctggaccaacggctacgacggcgagctgtacggcagccagagcctgaacagaagaagcggcagacccagctgcctgtacagcgccgccagacccagcggcagctacagagccagcgtgctggacgagggcagcttcggcggcaccagaagaggcagcaccagcggcagcagagcccccagcgagtacagcggccacctgaacagcagcagcagagccagcagcagagccagcagcgccagagccagccccgtggtggaggagagacccgagaaggacttcaccgagaagggcagcagaaacatgcccggcctgagcgccgccaccctggccagcctgggcggcaccagcagcagaagaggcagcggcgacaccagcatcagcatcgacaccgaggccagcatcagagagatcaaggagctgaacgagctgaaggaccagatccaggacgtggagggcaagtacatgcagggcctgaaggagatgaaggacagcctggccgaggtggaggagaagtacaagaaggccatggtgagcaacgcccagctggacaacgagaagaccaacttcatgtaccaggtggacaccctgaaggacatgctgctggagctggaggagcagctggccgagagcagaagacagtacgaggagaagaacaaggagttcgagagagagaagcacgcccacagcatcctgcagttccagttcgccgaggtgaaggaggccctgaagcagagagaggagatgctggaggagatcagacagctgcagcagaagcaggccagcagcatcagagagatcagcgacctgcaggagaccatcgagtggaaggacaagaagatcggcgccctggagagacagaaggagttcttcgacagcgtgagaagcgagagagacgacctgagagaggaggtggtgatgctgaaggaggagctgaagaagcacggcatcatcctgaacagcgagatcgccaccaacggcgagaccagcgacaccctgaacaacgtgggctaccagggccccaccaagatgaccaaggaggagctgaacgccctgaagagcaccggcgacggcaccctggacatcagactgaagaagctggtggacgagagagagtgcctgctggagcagatcaagaagctgaagggccagctggaggagagacagaagatcggcaagctggacaacctgagaagcgaggacgacgtgctggagaacggcaccgacatgcacgtgatggacctgcagagagacgccaacagacagatcagcgacctgaagttcaagctggccaagagcgagcaggagatcaccgccctggagcagaacgtgatcagactggagagccaggtgagcagatacaagagcgccgccgagaacgccgagaagatcgaggacgagctgaaggccgagaagagaaagctgcagagagagctgagaagcgccctggacaagaccgaggagctggaggtgagcaacggccacctggtgaagagactggagaagatgaaggccaacagaagcgccctgctgagccagcagtag

SEQ ID NO: 86669 - DNA, 2427 bp, Artificial Sequence
  Description of Artificial Sequence: Synthetic coding sequence
atgaccagccccgccgccgcccagagcagagagatcgactgcctgagccccgaggcccagaagctggccgaggccagactggccgccaagagagccgccagagccgaggccagagagatcagaatgaaggagctggagagacagcagaaggaggaggacagcgagagatacagcagaagaagcagaagaaacaccagcgccagcgacgaggacgagagaatgagcgtgggcagcagaggcagcctgagagtggaggagagacccgagaaggacttcaccgagaagggcagcagaaacatgcccggcctgagcgccgccaccctggccagcctgggcggcaccagcagcagaagaggcagcggcgacaccagcatcagcatcgacaccgaggccagcatcagagagatcaaggagctgaacgagctgaaggaccagatccaggacgtggagggcaagtacatgcagggcctgaaggagatgaaggacagcctggccgaggtggaggagaagtacaagaaggccatggtgagcaacgcccagctggacaacgagaagaccaacttcatgtaccaggtggacaccctgaaggacatgctgctggagctggaggagcagctggccgagagcagaagacagtacgaggagaagaacaaggagttcgagagagagaagcacgcccacagcatcctgcagttccagttcgccgaggtgaaggaggccctgaagcagagagaggagatgctggagaagcacggcatcatcctgaacagcgagatcgccaccaacggcgagaccagcgacaccctgaacaacgtgggctaccagggccccaccaagatgaccaaggaggagctgaacgccctgaagagcaccggcgacggcaccctgggcagagccagcgaggtggaggtgaagaacgagatcgtggccaacgtgggcaagagagagatcctgcacaacaccgagaaggagcagcacaccgaggacaccgtgaaggactgcgtggacatcgaggtgttccccgccggcgagaacaccgaggaccagaagagcagcgaggacaccgcccccttcctgggcaccctggccggcgccacctacgaggagcaggtgcagagccagatcctggagagcagcagcctgcccgagaacaccgtgcaggtggagagcaacgaggtgatgggcgcccccgacgacagaaccagaacccccctggagcccagcaactgctggagcgacctggacggcggcaaccacaccgagaacgtgggcgaggccgccgtgacccaggtggaggagcaggccggcaccgtggccagctgccccctgggccacagcgacgacaccgtgtaccacgacgacaagtgcatggtggaggtgccccaggagctggagaccagcaccggccacagcctggagaaggagttcaccaaccaggaggccgccgagcccaaggaggtgcccgcccacagcaccgaggtgggcagagaccacaacgaggaggagggcgaggagaccggcctgagagacgagaagcccatcaagaccgaggtgcccggcagccccgccggcaccgagggcaactgccaggaggccaccggccccagcaccgtggacacccagaacgagcccctggacatgaaggagcccgacgaggagaagagcgaccagcagggcgaggccctggacagcagccagaagaagaccaagaacaagaagaagaagaacaagaagaagaagagccccgtgcccgtggagaccctgaaggacgtgaagaaggagctgacctaccagaacaccgacctgagcgagatcaaggaggaggagcaggtgaagagcaccgacagaaagagcgccgtggaggcccagaacgaggtgaccgagaaccccaagcagaagatcgccgccgagagcagcgagaacgtggactgccccgagaaccccaagatcaagctggacggcaagctggaccaggagggcgacgacgtgcagaccgccgccgaggaggtgctggccgacggcgacaccctggacttcgaggacgacaccgtgcagagcagcggccccagagccggcggcgaggagctggacgagggcgtggccaaggacaacgccaagatcgacggcgccacccagagcagccccgccgagcccaagagcgaggacgccgacagatgcaccctgcccgagcacgagagccccagccaggacatcagcgacgcctgcgaggccgagagcaccgagagatgcgagatgagcgagcaccccagccagaccgtgagaaaggccctggacagcaacagcctggagaacgacgacctgagcgcccccggcagagagcccggccacttcaaccccgagagcagagaggacaccagaggcggcaacgagaagggcaagagcaaggaggactgcaccatgagctag

SEQ ID NO: 86670 - DNA, 1923 bp, Artificial Sequence
  Description of Artificial Sequence: Synthetic coding sequence
atggacatgggcacccagggcagcggcagaaagagactgcccaacagagagagactgaccgccgaggacgacgccctgaaccagatcgccagagaggccgaggccagactggccgccaagagagccgccagagccgaggccagagagatcagaatgaaggagctggagagacagcagaaggagatctaccaggtgcagaagaagtactacggcctggacaccaagtggggcgacatcgagcagtggatggaggacagcgagagatacagcagaagaagcagaagaaacaccagcgccagcgacgaggacgagagaatgagcgtgggcagcagaggcagcctgagaagccagcccgacctggagtacggcggcccctacgcctggaccaacggctacgacggcgagctgtacggcagccagagcctgaacagaagaagcggcagacccagctgcctgtacagcgccgccagacccagcggcagctacagagccagcgtgctggacgagggcagcttcggcggcaccagaagaggcagcaccagcggcagcagagcccccagcgagtacagcggccacctgaacagcagcagcagagccagcagcagagccagcagcgccagagccagccccgtggtggaggagagacccgagaaggacttcaccgagaagggcagcagaaacatgcccggcctgagcgccgccaccctggccagcctgggcggcaccagcagcagaagaggcagcggcgacaccagcatcagcatcgacaccgaggccagcatcagagagatcaaggagctgaacgagctgaaggaccagatccaggacgtggagggcaagtacatgcagggcctgaaggagatgaaggacagcctggccgaggtggaggagaagtacaagaaggccatggtgagcaacgcccagctggacaacgagaagaccaacttcatgtaccaggtggacaccctgaaggacatgctgctggagctggaggagcagctggccgagagcagaagacagtacgaggagaagaacaaggagttcgagagagagaagcacgcccacagcatcctgcagttccagttcgccgaggtgaaggaggccctgaagcagagagaggagatgctggaggagatcagacagctgcagcagaagcaggccagcagcatcagagagatcagcgacctgcaggagaccatcgagtggaaggacaagaagatcggcgccctggagagacagaaggagttcttcgacagcgtgagaagcgagagagacgacctgagagaggaggtggtgatgctgaaggaggagctgaagaagcacggcatcatcctgaacagcgagatcgccaccaacggcgagaccagcgacaccctgaacaacgtgggctaccagggccccaccaagatgaccaaggaggagctgaacgccctgaagagcaccggcgacggcaccctggacatcagactgaagaagctggtggacgagagagagtgcctgctggagcagatcaagaagctgaagggccagctggaggagagacagaagatcggcaagctggacaacctgagaagcgaggacgacgtgctggagaacggcaccgacatgcacgtgatggacctgcagagagacgccaacagacagatcagcgacctgaagttcaagctggccaagagcgagcaggagatcaccgccctggagcagaacgtgatcagactggagagccaggtgagcagatacaagagcgccgccgagaacgccgagaagatcgaggacgagctgaaggccgagaagagaaagctgcagagagagctgagaagcgccctggacaagaccgaggagctggaggtgagcaacggccacctggtgaagagactggagaagatgaaggccaacagaagcgccctgctgagccagcagtag

SEQ ID NO: 86671 - DNA, 2166 bp, Artificial Sequence
  Description of Artificial Sequence: Synthetic coding sequence
atgggcacccccgccagcggcagaaagagaacccccgtgaaggacagattcagcgccgaggacgaggccctgagcaacatcgccagagaggccgaggccagactggccgccaagagagccgccagagccgaggccagagacatcagaatgagagagctggagagacagcagaaggagtacagcctgcacagcttcgacagaaagtggggccagatccagaagtggctggaggacagcgagagagccagatacagccacagaagcagccaccacagaccctacctgggcgtggaggacgccctgagcatcagaagcgtgggcagccacagatacgacatgttcaaggacagaagcagcagactgagcagcctgaaccacagctacagccacagccacggcatgaagaagagaagcagcgacagccacaaggacctgctgagcggcctgtacttcgaccagagaaactacagcagcctgagacacagcaagcccaccagcgcctactacaccagacagagcagcagcctgtacagcgaccccctggccacctacaagagcgacagagccagccccaccgccaacagcggcctgctgagaagcgccagcctggccagcctgtacaacggcggcctgtacaacccctacggccccagaacccccagcgagtgcagctactacagcagcagaatcagcagcgccagaagcagccccggcttcaccaacgacgacaccgccagcatcgtgagcagcgacagagccagcagaggcagaagagagagcgtggtgagcgccgccgactacttcagcagaagcaacagaagaggcagcgtggtgagcgaggtggacgacatcagcatccccgacctgagcagcctggacgagaagagcgacaagcagtacgccgagaactacaccagacccagcagcagaaacagcgccagcgccaccacccccctgagcggcaacagcagcagaagaggcagcggcgacaccagcagcctgatcgaccccgacaccagcctgagcgagctgagagacatctacgacctgaaggaccagatccaggacgtggagggcagatacatgcagggcctgaaggagctgaaggagagcctgagcgaggtggaggagaagtacaagaaggccatggtgagcaacgcccagctggacaacgagaagaacaacctgatctaccaggtggacaccctgaaggacgtgatcgaggagcaggaggagcagatggccgagttctacagagagaacgaggagaagagcaaggagctggagagacagaagcacatgtgcagcgtgctgcagcacaagatggaggagctgaaggagggcctgagacagagagacgagctgatcgaggagaagcagagaatgcagcagaagatcgacaccatgaccaaggaggtgttcgacctgcaggagaccctgctgtggaaggacaagaagatcggcgccctggagaagcagaaggagtacatcgcctgcctgagaaacgagagagacatgctgagagaggagctggccgacctgcaggagaccgtgaagaccggcgagaagcacggcctggtgatcatccccgacggcacccccaacggcgacgtgagccacgagcccgtggccggcgccatcaccgtggtgagccaggaggccgcccaggtgctggagagcgccggcgagggccccctggacgtgagactgagaaagctggccggcgagaaggaggagctgctgagccagatcagaaagctgaagctgcagctggaggaggagagacagaagtgcagcagaaacgacggcaccgtgggcgacctggccggcctgcagaacggcagcgacctgcagttcatcgagatgcagagagacgccaacagacagatcagcgagtacaagttcaagctgagcaaggccgagcaggacatcaccaccctggagcagagcatcagcagactggagggccaggtgctgagatacaagaccgccgccgagaacgccgagaaggtggaggacgagctgaaggccgagaagagaaagctgcagagagagctgagaaccgccctggacaagatcgaggagatggagatgaccaacagccacctggccaagagactggagaagatgaaggccaacagaaccgccctgctggcccagcagtag

SEQ ID NO: 86672 - DNA, 1203 bp, Artificial Sequence
  Description of Artificial Sequence: Synthetic coding sequence
atgggcacccccgccagcggcagaaagagaacccccgtgaaggacagattcagcgccgaggacgaggccctgagcaacatcgccagagaggccgaggccagactggccgccaagagagccgccagagccgaggccagagacatcagaatgagagagctggagagacagcagaaggagctggacgagaagagcgacaagcagtacgccgagaactacaccagacccagcagcagaaacagcgccagcgccaccacccccctgagcggcaacagcagcagaagaggcagcggcgacaccagcagcctgatcgaccccgacaccagcctgagcgagctgagagagagcctgagcgaggtggaggagaagtacaagaaggccatggtgagcaacgcccagctggacaacgagaagaacaacctgatctaccaggtggacaccctgaaggacgtgatcgaggagcaggaggagcagatggccgagttctacagagagaacgaggagaagagcaaggagctggagagacagaagcacatgtgcagcgtgctgcagcacaagatggaggagctgaaggagggcctgagacagagagacgagctgatcgagaagcacggcctggtgatcatccccgacggcacccccaacggcgacgtgagccacgagcccgtggccggcgccatcaccgtggtgagccaggaggccgcccaggtgctggagagcgccggcgagggccccctggacgtgagactgagaaagctggccggcgagaaggaggagctgctgagccagatcagaaagctgaagctgcagctggaggaggagagacagaagtgcagcagaaacgacggcaccgtgggcgacctggccggcctgcagaacggcagcgacctgcagttcatcgagatgcagagagacgccaacagacagatcagcgagtacaagttcaagctgagcaaggccgagcaggacatcaccaccctggagcagagcatcagcagactggagggccaggtgctgagatacaagaccgccgccgagaacgccgagaaggtggaggacgagctgaaggccgagaagagaaagctgcagagagagctgagaaccgccctggacaagatcgaggagatggagatgaccaacagccacctggccaagagactggagaagatgaaggccaacagaaccgccctgctggcccagcagtag

SEQ ID NO: 86673 - DNA, 2166 bp, Artificial Sequence; identical to SEQ ID NO: 86671
  Description of Artificial Sequence: Synthetic coding sequence

SEQ ID NO: 86674 - DNA, 180 bp, Artificial Sequence
  Description of Artificial Sequence: Synthetic coding sequence
atgggcacccccgccagcggcagaaagagaacccccgtgaaggacagattcagcgccgaggacgaggccctgagcaacatcgccagagaggccgaggccagactggccgccaagagagccgccagagccgaggccagagacatcagaatgagagagctggagagacagcagaaggagtag

SEQ ID NO: 86675 - DNA, 180 bp, Artificial Sequence; identical to SEQ ID NO: 86674
  Description of Artificial Sequence: Synthetic coding sequence

SEQ ID NO: 86676 - DNA, 180 bp, Artificial Sequence; identical to SEQ ID NO: 86674
  Description of Artificial Sequence: Synthetic coding sequence

SEQ ID NO: 86677 - DNA, 1275 bp, Artificial Sequence
  Description of Artificial Sequence: Synthetic coding sequence
atgggcacccccgccagcggcagaaagagaacccccgtgaaggacagattcagcgccgaggacgaggccctgagcaacatcgccagagaggccgaggccagactggccgccaagagagccgccagagccgaggccagagacatcagaatgagagagctggagagacagcagaaggagctggacgagaagagcgacaagcagtacgccgagaactacaccagacccagcagcagaaacagcgccagcgccaccacccccctgagcggcaacagcagcagaagaggcagcggcgacaccagcagcctgatcgaccccgacaccagcctgagcgagctgagagacatctacgacctgaaggaccagatccaggacgtggagggcagatacatgcagggcctgaaggagctgaaggagagcctgagcgaggtggaggagaagtacaagaaggccatggtgagcaacgcccagctggacaacgagaagaacaacctgatctaccaggtggacaccctgaaggacgtgatcgaggagcaggaggagcagatggccgagttctacagagagaacgaggagaagagcaaggagctggagagacagaagcacatgtgcagcgtgctgcagcacaagatggaggagctgaaggagggcctgagacagagagacgagctgatcgagaagcacggcctggtgatcatccccgacggcacccccaacggcgacgtgagccacgagcccgtggccggcgccatcaccgtggtgagccaggaggccgcccaggtgctggagagcgccggcgagggccccctggacgtgagactgagaaagctggccggcgagaaggaggagctgctgagccagatcagaaagctgaagctgcagctggaggaggagagacagaagtgcagcagaaacgacggcaccgtgggcgacctggccggcctgcagaacggcagcgacctgcagttcatcgagatgcagagagacgccaacagacagatcagcgagtacaagttcaagctgagcaaggccgagcaggacatcaccaccctggagcagagcatcagcagactggagggccaggtgctgagatacaagaccgccgccgagaacgccgagaaggtggaggacgagctgaaggccgagaagagaaagctgcagagagagctgagaaccgccctggacaagatcgaggagatggagatgaccaacagccacctggccaagagactggagaagatgaaggccaacagaaccgccctgctggcccagcagtag

SEQ ID NO: 86678 - DNA, 2316 bp, Artificial Sequence
  Description of Artificial Sequence: Synthetic coding sequence
atggcccccggccccttcagcagcgccctgctgagccccccccccgccgccctgcccttcctgctgctgctgtgggccggcgccagcagaggccagccctgccccggcagatgcatctgccagaacgtggcccccaccctgaccatgctgtgcgccaagaccggcctgctgttcgtgccccccgccatcgacagaagagtggtggagctgagactgaccgacaacttcatcgccgccgtgagaagaagagacttcgccaacatgaccagcctggtgcacctgaccctgagcagaaacaccatcggccaggtggccgccggcgccttcgccgacctgagagccctgagagccctgcacctggacagcaacagactggccgaggtgagaggcgaccagctgagaggcctgggcaacctgagacacctgatcctgggcaacaaccagatcagaagagtggagagcgccgccttcgacgccttcctgagcaccgtggaggacctggacctgagctacaacaacctggaggccctgccctgggaggccgtgggccagatggtgaacctgaacaccctgaccctggaccacaacctgatcgaccacatcgccgagggcaccttcgtgcagctgcacaagctggtgagactggacatgaccagcaacagactgcacaagctgccccccgacggcctgttcctgagaagccagggcaccggccccaagccccccacccccctgaccgtgagcttcggcggcaaccccctgcactgcaactgcgagctgctgtggctgagaagactgaccagagaggacgacctggagacctgcgccacccccgagcacctgaccgacagatacttctggagcatccccgaggaggagttcctgtgcgagccccccctgatcaccagacaggccggcggcagagccctggtggtggagggccaggccgtgagcctgagatgcagagccgtgggcgaccccgagcccgtggtgcactgggtggcccccgacggcagactgctgggcaacagcagcagaaccagagtgagaggcgacggcaccctggacgtgaccatcaccaccctgagagacagcggcaccttcacctgcatcgccagcaacgccgccggcgaggccaccgcccccgtggaggtgtgcgtggtgcccctgcccctgatggcccccccccccgccgcccccccccccctgaccgagcccggcagcagcgacatcgccacccccggcagacccggcgccaacgacagcgccgccgagagaagactggtggccgccgagctgaccagcaacagcgtgctgatcagatggcccgcccagagacccgtgcccggcatcagaatgtaccaggtgcagtacaacagcagcgtggacgacagcctggtgtacagaatgatccccagcaccagccagaccttcctggtgaacgacctggccgccggcagagcctacgacctgtgcgtgctggccgtgtacgacgacggcgccaccgccctgcccgccaccagagtggtgggctgcgtgcagttcaccaccgccggcgaccccgccccctgcagacccctgagagcccacttcctgggcggcaccatgatcatcgccatcggcggcgtgatcgtggccagcgtgctggtgttcatcgtgctgctgatgatcagatacaaggtgtacggcgacggcgacagcagaagagtgaagggcagcagaagcctgcccagagtgagccacgtgtgcagccagaccaacggcgccggcaccggcgccgcccaggcccccgccctgcccgcccaggaccactacgaggccctgagagaggtggagagccaggccgcccccgccgtggccgtggaggccaaggccatggaggccgagaccgccagcgccgagcccgaggtggtgctgggcagaagcctgggcggcagcgccaccagcctgtgcctgctgcccagcgaggagaccagcggcgaggagagcagagccgccgtgggccccagaagaagcagaagcggcgccctggagccccccaccagcgccccccccaccctggccctggtgcccggcggcgccgccgccagacccagaccccagcagagatacagcttcgacggcgactacggcgccctgttccagagccacagctaccccagaagagccagaagaaccaagagacacagaagcaccccccacctggacggcgccggcggcggcgccgccggcgaggacggcgacctgggcctgggcagcgccagagcctgcctggccttcaccagcaccgagtggatgctggagagcaccgtgtag

SEQ ID NO: 86679 - DNA, 2370 bp, Artificial Sequence
  Description of Artificial Sequence: Synthetic coding sequence
atggagaccctgctgggcggcctgctggccttcggcatggccttcgccgtggtggacgcctgccccaagtactgcgtgtgccagaacctgagcgagagcctgggcaccctgtgccccagcaagggcctgctgttcgtgccccccgacatcgacagaagaaccgtggagctgagactgggcggcaacttcatcatccacatcagcagacaggacttcgccaacatgaccggcctggtggacctgaccctgagcagaaacaccatcagccacatccagcccttcagcttcctggacctggagagcctgagaagcctgcacctggacagcaacagactgcccagcctgggcgaggacaccctgagaggcctggtgaacctgcagcacctgatcgtgaacaacaaccagctgggcggcatcgccgacgaggccttcgaggacttcctgctgaccctggaggacctggacctgagctacaacaacctgcacggcctgccctgggacagcgtgagaagaatggtgaacctgcaccagctgagcctggaccacaacctgctggaccacatcgccgagggcaccttcgccgacctgcagaagctggccagactggacctgaccagcaacagactgcagaagctgccccccgaccccatcttcgccagaagccaggccagcgccctgaccgccacccccttcgccccccccctgagcttcagcttcggcggcaaccccctgcactgcaactgcgagctgctgtggctgagaagactggagagagacgacgacctggagacctgcggcagccccggcggcctgaagggcagatacttctggcacgtgagagaggaggagttcgtgtgcgagccccccctgatcacccagcacacccacaagctgctggtgctggagggccaggccgccaccctgaagtgcaaggccatcggcgaccccagccccctgatccactgggtggcccccgacgacagactggtgggcaacagcagcagaaccgccgtgtacgacaacggcaccctggacatcttcatcaccaccagccaggacagcggcgccttcacctgcatcgccgccaacgccgccggcgaggccaccgccatggtggaggtgagcatcgtgcagctgccccacctgagcaacagcaccagcagaaccgccccccccaagagcagactgagcgacatcaccggcagcagcaagaccagcagaggcggcggcggcagcggcggcggcgagccccccaagagcccccccgagagagccgtgctggtgagcgaggtgaccaccaccagcgccctggtgaagtggagcgtgagcaagagcgcccccagagtgaagatgtaccagctgcagtacaactgcagcgacgacgaggtgctgatctacagaatgatccccgccagcaacaaggccttcgtggtgaacaacctggtgagcggcaccggctacgacctgtgcgtgctggccatgtgggacgacaccgccaccaccctgaccgccaccaacatcgtgggctgcgcccagttcttcaccaaggccgactacccccagtgccagagcatgcacagccagatcctgggcggcaccatgatcctggtgatcggcggcatcatcgtggccaccctgctggtgttcatcgtgatcctgatggtgagatacaaggtgtgcaaccacgaggcccccagcaagatggccgccgccgtgagcaacgtgtacagccagaccaacggcgcccagccccccccccccagcagcgcccccgccggcgcccccccccagggcccccccaaggtggtggtgagaaacgagctgctggacttcaccgccagcctggccagagccagcgacagcagcagcagcagcagcctgggcagcggcgaggccgccggcctgggcagagccccctggagaatcccccccagcgcccccagacccaagcccagcctggacagactgatgggcgccttcgccagcctggacctgaagagccagagaaaggaggagctgctggacagcagaacccccgccggcagaggcgccggcaccagcgccagaggccaccacagcgacagagagcccctgctgggcccccccgccgccagagccagaagcctgctgcccctgcccctggagggcaaggccaagagaagccacagcttcgacatgggcgacttcgccgccgccgccgccggcggcgtggtgcccggcggctacagcccccccagaaaggtgagcaacatctggaccaagagaagcctgagcgtgaacggcatgctgctgcccttcgaggagagcgacctggtgggcgccagaggcaccttcggcagcagcgagtgggtgatggagagcaccgtgtag

SEQ ID NO: 86680 - DNA, 1887 bp, Artificial Sequence
  Description of Artificial Sequence: Synthetic coding sequence
atggccatcctgcccctgctgctgtgcctgctgcccctggcccccgccagcagccccccccagagcgccacccccagcccctgccccagaagatgcagatgccagacccagagcctgcccctgagcgtgctgtgccccggcgccggcctgctgttcgtgccccccagcctggacagaagagccgccgagctgagactggccgacaacttcatcgccagcgtgagaagaagagacctggccaacatgaccggcctgctgcacctgagcctgagcagaaacaccatcagacacgtggccgccggcgccttcgccgacctgagagccctgagagccctgcacctggacggcaacagactgaccagcctgggcgagggccagctgagaggcctggtgaacctgagacacctgatcctgagcaacaaccagctggccgccctggccgccggcgccctggacgactgcgccgagaccctggaggacctggacctgagctacaacaacctggagcagctgccctgggaggccctgggcagactgggcaacgtgaacaccctgggcctggaccacaacctgctggccagcgtgcccgccggcgccttcagcagactgcacaagctggccagactggacatgaccagcaacagactgaccaccatcccccccgaccccctgttcagcagactgcccctgctggccagacccagaggcagccccgccagcgccctggtgctggccttcggcggcaaccccctgcactgcaactgcgagctggtgtggctgagaagactggccagagaggacgacctggaggcctgcgccagcccccccgccctgggcggcagatacttctgggccgtgggcgaggaggagttcgtgtgcgagccccccgtggtgacccacagaagcccccccctggccgtgcccgccggcagacccgccgccctgagatgcagagccgtgggcgaccccgagcccagagtgagatgggtgagcccccagggcagactgctgggcaacagcagcagagccagagccttccccaacggcaccctggagctgctggtgaccgagcccggcgacggcggcatcttcacctgcatcgccgccaacgccgccggcgaggccaccgccgccgtggagctgaccgtgggcccccccccccccccccagctggccaacagcaccagctgcgacccccccagagacggcgaccccgacgccctgaccccccccagcgccgccagcgccagcgccaaggtggccgacaccggcccccccaccgacagaggcgtgcaggtgaccgagcacggcgccaccgccgccctggtgcagtggcccgaccagagacccatccccggcatcagaatgtaccagatccagtacaacagcagcgccgacgacatcctggtgtacagaatgatccccgccgagagcagaagcttcctgctgaccgacctggccagcggcagaacctacgacctgtgcgtgctggccgtgtacgaggacagcgccaccggcctgaccgccaccagacccgtgggctgcgccagattcagcaccgagcccgccctgagaccctgcggcgccccccacgcccccttcctgggcggcaccatgatcatcgccctgggcggcgtgatcgtggccagcgtgctggtgttcatcttcgtgctgctgatgagatacaaggtgcacggcggccagccccccggcaaggccaagatccccgcccccgtgagcagcgtgtgcagccagaccaacggcgccctgggccccacccccacccccgccccccccgcccccgagcccgccgccctgagagcccacaccgtggtgcagctggactgcgagccctggggccccggccacgagcccgtgggcccctag

SEQ ID NO: 86681 - DNA, 1887 bp, Artificial Sequence; identical to SEQ ID NO: 86680
  Description of Artificial Sequence: Synthetic coding sequence

SEQ ID NO: 86682 - DNA, 1908 bp, Artificial Sequence
  Description of Artificial Sequence: Synthetic coding sequence
atggccccccccctgctgctgctgctgctggccagcggcgccgccgcctgccccctgccctgcgtgtgccagaacctgagcgagagcctgagcaccctgtgcgcccacagaggcctgctgttcgtgccccccaacgtggacagaagaaccgtggagctgagactggccgacaacttcatccaggccctgggcccccccgacttcagaaacatgaccggcctggtggacctgaccctgagcagaaacgccatcaccagaatcggcgccagagccttcggcgacctggagagcctgagaagcctgcacctggacggcaacagactggtggagctgggcaccggcagcctgagaggccccgtgaacctgcagcacctgatcctgagcggcaaccagctgggcagaatcgcccccggcgccttcgacgacttcctggagagcctggaggacctggacctgagctacaacaacctgagacaggtgccctgggccggcatcggcgccatgcccgccctgcacaccctgaacctggaccacaacctgatcgacgccctgccccccggcgccttcgcccagctgggccagctgagcagactggacctgaccagcaacagactggccaccctggcccccgaccccctgttcagcagaggcagagacgccgaggccagccccgcccccctggtgctgagcttcagcggcaaccccctgcactgcaactgcgagctgctgtggctgagaagactggccagacccgacgacctggagacctgcgccagcccccccggcctggccggcagatacttctgggccgtgcccgagggcgagttcagctgcgagccccccctgatcgccagacacacccagagactgtgggtgctggagggccagagagccaccctgagatgcagagccctgggcgaccccgcccccaccatgcactgggtgggccccgacgacagactggtgggcaacagcagcagagccagagccttccccaacggcaccctggagatcggcgtgaccggcgccggcgacgccggcggctacacctgcatcgccaccaaccccgccggcgaggccaccgccagagtggagctgagagtgctggccctgccccacggcggcaacagcagcgccgagggcggcagacccggccccagcgacatcgccgccagcgccagaaccgccgccgagggcgagggcaccctggagagcgagcccgccgtgcaggtgaccgaggtgaccgccaccagcggcctggtgagctggggccccggcagacccgccgaccccgtgtggatgttccagatccagtacaacagcagcgaggacgagaccctgatctacagaatcgtgcccgccagcagccaccacttcctgctgaagcacctggtgcccggcgccgactacgacctgtgcctgctggccctgagccccgccgccggccccagcgacctgaccgccaccagactgctgggctgcgcccacttcagcaccctgcccgccagccccctgtgccacgccctgcaggcccacgtgctgggcggcaccctgaccgtggccgtgggcggcgtgctggtggccgccctgctggtgttcaccgtggccctgctggtgagaggcagaggcgccggcaacggcagactgcccctgaagctgagccacgtgcagagccagaccaacggcggccccagccccacccccaaggcccacccccccagaagccccccccccagaccccagagaagctgcagcctggacctgggcgacgccggctgctacggctacgccagaagactgggcggcgcctgggccagaagaagccacagcgtgcacggcggcctgctgggcgccggctgcagaggcgtgggcggcagcgccgagagactggaggagagcgtggtgtag

SEQ ID NO: 86683 - DNA, 2160 bp, Artificial Sequence
  Description of Artificial Sequence: Synthetic coding sequence
atggagaagatcctgttctacctgttcctgatcggcatcgccgtgaaggcccagatctgccccaagagatgcgtgtgccagatcctgagccccaacctggccaccctgtgcgccaagaagggcctgctgttcgtgccccccaacatcgacagaagaaccgtggagctgagactggccgacaacttcgtgaccaacatcaagagaaaggacttcgccaacatgaccagcctggtggacctgaccctgagcagaaacaccatcagcttcatcaccccccacgccttcgccgacctgagaaacctgagagccctgcacctgaacagcaacagactgaccaagatcaccaacgacatgttcagcggcctgagcaacctgcaccacctgatcctgaacaacaaccagctgaccctgatcagcagcaccgccttcgacgacgtgttcgccctggaggagctggacctgagctacaacaacctggagaccatcccctgggacgccgtggagaagatggtgagcctgcacaccctgagcctggaccacaacatgatcgacaacatccccaagggcaccttcagccacctgcacaagatgaccagactggacgtgaccagcaacaagctgcagaagctgccccccgaccccctgttccagagagcccaggtgctggccaccagcggcatcatcagccccagcaccttcgccctgagcttcggcggcaaccccctgcactgcaactgcgagctgctgtggctgagaagactgagcagagaggacgacctggagacctgcgccagcccccccctgctgaccggcagatacttctggagcatccccgaggaggagttcctgtgcgagccccccctgatcaccagacacacccacgagatgagagtgctggagggccagagagccaccctgagatgcaaggccagaggcgaccccgagcccgccatccactggatcagccccgagggcaagctgatcagcaacgccaccagaagcctggtgtacgacaacggcaccctggacatcctgatcaccaccgtgaaggacaccggcgccttcacctgcatcgccagcaaccccgccggcgaggccacccagatcgtggacctgcacatcatcaagctgccccacctgctgaacagcaccaaccacatccacgagcccgaccccggcagcagcgacatcagcaccagcaccaagagcggcagcaacaccagcagcagcaacggcgacaccaagctgagccaggacaagatcgtggtggccgaggccaccagcagcaccgccctgctgaagttcaacttccagagaaacatccccggcatcagaatgttccagatccagtacaacggcacctacgacgacaccctggtgtacagaatgatcccccccaccagcaagaccttcctggtgaacaacctggccgccggcaccatgtacgacctgtgcgtgctggccatctacgacgacggcatcaccagcctgaccgccaccagagtggtgggctgcatccagttcaccaccgagcaggactacgtgagatgccacttcatgcagagccagttcctgggcggcaccatgatcatcatcatcggcggcatcatcgtggccagcgtgctggtgttcatcatcatcctgatgatcagatacaaggtgtgcaacaacaacggccagcacaaggtgaccaaggtgagcaacgtgtacagccagaccaacggcgcccagatccagggctgcagcgtgaccctgccccagagcgtgagcaagcaggccgtgggccacgaggagaacgcccagtgctgcaaggccaccagcgacaacgtgatccagagcagcgagacctgcagcagccaggacagcagcaccaccaccagcgccctgccccccagctggaccagcagcaccagcgtgagccagaagcagaagagaaagaccggcaccaagcccagcaccgagccccagaacgaggccgtgaccaacgtggagagccagaacaccaacagaaacaacagcaccgccctgcagctggccagcagaccccccgacagcgtgaccgagggccccaccagcaagagagcccacatcaagcccaacgccctgctgaccaacgtggaccagatcgtgcaggagacccagagactggagctgatctag

SEQ ID NO: 86684 - DNA, 1863 bp, Artificial Sequence
  Description of Artificial Sequence: Synthetic coding sequence
atgcaggtgagcaagagaatgctggccggcggcgtgagaagcatgcccagccccctgctggcctgctggcagcccatcctgctgctggtgctgggcagcgtgctgagcggcagcgccaccggctgcccccccagatgcgagtgcagcgcccaggacagagccgtgctgtgccacagaaagagattcgtggccgtgcccgagggcatccccaccgagaccagactgctggacctgggcaagaacagaatcaagaccctgaaccaggacgagttcgccagcttcccccacctggaggagctggagctgaacgagaacatcgtgagcgccgtggagcccggcgccttcaacaacctgttcaacctgagaaccctgggcctgagaagcaacagactgaagctgatccccctgggcgtgttcaccggcctgagcaacctgaccaagctggacatcagcgagaacaagatcgtgatcctgctggactacatgttccaggacctgtacaacctgaagagcctggaggtgggcgacaacgacctggtgtacatcagccacagagccttcagcggcctgaacagcctggagcagctgaccctggagaagtgcaacctgaccagcatccccaccgaggccctgagccacctgcacggcctgatcgtgctgagactgagacacctgaacatcaacgccatcagagactacagcttcaagagactgtacagactgaaggtgctggagatcagccactggccctacctggacaccatgacccccaactgcctgtacggcctgaacctgaccagcctgagcatcacccactgcaacctgaccgccgtgccctacctggccgtgagacacctggtgtacctgagattcctgaacctgagctacaaccccatcagcaccatcgagggcagcatgctgcacgagctgctgagactgcaggagatccagctggtgggcggccagctggccgtggtggagccctacgccttcagaggcctgaactacctgagagtgctgaacgtgagcggcaaccagctgaccaccctggaggagagcgtgttccacagcgtgggcaacctggagaccctgatcctggacagcaaccccctggcctgcgactgcagactgctgtgggtgttcagaagaagatggagactgaacttcaacagacagcagcccacctgcgccacccccgagttcgtgcagggcaaggagttcaaggacttccccgacgtgctgctgcccaactacttcacctgcagaagagccagaatcagagacagaaaggcccagcaggtgttcgtggacgagggccacaccgtgcagttcgtgtgcagagccgacggcgaccccccccccgccatcctgtggctgagccccagaaagcacctggtgagcgccaagagcaacggcagactgaccgtgttccccgacggcaccctggaggtgagatacgcccaggtgcaggacaacggcacctacctgtgcatcgccgccaacgccggcggcaacgacagcatgcccgcccacctgcacgtgagaagctacagccccgactggccccaccagcccaacaagaccttcgccttcatcagcaaccagcccggcgagggcgaggccaacagcaccagagccaccgtgcccttccccttcgacatcaagaccctgatcatcgccaccaccatgggcttcatcagcttcctgggcgtggtgctgttctgcctggtgctgctgttcctgtggagcagaggcaagggcaacaccaagcacaacatcgagatcgagtacgtgcccagaaagagcgacgccggcatcagcagcgccgacgcccccagaaagttcaacatgaagatgatctag

SEQ ID NO: 86685 - DNA, 168 bp, Artificial Sequence
  Description of Artificial Sequence: Synthetic coding sequence
atgctggccggcggcgtgagaagcatgcccagccccctgctggcctgctggcagcccatcctgctgctggtgctgggcagcgtgctgagcggcagcgccaccggctgcccccccagatgcgagtgcagcgcccaggacagagccgtgctgtgccacagaaagagatag

SEQ ID NO: 86686 - DNA, 1845 bp, Artificial Sequence
  Description of Artificial Sequence: Synthetic coding sequence
atgctggccggcggcgtgagaagcatgcccagccccctgctggcctgctggcagcccatcctgctgctggtgctgggcagcgtgctgagcggcagcgccaccggctgcccccccagatgcgagtgcagcgcccaggacagagccgtgctgtgccacagaaagagattcgtggccgtgcccgagggcatccccaccgagaccagactgctggacctgggcaagaacagaatcaagaccctgaaccaggacgagttcgccagcttcccccacctggaggagctggagctgaacgagaacatcgtgagcgccgtggagcccggcgccttcaacaacctgttcaacctgagaaccctgggcctgagaagcaacagactgaagctgatccccctgggcgtgttcaccggcctgagcaacctgaccaagctggacatcagcgagaacaagatcgtgatcctgctggactacatgttccaggacctgtacaacctgaagagcctggaggtgggcgacaacgacctggtgtacatcagccacagagccttcagcggcctgaacagcctggagcagctgaccctggagaagtgcaacctgaccagcatccccaccgaggccctgagccacctgcacggcctgatcgtgctgagactgagacacctgaacatcaacgccatcagagactacagcttcaagagactgtacagactgaaggtgctggagatcagccactggccctacctggacaccatgacccccaactgcctgtacggcctgaacctgaccagcctgagcatcacccactgcaacctgaccgccgtgccctacctggccgtgagacacctggtgtacctgagattcctgaacctgagctacaaccccatcagcaccatcgagggcagcatgctgcacgagctgctgagactgcaggagatccagctggtgggcggccagctggccgtggtggagccctacgccttcagaggcctgaactacctgagagtgctgaacgtgagcggcaaccagctgaccaccctggaggagagcgtgttccacagcgtgggcaacctggagaccctgatcctggacagcaaccccctggcctgcgactgcagactgctgtgggtgttcagaagaagatggagactgaacttcaacagacagcagcccacctgcgccacccccgagttcgtgcagggcaaggagttcaaggacttccccgacgtgctgctgcccaactacttcacctgcagaagagccagaatcagagacagaaaggcccagcaggtgttcgtggacgagggccacaccgtgcagttcgtgtgcagagccgacggcgaccccccccccgccatcctgtggctgagccccagaaagcacctggtgagcgccaagagcaacggcagactgaccgtgttccccgacggcaccctggaggtgagatacgcccaggtgcaggacaacggcacctacctgtgcatcgccgccaacgccggcggcaacgacagcatgcccgcccacctgcacgtgagaagctacagccccgactggccccaccagcccaacaagaccttcgccttcatcagcaaccagcccggcgagggcgaggccaacagcaccagagccaccgtgcccttccccttcgacatcaagaccctgatcatcgccaccaccatgggcttcatcagcttcctgggcgtggtgctgttctgcctggtgctgctgttcctgtggagcagaggcaagggcaacaccaagcacaacatcgagatcgagtacgtgcccagaaagagcgacgccggcatcagcagcgccgacgcccccagaaagttcaacatgaagatgatctag

SEQ ID NO: 86687 - DNA, 1821 bp, Artificial Sequence
  Description of Artificial Sequence: Synthetic coding sequence
atgctgcacaccgccatcagctgctggcagcccttcctgggcctggccgtggtgctgatcttcatgggcagcaccatcggctgccccgccagatgcgagtgcagcgcccagaacaagagcgtgagctgccacagaagaagactgatcgccatccccgagggcatccccatcgagaccaagatcctggacctgagcaagaacagactgaagagcgtgaaccccgaggagttcatcagctaccccctgctggaggagatcgacctgagcgacaacatcatcgccaacgtggagcccggcgccttcaacaacctgttcaacctgagaagcctgagactgaagggcaacagactgaagctggtgcccctgggcgtgttcaccggcctgagcaacctgaccaagctggacatcagcgagaacaagatcgtgatcctgctggactacatgttccaggacctgcacaacctgaagagcctggaggtgggcgacaacgacctggtgtacatcagccacagagccttcagcggcctgctgagcctggagcagctgaccctggagaagtgcaacctgaccgccgtgcccaccgaggccctgagccacctgagaagcctgatcagcctgcacctgaagcacctgaacatcaacaacatgcccgtgtacgccttcaagagactgttccacctgaagcacctggagatcgactactggcccctgctggacatgatgcccgccaacagcctgtacggcctgaacctgaccagcctgagcgtgaccaacaccaacctgagcaccgtgcccttcctggccttcaagcacctggtgtacctgacccacctgaacctgagctacaaccccatcagcaccatcgaggccggcatgttcagcgacctgatcagactgcaggagctgcacatcgtgggcgcccagctgagaaccatcgagccccacagcttccagggcctgagattcctgagagtgctgaacgtgagccagaacctgctggagaccctggaggagaacgtgttcagcagccccagagccctggaggtgctgagcatcaacaacaaccccctggcctgcgactgcagactgctgtggatcctgcagagacagcccaccctgcagttcggcggccagcagcccatgtgcgccggccccgacaccatcagagagagaagcttcaaggacttccacagcaccgccctgagcttctacttcacctgcaagaagcccaagatcagagagaagaagctgcagcacctgctggtggacgagggccagaccgtgcagctggagtgcagcgccgacggcgacccccagcccgtgatcagctgggtgacccccagaagaagattcatcaccaccaagagcaacggcagagccaccgtgctgggcgacggcaccctggagatcagattcgcccaggaccaggacagcggcatgtacgtgtgcatcgccagcaacgccgccggcaacgacaccttcaccgccagcctgaccgtgaagggcttcgccagcgacagattcctgtacgccaacagaacccccatgtacatgaccgacagcaacgacaccatcagcaacggcaccaacgccaacaccttcagcctggacctgaagaccatcctggtgagcaccgccatgggctgcttcaccttcctgggcgtggtgctgttctgcttcctgctgctgttcgtgtggagcagaggcaagggcaagcacaagaacagcatcgacctggagtacgtgcccagaaagaacaacggcgccgtggtggagggcgaggtggccggccccagaagattcaacatgaagatgatctag

SEQ ID NO: 86688 - DNA, 1821 bp, Artificial Sequence; identical to SEQ ID NO: 86687
  Description of Artificial Sequence: Synthetic coding sequence

SEQ ID NO: 86689 - DNA, 1779 bp, Artificial Sequence
  Description of Artificial Sequence: Synthetic coding sequence
atgacctgctggctgtgcgtgctgagcctgcccctgctgctgctgcccgccgcccccccccccgccggcggctgccccgccagatgcgagtgcaccgtgcagaccagagccgtggcctgcaccagaagaagactgaccgccgtgcccgacggcatccccgccgagaccagactgctggagctgagcagaaacagaatcagatgcctgaaccccggcgacctggccgccctgcccgccctggaggagctggacctgagcgagaacgccatcgcccacgtggagcccggcgccttcgccaacctgcccagactgagagtgctgagactgagaggcaaccagctgaagctgatcccccccggcgtgttcaccagactggacaacctgaccctgctggacctgagcgagaacaagctggtgatcctgctggactacaccttccaggacctgcacagcctgagaagactggaggtgggcgacaacgacctggtgttcgtgagcagaagagccttcgccggcctgctggccctggaggagctgaccctggagagatgcaacctgaccgccctgagcggcgagagcctgggccacctgagaagcctgggcgccctgagactgagacacctggccatcgccagcctggaggaccagaacttcagaagactgcccggcctgctgcacctggagatcgacaactggcccctgctggaggaggtggccgccggcagcctgagaggcctgaacctgaccagcctgagcgtgacccacaccaacatcaccgccgtgcccgccgccgccctgagacaccaggcccacctgacctgcctgaacctgagccacaaccccatcagcaccgtgcccagaggcagcttcagagacctggtgagactgagagagctgcacctggccggcgccctgctggccgtggtggagccccaggccttcctgggcctgagacagatcagactgctgaacctgagcaacaacctgctgagcaccctggaggagagcaccttccacagcgtgaacaccctggagaccctgagagtggacggcaaccccctggcctgcgactgcagactgctgtggatcgtgcagagaagaaagaccctgaacttcgacggcagactgcccgcctgcgccacccccgccgaggtgagaggcgacgccctgagaaacctgcccgacagcgtgctgttcgagtacttcgtgtgcagaaagcccaagatcagagagagaagactgcagagagtgaccgccaccgccggcgaggacgtgagattcctgtgcagagccgagggcgagcccgcccccaccgtggcctgggtgaccccccagcacagacccgtgaccgccaccagcgccggcagagccagagtgctgcccggcggcaccctggagatccaggacgccagaccccaggacagcggcacctacacctgcgtggccagcaacgccggcggcaacgacacctacttcgccaccctgaccgtgagacccgagcccgccgccaacagaacccccggcgaggcccacaacgagaccctggccgccctgagagcccccctggacctgaccaccatcctggtgagcaccgccatgggctgcatcaccttcctgggcgtggtgctgttctgcttcgtgctgctgttcgtgtggagcagaggcagaggccagcacaagaacaacttcagcgtggagtacagcttcagaaaggtggacggccccgccgccgccgccggccagggcggcgccagaaagttcaacatgaagatgatctag

SEQ ID NO: 86690 - DNA, 2172 bp, Artificial Sequence
  Description of Artificial Sequence: Synthetic coding sequence
atgcccctgttcttcagaaagagaaagcccagcgaggaggccagaaagagactggagtaccagatgtgcctggccaaggaggccggcgccgacgacatcctggacatcagcaagtgcgagctgagcgagatccccttcggcgccttcgccacctgcaaggtgctgcagaagaaggtgctgatcgtgcacaccaaccacctgaccagcctgctgcccaagagctgcagcctgctgagcctggccaccatcaaggtgctggacctgcacgacaaccagctgaccgccctgcccgacgacctgggccagctgaccgccctgcaggtgctgaacgtggagagaaaccagctgatgcagctgcccagaagcatcggcaacctgacccagctgcagaccctgaacgtgaaggacaacaagctgaaggagctgcccgacaccgtgggcgagctgagaagcctgagaaccctgaacatcagcggcaacgagatccagagactgccccagatgctggcccacgtgagaaccctggagatgctgagcctggacgccagcgccatggtgtacccccccagagaggtgtgcggcgccggcaccgccgccatcctgcagttcctgtgcaaggagagcggcctggagtactacccccccagccagtacctgctgcccatcctggagcaggacggcatcgagaacagcagagacagccccgacggccccaccgacagattcagcagagaggagctggagtggcagaacagattcagcgactacgagaagagaaaggagcagaagatgctggagaagctggagttcgagagaagactggagctgggccagagagagcacacccagctgctgcagcagagcagcagccagaaggacgagatcctgcagaccgtgaaggaggagcagagcagactggagcagggcctgagcgagcaccagagacacctgaacgccgagagacagagactgcaggagcagctgaagcagaccgagcagaacatcagcagcagaatccagaagctgctgcaggacaaccagagacagaagaagagcagcgagatcctgaagagcctggagaacgagagaatcagaatggagcagctgatgagcatcacccaggaggagaccgagagcctgagaagaagagacgtggccagcgccatgcagcagatgctgaccgagagctgcaagaacagactgatccagatggcctacgagagccagagacagaacctggtgcagcaggcctgcagcagcatggccgagatggacgagagattccagcagatcctgagctggcagcagatggaccagaacaaggccatcagccagatcctgcaggagagcgccatgcagaaggccgccttcgaggccctgcaggtgaagaaggacctgatgcacagacagatcagaagccagatcaagctgatcgagaccgagctgctgcagctgacccagctggagctgaagagaaagagcctggacaccgagagcctgcaggagatgatcagcgagcagagatgggccctgagcagcctgctgcagcagctgctgaaggagaagcagcagagagaggaggagctgagagagatcctgaccgagctggaggccaagagcgagaccagacaggagaactactggctgatccagtaccagagactgctgaaccagaagcccctgagcctgaagctgcaggaggagggcatggagagacagctggtggccctgctggaggagctgagcgccgagcactacctgcccatcttcgcccaccacagactgagcctggacctgctgagccagatgagccccggcgacctggccaaggtgggcgtgagcgaggccggcctgcagcacgagatcctgagaagagtgcaggagctgctggacgccgccagaatccagcccgagctgaagccccccatgggcgaggtggtgacccccaccgccccccaggagccccccgagagcgtgagacccagcgccccccccgccgagctggaggtgcaggccagcgagtgcgtggtgtgcctggagagagaggcccagatgatcttcctgaactgcggccacgtgtgctgctgccagcagtgctgccagcccctgagaacctgccccctgtgcagacaggacatcgcccagagactgagaatctaccacagcagctag

SEQ ID NO: 86691 - DNA, 2172 bp, Artificial Sequence; identical to SEQ ID NO: 86690
  Description of Artificial Sequence: Synthetic coding sequence

SEQ ID NO: 86692 - DNA, 2172 bp, Artificial Sequence; identical to SEQ ID NO: 86690
  Description of Artificial Sequence: Synthetic coding sequence

SEQ ID NO: 86693 - DNA, 2091 bp, Artificial Sequence
  Description of Artificial Sequence: Synthetic coding sequence
atgcccctgttcttcagaaagagaaagcccagcgaggaggccagaaagagactggagtaccagatgtgcctggccaaggaggccggcgccgacgacatcctggacatcagcaagtgcgagctgagcgagatccccttcggcgccttcgccacctgcaaggtgctgcagaagaaggtgctgatcgtgcacaccaaccacctgaccagcctgctgcccaagagctgcagcctgctgagcctggccaccatcaaggtgctggacctgcacgacaaccagctgaccgccctgcccgacgacctgggccagctgaccgccctgcaggtgctgaacgtggagagaaaccagctgatgcagctgcccagaagcatcggcaacctgacccagctgcagaccctgaacgtgaaggacaacaagctgaaggagctgcccgacaccgtgggcgagctgagaagcctgagaaccctgaacatcagcggcaacgagatccagagactgccccagatgctggcccacgtgagaaccctggagatgctgagcctggacgccagcgccatggtgtacccccccagagaggtgtgcggcgccggcaccgccgccatcctgcagttcctgtgcaaggagagcggcctggagtactacccccccagccagtacctgctgcccatcctggagcaggacggcatcgagaacagcagagacagccccgacggccccaccgacagattcagcagagaggagctggagtggcagaacagattcagcgactacgagaagagaaaggagcagaagatgctggagaagctggagttcgagagaagactggagctgggccagagagagcacacccagctgctgcagcagagcagcagccagaaggacgagatcctgcagaccgtgaaggaggagcagagcagactggagcagggcctgagcgagcaccagagacacctgaacgccgagagacagagactgcaggagcagctgaagcagaccgagcagaacatcagcagcagaatccagaagctgctgcaggacaaccagagacagaagaagagcagcgagatcctgaagagcctggagaacgagagaatcagaatggagcagctgatgagcatcacccaggaggagaccgagagcctgagaagaagagacgtggccagcgccatgcagcagatgctgaccgagagctgcaagaacagactgatccagatggcctacgagagccagagacagaacctggtgcagcaggcctgcagcagcatggccgagatggacgagagattccagcagatcctgagctggcagcagatggaccagaacaaggccatcagccagatcctgcaggagagcgccatgcagaaggccgccttcgaggccctgcaggtgaagaaggacctgatgcacagacagatcagaagccaggagatgatcagcgagcagagatgggccctgagcagcctgctgcagcagctgctgaaggagaagcagcagagagaggaggagctgagagagatcctgaccgagctggaggccaagagcgagaccagacaggagaactactggctgatccagtaccagagactgctgaaccagaagcccctgagcctgaagctgcaggaggagggcatggagagacagctggtggccctgctggaggagctgagcgccgagcactacctgcccatcttcgcccaccacagactgagcctggacctgctgagccagatgagccccggcgacctggccaaggtgggcgtgagcgaggccggcctgcagcacgagatcctgagaagagtgcaggagctgctggacgccgccagaatccagcccgagctgaagccccccatgggcgaggtggtgacccccaccgccccccaggagccccccgagagcgtgagacccagcgccccccccgccgagctggaggtgcaggccagcgagtgcgtggtgtgcctggagagagaggcccagatgatcttcctgaactgcggccacgtgtgctgctgccagcagtgctgccagcccctgagaacctgccccctgtgcagacaggacatcgcccagagactgagaatctaccacagcagctag

SEQ ID NO: 86694 - DNA, 465 bp, Artificial Sequence
  Description of Artificial Sequence: Synthetic coding sequence
atgttccactgcatccccctgtggagatgcaacagacacgtggagagcatcgacaagagacactgcagcctggtgtacgtgcccgaggagatctacagatacgccagaagcctggaggagctgctgctggacgccaaccagctgagagagctgcccgagcagttcttccagctggtgaagctgagaaagctgggcctgagcgacaacgagatccagagactgccccccgagatcgccaacttcatgcagctggtggagctggacgtgagcagaaacgagatccccgagatccccgagagcatcagcttctgcaaggccctgcaggtggccgacttcagcggcaaccccctgaccagactgcccgagagcttccccgagctgcagaacctgacctgcctgagcgtgaacgacatcagcctgcagagcctgcccgagaacatcggcaagcagaagaccaccagctag

SEQ ID NO: 86695 - DNA, 1575 bp, Artificial Sequence
  Description of Artificial Sequence: Synthetic coding sequence
atgttccactgcatccccctgtggagatgcaacagacacgtggagagcatcgacaagagacactgcagcctggtgtacgtgcccgaggagatctacagatacgccagaagcctggaggagctgctgctggacgccaaccagctgagagagctgcccgagcagttcttccagctggtgaagctgagaaagctgggcctgagcgacaacgagatccagagactgccccccgagatcgccaacttcatgcagctggtggagctggacgtgagcagaaacgagatccccgagatccccgagagcatcagcttctgcaaggccctgcaggtggccgacttcagcggcaaccccctgaccagactgcccgagagcttccccgagctgcagaacctgacctgcctgagcgtgaacgacatcagcctgcagagcctgcccgagaacatcggcaacctgtacaacctggccagcctggagctgagagagaacctgctgacctacctgcccgacagcctgacccagctgagaagactggaggagctggacctgggcaacaacgagatctacaacctgcccgagagcatcggcgccctgctgcacctgaaggacctgtggctggacggcaaccagctgagcgagctgccccaggagatcggcaacctgaagaacctgctgtgcctggacgtgagcgagaacagactggagagactgcccgaggagatcagcggcctgaccagcctgaccgacctggtgatcagccagaacctgctggagaccatccccgacggcatcggcaagctgaagaagctgagcatcctgaaggtggaccagaacagactgacccagctgcccgaggccgtgggcgagtgcgagagcctgaccgagctggtgctgaccgagaaccagctgctgaccctgcccaagagcatcggcaagctgaagaagctgagcaacctgaacgccgacagaaacaagctggtgagcctgcccaaggagatcggcggctgctgcagcctgaccgtgttctgcgtgagagacaacagactgaccagaatccccgccgaggtgagccaggccaccgagctgcacgtgctggacgtggccggcaacagactgctgcacctgcccctgagcctgaccgccctgaagctgaaggccctgtggctgagcgacaaccagagccagcccctgctgaccttccagaccgacaccgactacaccaccggcgagaagatcctgacctgcgtgctgctgccccagctgcccagcgagcccacctgccaggagaacctgcccagatgcggcgccctggagaacctggtgaacgacgtgagcgacgaggcctggaacgagagagccgtgaacagagtgagcgccatcagattcgtggaggacgagaaggacgaggaggacaacgagaccagaaccctgctgagaagagccaccccccaccccggcgagctgaagcacatgaagaagaccgtggagaacctgagaaacgacatgaacgccgccaagggcctggacagcaacaagaacgaggtgaaccacgccatcgacagagtgaccaccagcgtgtag

SEQ ID NO: 86696 - DNA, 834 bp, Artificial Sequence
  Description of Artificial Sequence: Synthetic coding sequence
atgggcaacaccatcagagccctggtggccttcatccccgccgacagatgccagaactacgtggtgagagacctgagagagatgcccctggacaagatggtggacctgagcggcagccagctgagaagattccccctgcacgtgtgcagcttcagagagctggtgaagctgtacctgagcgacaaccacctgaacagcctgccccccgagctgggccagctgcagaacctgcagatcctggccctggacttcaacaacttcaaggccctgccccaggtggtgtgcaccctgaagcagctgtgcatcctgtacctgggcaacaacaagctgtgcgacctgcccagcgagctgagcctgctgcagaacctgagaaccctgtggatcgaggccaactgcctgacccagctgcccgacgtggtgtgcgagctgagcctgctgaagaccctgcacgccggcagcaacgccctgagactgctgcccggccagctgagaagactgcaggagctgagaaccatctggctgagcggcaacagactgaccgacttccccaccgtgctgctgcacatgcccttcctggaggtgatcgacgtggactggaacagcatcagatacttccccagcctggcccacctgagcagcctgaagctggtgatctacgaccacaacccctgcagaaacgcccccaaggtggccaagggcgtgagaagagtgggcagatgggccgaggagacccccgagcccgaccccagaaaggccagaagatacgccctggtgagagaggagagccaggagctgcaggcccccgtgcccctgctgccccccaccaacagctag

SEQ ID NO: 86697 - DNA, 4116 bp, Artificial Sequence
  Description of Artificial Sequence: Synthetic coding sequence
atgaccgaggagagcagcgacgtgcccagagagctgatcgagagcatcaaggacgtgatcggcagaaagatcaagatcagcgtgaagaagaaggtgaagctggaggtgaagggcgacaaggtggagaacaaggtgctggtgctgaccagctgcagagccttcctggtgaccgccagaatccccaccaagctggagctgaccttcagctacctggagatccacggcgtggtgtgcagcaagagcgcccagatgatcgtggagaccgagaagtgcagcatcagcatgaagatggccagccccgaggacgtgagcgaggtgctggcccacatcggcacctgcctgagaaagatcttccccggcctgagccccgtgagaatcatgaagaaggtgagcatggagcccagcgagagactggccagcctgcaggccctgtgggacagccagaccgtggccgagcagggcccctgcggcggcttcagccagatgtacgcctgcgtgtgcgactggctgggcttcagctacagagaggaggtgcagtgggacgtggacaccatctacctgacccaggacaccagagagctgaacctgcaggacttcagccacctggaccacagagacctgatccccatcatcgccgccctggagtacaaccagtggttcaccaagctgagcagcaaggacctgaagctgagcaccgacgtgtgcgagcagatcctgagagtggtgagcagaagcaacagactggaggagctggtgctggagaacgccggcctgagaaccgacttcgcccagaagctggccagcgccctggcccacaaccccaacagcggcctgcacaccatcaacctggccggcaaccccctggaggacagaggcgtgagcagcctgagcatccagttcgccaagctgcccaagggcctgaagcacctgaacctgagcaagaccagcctgagccccaagggcgtgaacagcctgagccagagcctgagcgccaaccccctgaccgccagcaccctggtgcacctggacctgagcggcaacgtgctgagaggcgacgacctgagccacatgtacaacttcctggcccagcccaacgccatcgtgcacctggacctgagcaacaccgagtgcagcctggacatggtgtgcggcgccctgctgagaggctgcctgcagtacctggccgtgctgaacctgagcagaaccgtgttcagccacagaaagggcaaggaggtgccccccagcttcaagcagttcttcagcagcagcctggccctgatgcacatcaacctgagcggcaccaagctgagccccgagcccctgaaggccctgctgctgggcctggcctgcaaccacaacctgaagggcgtgagcctggacctgagcaactgcgagctgagaagcggcggcgcccaggtgctggagggctgcatcgccgagatccacaacatcaccagcctggacatcagcgacaacggcctggagagcgacctgagcaccctgatcgtgtggctgagcaagaacagaagcatccagcacctggccctgggcaagaacttcaacaacatgaagagcaagaacctgacccccgtgctggacaacctggtgcagatgatccaggacgaggagagccccctgcagagcctgagcctggccgacagcaagctgaagaccgaggtgaccatcatcatcaacgccctgggcagcaacaccagcctgaccaaggtggacatcagcggcaacggcatgggcgacatgggcgccaagatgctggccaaggccctgcagatcaacaccaagctgagaaccgtgatctgggacaagaacaacatcaccgcccagggcttccaggacatcgccgtggccatggagaagaactacaccctgagattcatgcccatccccatgtacgacgccagccaggccctgaagaccaaccccgagaagaccgaggacgccctgcagaagatcgagaactacctgctgagaaaccacgagaccagaaagtacctgcaggagcaggcctacagactgcagcagggcatcgtgaccagcaccacccagcagatgatcgacagaatctgcgtgaaggtgcaggaccacctgaacagcctgagaaactgcggcggcgacgccatccaggaggacctgaagagcgccgagagactgatgagagacgccaagaacagcaagaccctgctgcccaacctgtaccacgtgggcggcgccagctgggccggcgccagcggcctgctgagcagccccatccaggagaccctggagagcatggccggcgaggtgaccagagtggtggacgagcagctgaaggccctgctggagagcatggtggacgccgccgagaacctgtgccccaacgtgatgaagaaggcccacatcagacaggacctgatccacgccagcaccgagaagatcagcatccccagaaccttcgtgaagaacgtgctgctggagcagagcggcatcgacatcctgaacaagatcagcgaggtgaagctgaccgtggccagcttcctgagcgacagaatcgtggacgagatcctggacgccctgagccactgccaccacaagctggccgaccacttcagcagaagaggcaagaccctgccccagcaggagagcctggagatcgagctggccgaggagaagcccgtgaagagaagcatcatcaccgtggaggagctgaccgagatcgagagactggaggacctggacacctgcatgatgacccccaagagcaagagaaagagcatccacagcagaatgctgagacccgtgagcagagccttcgagatggagttcgacctggacaaggccctggaggaggtgcccatccacatcgaggacccccccttccccagcctgagacaggagaagagaagcagcggcttcatcagcgagctgcccagcgaggagggcaagaagctggagcacttcaccaagctgagacccaagagaaacaagaagcagcagcccacccaggccgccgtgtgcgccgccaacatcgtgagccaggacggcgagcagaacggcctgatgggcagagtggacgagggcgtggacgagttcttcaccaagaaggtgaccaagatggacagcaagaagtggagcaccagaggcagcgagagccacgagctgaacgagggcggcgacgagaagaagaagagagacagcagaaagagcagcggcttcctgaacctgatcaagagcagaagcaagagcgagagaccccccaccatcctgatgaccgaggagcccagcagccccaagggcgccgtgagaagcccccccgtggactgccccagaaaggacaccaaggccgccgagcacaacggcaacagcgagagaatcgaggagatcaagacccccgacagcttcgaggagagccagggcgaggagatcggcaaggtggagagaagcgacagcaagagcagcccccaggccggcagaagatacggcgtgcaggtgatgggcagcggcctgctggccgagatgaaggccaagcaggagaagagagccgcctgcgcccagaagaagctgggcaacgacgccgtgagccaggacagcagcagccccgccctgagcggcgtggagagaagcgacggcggcggcgccgtgcccaagctgcaccccggcctgcccgagaacagattcggcctgggcacccccgagaagaacaccaaggccgagcccaaggccgaggccggcagcagaagcagaagcagcagcagcacccccaccagccccaagcccctgctgcagagccccaagcccagcctggccgccagacccgtgatcccccagaagcccagaaccgccagcagacccgacgacatccccgacagccccagcagccccaaggtggccctgctgccccccgtgctgaagaaggtgcccagcgacaaggagagagacggccagagcagcccccagcccagccccagaaccttcagccaggaggtgagcagaagaagctggggccagcaggcccaggagtaccaggagcagaagcagagaagcagcagcaaggacggccaccagggcagcaagagcaacgacagcggcgaggaggccgagaaggagttcatcttcgtgtag

SEQ ID NO: 86698 - DNA, 531 bp, Artificial Sequence
  Description of Artificial Sequence: Synthetic coding sequence
atgtacgcctgcgtgtgcgactggctgggcttcagctacagagaggaggtgcagtgggacgtggacaccatctacctgacccaggacaccagagagctgaacctgcaggacttcagccacctggaccacagagacctgatccccatcatcgccgccctggagtacaaccagtggttcaccaagctgagcagcaaggacctgaagctgagcaccgacgtgtgcgagcagatcctgagagtggtgagcagaagcaacagactggaggagctggtgctggagaacgccggcctgagaaccgacttcgcccagaagctggccagcgccctggcccacaaccccaacagcggcctgcacaccatcaacctggccggcaaccccctggaggacagagagaccaccaccaagatcaagagacagaacgtgcccaccgtgctgcagacctacctggtggtgtgccccagcgactaccagccctgccccctgcccctgggcaaggacaactactacagcgacttcagccacgacggctag

SEQ ID NO: 86699 - DNA, 3981 bp, Artificial Sequence
  Description of Artificial Sequence: Synthetic coding sequence
atgaccgaggagagcagcgacgtgcccagagagctgatcgagagcatcaaggacgtgatcggcagaaagatcaagatcagcgtgaagaagaaggtgaagctggaggtgaagggcgacaaggtggagaacaaggtgctggtgctgaccagctgcagagccttcctggtgaccgccagaatccccaccaagctggagctgaccttcagctacctggagatccacggcgtggtgtgcagcaagagcgcccagatgatcgtggagaccgagaagtgcagcatcagcatgaagatggccagccccgaggacgtgagcgaggtgctggcccacatcggcacctgcctgagaaagatcttccccggcctgagccccgtgagaatcatgaagaaggtgagcatggagcccagcgagagactggccagcctgcaggccctgtgggacagccagaccgtggccgagcagggcccctgcggcggcttcagccagatgtacgcctgcgtgtgcgactggctgggcttcagctacagagaggaggtgcagtgggacgtggacaccatctacctgacccaggacaccagagagctgaacctgcaggacttcagccacctggaccacagagacctgatccccatcatcgccgccctggagtacaaccagtggttcaccaagctgagcagcaaggacctgaagctgagcaccgacgtgtgcgagcagatcctgagagtggtgagcagaagcaacagactggaggagctggtgctggagaacgccggcctgagaaccgacttcgcccagaagctggccagcgccctggcccacaaccccaacagcggcctgcacaccatcaacctggccggcaaccccctggaggacagaggcgtgagcagcctgagcatccagttcgccaagctgcccaagggcctgaagcacctgaacctgagcaagaccagcctgagccccaagggcgtgaacagcctgagccagagcctgagcgccaaccccctgaccgccagcaccctggtgcacctggacctgagcggcaacgtgctgagaggcgacgacctgagccacatgtacaacttcctggcccagcccaacgccatcgtgcacctggacctgagcaacaccgagtgcagcctggacatggtgtgcggcgccctgctgagaggctgcctgcagtacctggccgtgctgaacctgagcagaaccgtgttcagccacagaaagggcaaggaggtgccccccagcttcaagcagttcttcagcagcagcctggccctgatgcacatcaacctgagcggcaccaagctgagccccgagcccctgaaggccctgctgctgggcctggcctgcaaccacaacctgaagggcgtgagcctggacctgagcaactgcgagctgagaagcggcggcgcccaggtgctggagggctgcatcgccgagatccacaacatcaccagcctggacatcagcgacaacggcctggagagcgacctgagcaccctgatcgtgtggctgagcaagaacagaagcatccagcacctggccctgggcaagaacttcaacaacatgaagagcaagaacctgacccccgtgctggacaacctggtgcagatgatccaggacgaggagagccccctgcagagcctgagcctggccgacagcaagctgaagaccgaggtgaccatcatcatcaacgccctgggcagcaacaccagcctgaccaaggtggacatcagcggcaacggcatgggcgacatgggcgccaagatgctggccaaggccctgcagatcaacaccaagctgagaaccgtgatctgggacaagaacaacatcaccgcccagggcttccaggacatcgccgtggccatggagaagaactacaccctgagattcatgcccatccccatgtacgacgccagccaggccctgaagaccaaccccgagaagaccgaggacgccctgcagaagatcgagaactacctgctgagaaaccacgagaccagaaagtacctgcaggagcaggcctacagactgcagcagggcatcgtgaccagcaccacccagcagatgatcgacagaatctgcgtgaaggtgcaggaccacctgaacagcctgagaaactgcggcggcgacgccatccaggaggacctgaagagcgccgagagactgatgagagacgccaagaacagcaagaccctgctgcccaacctgtaccacgtgggcggcgccagctgggccggcgccagcggcctgctgagcagccccatccaggagaccctggagagcatggccggcgaggtgaccagagtggtggacgagcagctgaaggccctgctggagagcatggtggacgccgccgagaacctgtgccccaacgtgatgaagaaggcccacatcagacaggacctgatccacgccagcaccgagaagatcagcatccccagaaccttcgtgaagaacgtgctgctggagcagagcggcatcgacatcctgaacaagatcagcgaggtgaagctgaccgtggccagcttcctgagcgacagaatcgtggacgagatcctggacgccctgagccactgccaccacaagctggccgaccacttcagcagaagaggcaagaccctgccccagcaggagagcctggagatcgagctggccgaggagaagcccgtgaagagaagcatcatcaccgtggaggagctgaccgagatcgagagactggaggacctggacacctgcatgatgacccccaagagcaagagaaagagcatccacagcagaatgctgagacccgtgagcagagccttcgagatggagttcgacctggacaaggccctggaggaggtgcccatccacatcgaggacccccccttccccagcctgagacaggagaagagaagcagcggcttcatcagcgagctgcccagcgaggagggcaagaagctggagcacttcaccaagctgagacccaagagaaacaagaagcagcagcccacccaggccgccgtgtgcgccgccaacatcgtgagccaggacggcgagcagaacggcctgatgggcagagtggacgagggcgtggacgagttcttcaccaagaaggtgaccaagatggacagcaagaagtggagcaccagaggcagcgagagccacgagctgaacgagggcggcgacgagaagaagaagagagacagcagaaagagcagcggcttcctgaacctgatcaagagcagaagcaagagcgagagaccccccaccatcctgatgaccgaggagcccagcagccccaagggcgccgtgagaagcccccccgtggactgccccagaaaggacaccaaggccgccgagcacaacggcaacagcgagagaatcgaggagatcaagacccccgacagcttcgaggagagccagggcgaggagatcggcaaggtggagagaagcgacagcaagagcagcccccaggccggcagaagatacggcgtgcaggtgatgggcagcggcctgctggccgagatgaaggccaagcaggagaacagattcggcctgggcacccccgagaagaacaccaaggccgagcccaaggccgaggccggcagcagaagcagaagcagcagcagcacccccaccagccccaagcccctgctgcagagccccaagcccagcctggccgccagacccgtgatcccccagaagcccagaaccgccagcagacccgacgacatccccgacagccccagcagccccaaggtggccctgctgccccccgtgctgaagaaggtgcccagcgacaaggagagagacggccagagcagcccccagcccagccccagaaccttcagccaggaggtgagcagaagaagctggggccagcaggcccaggagtaccaggagcagaagcagagaagcagcagcaaggacggccaccagggcagcaagagcaacgacagcggcgaggaggccgagaaggagttcatcttcgtgtag

SEQ ID NO: 86700 - DNA, 1116 bp, Artificial Sequence
  Description of Artificial Sequence: Synthetic coding sequence
atgggccacaaggtggtggtgttcgacatcagcgtgatcagagccctgtgggagaccagagtgaagaagcacaaggcctggcagaagaaggaggtggagagactggagaagagcgccctggagaagatcaaggaggagtggaacttcgtggccgagtgcagaagaaagggcatcccccaggccgtgtactgcaagaacggcttcatcgacaccagcgtgagactgctggacaagatcgagagaaacaccctgaccagacagagcagcctgcccaaggacagaggcaagagaagcagcgccttcgtgttcgagctgagcggcgagcactggaccgagctgcccgacagcctgaaggagcagacccacctgagagagtggtacatcagcaacaccctgatccagatcatccccacctacatccagctgttccaggccatgagaatcctggacctgcccaagaaccagatcagccacctgcccgccgagatcggctgcctgaagaacctgaaggagctgaacgtgggcttcaactacctgaagagcatcccccccgagctgggcgactgcgagaacctggagagactggactgcagcggcaacctggagctgatggagctgcccttcgagctgagcaacctgaagcaggtgaccttcgtggacatcagcgccaacaagttcagcagcgtgcccatctgcgtgctgagaatgagcaacctgcagtggctggacatcagcagcaacaacctgaccgacctgccccaggacatcgacagactggaggagctgcagagcttcctgctgtacaagaacaagctgacctacctgccctacagcatgctgaacctgaagaagctgaccctgctggtggtgagcggcgaccacctggtggagctgcccaccgccctgtgcgacagcagcacccccctgaagttcgtgagcctgatggacaaccccatcgacaacgcccagtgcgaggacggcaacgagatcatggagagcgagagagacagacagcacttcgacaaggaggtgatgaaggcctacatcgaggacctgaaggagagagagagcgtgcccagctacaccaccaaggtgagcttcagcctgcagctgtag

SEQ ID NO: 86701 - DNA, 1116 bp, Artificial Sequence; identical to SEQ ID NO: 86700
  Description of Artificial Sequence: Synthetic coding sequence

SEQ ID NO: 86702 - DNA, 918 bp, Artificial Sequence
  Description of Artificial Sequence: Synthetic coding sequence
atgggcggcaccctggcctggaccctgctgctgcccctgctgctgagagagagcgacagcctggagcccagctgcaccgtgagcagcgccgacgtggactggaacgccgagttcagcgccacctgcctgaacttcagcggcctgagcctgagcctgccccacaaccagagcctgagagccagcaacgtgatcctgctggacctgagcggcaacggcctgagagagctgcccgtgaccttcttcgcccacctgcagaagctggaggtgctgaacgtgctgagaaaccccctgagcagagtggacggcgccctggccgccagatgcgacctggacctgcaggccgactgcaactgcgccctggagagctggcacgacatcagaagagacaactgcagcggccagaagcccctgctgtgctgggacaccaccagcagccagcacaacctgagcgccttcctggaggtgagctgcgcccccggcctggccagcgccaccatcggcgccgtggtggtgagcggctgcctgctgctgggcctggccatcgccggccccgtgctggcctggagactgtggagatgcagagtggccagaagcagagagctgaacaagccctgggccgcccaggacggccccaagcccggcctgggcctgcagcccagatacggcagcagaagcgcccccaagccccaggtggccgtgcccagctgccccagcacccccgactacgagaacatgttcgtgggccagcccgccgccgagcaccagtgggacgagcagggcgcccaccccagcgaggacaacgacttctacatcaactacaaggacatcgacctggccagccagcccgtgtactgcaacctgcagagcctgggccaggcccccatggacgaggaggagtacgtgatccccggccactag

SEQ ID NO: 86703 - DNA, 1005 bp, Artificial Sequence
  Description of Artificial Sequence: Synthetic coding sequence
atgagaggccccagctggagcagacccagacccctgctgctgctgctgctgctgctgagcccctggcccgtgtgggcccaggtgagcgccaccgccagccccagcggcagcctgggcgcccccgactgccccgaggtgtgcacctgcgtgcccggcggcctggccagctgcagcgccctgagcctgcccgccgtgccccccggcctgagcctgagactgagagccctgctgctggaccacaacagagtgagagccctgccccccggcgccttcgccggcgccggcgccctgcagagactggacctgagagagaacggcctgcacagcgtgcacgtgagagccttctggggcctgggcgccctgcagctgctggacctgagcgccaaccagctggaggccctggcccccggcaccttcgcccccctgagagccctgagaaacctgagcctggccggcaacagactggccagactggagcccgccgccctgggcgccctgcccctgctgagaagcctgagcctgcaggacaacgagctggccgccctggcccccggcctgctgggcagactgcccgccctggacgccctgcacctgagaggcaacccctggggctgcggctgcgccctgagacccctgtgcgcctggctgagaagacaccccctgcccgccagcgaggccgagaccgtgctgtgcgtgtggcccggcagactgaccctgagccccctgaccgccttcagcgacgccgccttcagccactgcgcccagcccctggccctgagagacctggccgtggtgtacaccctgggccccgccagcttcctggtgagcctggccagctgcctggccctgggcagcggcctgaccgcctgcagagccagaagaagaagactgagaaccgccgccctgagaccccccagaccccccgaccccaaccccgaccccgacccccacggctgcgccagccccgccgaccccggcagccccgccgccgccgcccaggcctag

SEQ ID NO: 86704 - DNA, 1923 bp, Artificial Sequence
  Description of Artificial Sequence: Synthetic coding sequence
atgctgaacaagatgaccctgcacccccagcagatcatgatcggccccagattcaacagagccctgttcgaccccctgctggtggtgctgctggccctgcagctgctggtggtggccggcctggtgagagcccagacctgccccagcgtgtgcagctgcagcaaccagttcagcaaggtgatctgcgtgagaaagaacctgagagaggtgcccgacggcatcagcaccaacaccagactgctgaacctgcacgagaaccagatccagatcatcaaggtgaacagcttcaagcacctgagacacctggagatcctgcagctgagcagaaaccacatcagaaccatcgagatcggcgccttcaacggcctggccaacctgaacaccctggagctgttcgacaacagactgaccaccatccccaacggcgccttcgtgtacctgagcaagctgaaggagctgtggctgagaaacaaccccatcgagagcatccccagctacgccttcaacagaatccccagcctgagaagactggacctgggcgagctgaagagactgagctacatcagcgagggcgccttcgagggcctgagcaacctgagatacctgaacctggccatgtgcaacctgagagagatccccaacctgacccccctgatcaagctggacgagctggacctgagcggcaaccacctgagcgccatcagacccggcagcttccagggcctgatgcacctgcagaagctgtggatgatccagagccagatccaggtgatcgagagaaacgccttcgacaacctgcagagcctggtggagatcaacctggcccacaacaacctgaccctgctgccccacgacctgttcacccccctgcaccacctggagagaatccacctgcaccacaacccctggaactgcaactgcgacatcctgtggctgagctggtggatcaaggacatggcccccagcaacaccgcctgctgcgccagatgcaacaccccccccaacctgaagggcagatacatcggcgagctggaccagaactacttcacctgctacgcccccgtgatcgtggagccccccgccgacctgaacgtgaccgagggcatggccgccgagctgaagtgcagagccagcaccagcctgaccagcgtgagctggatcacccccaacggcaccgtgatgacccacggcgcctacaaggtgagaatcgccgtgctgagcgacggcaccctgaacttcaccaacgtgaccgtgcaggacaccggcatgtacacctgcatggtgagcaacagcgtgggcaacaccaccgccagcgccaccctgaacgtgaccgccgccaccaccacccccttcagctacttcagcaccgtgaccgtggagaccatggagcccagccaggacgaggccagaaccaccgacaacaacgtgggccccacccccgtggtggactgggagaccaccaacgtgaccaccagcctgaccccccagagcaccagaagcaccgagaagaccttcaccatccccgtgaccgacatcaacagcggcatccccggcatcgacgaggtgatgaagaccaccaagatcatcatcggctgcttcgtggccatcaccctgatggccgccgtgatgctggtgatcttctacaagatgagaaagcagcaccacagacagaaccaccacgcccccaccagaaccgtggagatcatcaacgtggacgacgagatcaccggcgacacccccatggagagccacctgcccatgcccgccatcgagcacgagcacctgaaccactacaacagctacaagagccccttcaaccacaccaccaccgtgaacaccatcaacagcatccacagcagcgtgcacgagcccctgctgatcagaatgaacagcaaggacaacgtgcaggagacccagatctag

SEQ ID NO: 86705 - DNA, 1923 bp, Artificial Sequence; identical to SEQ ID NO: 86704
  Description of Artificial Sequence: Synthetic coding sequence

SEQ ID NO: 86706 - DNA, 1923 bp, Artificial Sequence; identical to SEQ ID NO: 86704
  Description of Artificial Sequence: Synthetic coding sequence

SEQ ID NO: 86707 - DNA, 1923 bp, Artificial Sequence; identical to SEQ ID NO: 86704
  Description of Artificial Sequence: Synthetic coding sequence

SEQ ID NO: 86708 - DNA, 126 bp, Artificial Sequence
  Description of Artificial Sequence: Synthetic coding sequence
atgctgaacaagatgaccctgcacccccagcagatcatgatcggccccagattcaacagagccctgttcgaccccctgctggtggtgctgctggccctgcagctgctggtggtggccggcctgtag

SEQ ID NO: 86709 - DNA, 4614 bp, Artificial Sequence
  Description of Artificial Sequence: Synthetic coding sequence
atgaccaccaagagaaagatcatcggcagactggtgccctgcagatgcttcagaggcgaggaggagatcatcagcgtgctggactacagccactgcagcctgcagcaggtgcccaaggaggtgttcaacttcgagagaaccctggaggagctgtacctggacgccaaccagatcgaggagctgcccaagcagctgttcaactgccaggccctgagaaagctgagcatccccgacaacgacctgagcaacctgcccaccaccatcgccagcctggtgaacctgaaggagctggacatcagcaagaacggcgtgcaggagttccccgagaacatcaagtgctgcaagtgcctgaccatcatcgaggccagcgtgaaccccatcagcaagctgcccgacggcttcacccagctgctgaacctgacccagctgtacctgaacgacgccttcctggagttcctgcccgccaacttcggcagactggtgaagctgagaatcctggagctgagagagaaccacctgaagaccctgcccaagagcatgcacaagctggcccagctggagagactggacctgggcaacaacgagttcggcgagctgcccgaggtgctggaccagatccagaacctgagagagctgtggatggacaacaacgccctgcaggtgctgcccggcagcatcggcaagctgaagatgctggtgtacctggacatgagcaagaacagaatcgagaccgtggacatggacatcagcggctgcgaggccctggaggacctgctgctgagcagcaacatgctgcagcagctgcccgacagcatcggcctgctgaagaagctgaccaccctgaaggtggacgacaaccagctgaccatgctgcccaacaccatcggcaacctgagcctgctggaggagttcgactgcagctgcaacgagctggagagcctgcccagcaccatcggctacctgcacagcctgagaaccctggccgtggacgagaacttcctgcccgagctgcccagagagatcggcagctgcaagaacgtgaccgtgatgagcctgagaagcaacaagctggagttcctgcccgaggagatcggccagatgcagaagctgagagtgctgaacctgagcgacaacagactgaagaacctgcccttcagcttcaccaagctgaaggagctggccgccctgtggctgagcgacaaccagagcaaggccctgatccccctgcagaccgaggcccaccccgagaccaagcagagagtgctgaccaactacatgttcccccagcagcccagaggcgacgaggacttccagagcgacagcgacagcttcaaccccaccctgtgggaggagcagagacagcagagaatgaccgtggccttcgagttcgaggacaagaaggaggacgacgagaacgccggcaaggtgaaggacctgagctgccaggccccctgggagagaggccagagaggcatcaccctgcagcccgccagactgagcggcgactgctgcaccccctgggccagatgcgaccagcagatccaggacatgcccgtgccccagaacgacccccagctggcctggggctgcatcagcggcctgcagcaggagagaagcatgtgcacccccctgcccgtggccgcccagagcaccaccctgcccagcctgagcggcagacaggtggagatcaacctgaagagataccccaccccctaccccgaggacctgaagaacatggtgaagagcgtgcagaacctggtgggcaagcccagccacggcgtgagagtggagaacagcaaccccaccgccaacaccgagcagaccgtgaaggagaagtacgagcacaagtggcccgtggcccccaaggagatcaccgtggaggacagcttcgtgcaccccgccaacgagatgagaatcggcgagctgcaccccagcctggccgagacccccctgtacccccccaagctggtgctgctgggcaaggacaagaaggagagcaccgacgagagcgaggtggacaagacccactgcctgaacaacagcgtgagcagcggcacctacagcgactacagccccagccaggccagcagcggcagcagcaacaccagagtgaaggtgggcagcctgcagaccaccgccaaggacgccgtgcacaacagcctgtggggcaacagaatcgcccccagcttcccccagcccctggacagcaagcccctgctgagccagagagaggccgtgccccccggcaacatcccccagagacccgacagactgcccatgagcgacaccttcaccgacaactggaccgacggcagccactacgacaacaccggcttcgtggccgaggagaccaccgccgagaacgccaacagcaaccccctgctgagcagcaagagcagaagcaccagcagccacggcagaagacccctgatcagacaggacagaatcgtgggcgtgcccctggagctggagcagagcacccacagacacacccccgagaccgaggtgccccccagcaacccctggcagaactggaccagaacccccagccccttcgaggacagaaccgccttccccagcaagctggagaccacccccaccaccagccccctgcccgagagaaaggagcacatcaaggagagcaccgagatccccagccccttcagccccggcgtgccctgggagtaccacgacagcaaccccaacagaagcctgagcaacgtgttcagccagatccactgcagacccgagagcagcaagggcgtgatcagcatcagcaagagcaccgagagactgagccccctgatgaaggacatcaagagcaacaagttcaagaagagccagagcatcgacgagatcgacatcggcacctacaaggtgtacaacatccccctggagaactacgccagcggcagcgaccacctgggcagccacgagagacccgacaagatgctgggccccgagcacggcatgagcagcatgagcagaagccagagcgtgcccatgctggacgacgagatgctgacctacggcagcagcaagggcccccagcagcagaaggccagcatgaccaagaaggtgtaccagttcgaccagagcttcaacccccagggcagcgtggaggtgaaggccgagaagagaatccccccccccttccagcacaaccccgagtacgtgcagcaggccagcaagaacatcgccaaggacctgatcagccccagagcctacagaggctacccccccatggagcagatgttcagcttcagccagcccagcgtgaacgaggacgccgtggtgaacgcccagttcgccagccagggcgccagagccggcttcctgagaagagccgacagcctggtgagcgccaccgagatggccatgttcagaagagtgaacgagccccacgagctgccccccaccgacagatacggcagacccccctacagaggcggcctggacagacagagcagcgtgaccgtgaccgagagccagttcctgaagagaaacggcagatacgaggacgagcaccccagctaccaggaggtgaaggcccaggccggcagcttccccgtgaagaacctgacccagagaagacccctgagcgccagaagctacagcaccgagagctacggcgccagccagaccagacccgtgagcgccagacccaccatggccgccctgctggagaagatccccagcgactacaacctgggcaactacggcgacaagcccagcgacaacagcgacctgaagaccagacccacccccgtgaagggcgaggagagctgcggcaagatgcccgccgactggagacagcagctgctgagacacatcgaggccagaagactggacagaaacgccgcctacaagcacaacaccgtgaacctgggcatgctgccctacggcggcatcagcgccatgcacgccggcagaagcatgaccctgaacctgcagaccaagagcaagttcgaccaccaggagctgcccctgcagaagacccccagccagcagagcaacatcctggacaacggccaggaggacgtgagccccagcggccagtggaacccctaccccctgggcagaagagacgtgccccccgacaccatcaccaagaaggccggcagccacatccagaccctgatgggcagccagagcctgcagcacagaagcagagagcagcagccctacgagggcaacatcaacaaggtgaccatccagcagttccagagccccctgcccatccagatccccagcagccaggccaccagaggcccccagcccggcagatgcctgatccagaccaagggccagagaagcatggacggctaccccgagcagttctgcgtgagaatcgagaagaaccccggcctgggcttcagcatcagcggcggcatcagcggccagggcaaccccttcaagcccagcgacaagggcatcttcgtgaccagagtgcagcccgacggccccgccagcaacctgctgcagcccggcgacaagatcctgcaggccaacggccacagcttcgtgcacatggagcacgagaaggccgtgctgctgctgaagagcttccagaacaccgtggacctggtgatccagagagagctgaccgtgtag

SEQ ID NO: 86710 - DNA, 4488 bp, Artificial Sequence
  Description of Artificial Sequence: Synthetic coding sequence
atgcagtgcctggagatgaccaccaagagaaagatcatcggcagactggtgccctgcagatgcttcagaggcgaggaggagatcatcagcgtgctggactacagccactgcagcctgcagcaggtgcccaaggaggtgttcaacttcgagagaaccctggaggagctgtacctggacgccaaccagatcgaggagctgcccaagcagctgttcaactgccaggccctgagaaagctgagcatccccgacaacgacctgagcaacctgcccaccaccatcgccagcctggtgaacctgaaggagctggacatcagcaagaacggcgtgcaggagttccccgagaacatcaagtgctgcaagtgcctgaccatcatcgaggccagcgtgaaccccatcagcaagctgcccgacggcttcacccagctgctgaacctgacccagctgtacctgaacgacgccttcctggagttcctgcccgccaacttcggcagactggtgaagctgagaatcctggagctgagagagaaccacctgaagaccctgcccaagagcatgcacaagctggcccagctggagagactggacctgggcaacaacgagttcggcgagctgcccgaggtgctggaccagatccagaacctgagagagctgtggatggacaacaacgccctgcaggtgctgcccggcagcatcggcaagctgaagatgctggtgtacctggacatgagcaagaacagaatcgagaccgtggacatggacatcagcggctgcgaggccctggaggacctgctgctgagcagcaacatgctgcagcagctgcccgacagcatcggcctgctgaagaagctgaccaccctgaaggtggacgacaaccagctgaccatgctgcccaacaccatcggcaacctgagcctgctggaggagttcgactgcagctgcaacgagctggagagcctgcccagcaccatcggctacctgcacagcctgagaaccctggccgtggacgagaacttcctgcccgagctgcccagagagatcggcagctgcaagaacgtgaccgtgatgagcctgagaagcaacaagctggagttcctgcccgaggagatcggccagatgcagaagctgagagtgctgaacctgagcgacaacagactgaagaacctgcccttcagcttcaccaagctgaaggagctggccgccctgtggctgagcgacaaccagagcaaggccctgatccccctgcagaccgaggcccaccccgagaccaagcagagagtgctgaccaactacatgttcccccagcagcccagaggcgacgaggacttccagagcgacagcgacagcttcaaccccaccctgtgggaggagcagagacagcagagaatgaccgtggccttcgagttcgaggacaagaaggaggacgacgagaacgccggcaaggtgaaggacctgagctgccaggccccctgggagagaggccagagaggcatcaccctgcagcccgccagactgagcggcgactgctgcaccccctgggccagatgcgaccagcagatccaggacatgcccgtgccccagaacgacccccagctggcctggggctgcatcagcggcctgcagcaggagagaagcatgtgcacccccctgcccgtggccgcccagagcaccaccctgcccagcctgagcggcagacaggtggagatcaacctgaagagataccccaccccctaccccgaggacctgaagaacatggtgaagagcgtgcagaacctggtgggcaagcccagccacggcgtgagagtggagaacagcaaccccaccgccaacaccgagcagaccgtgaaggagaagtacgagcacaagtggcccgtggcccccaaggagatcaccgtggaggacagcttcgtgcaccccgccaacgagatgagaatcggcgagctgcaccccagcctggccgagacccccctgtacccccccaagctggtgctgctgggcaaggacaagaaggagagcaccgacgagagcgaggtggacaagacccactgcctgaacaacagcgtgagcagcggcacctacagcgactacagccccagccaggccagcagcggcagcagcaacaccagagtgaaggtgggcagcctgcagaccaccgccaaggacgccgtgcacaacagcctgtggggcaacagaatcgcccccagcttcccccagcccctggacagcaagcccctgctgagccagagagaggccgtgccccccggcaacatcccccagagacccgacagactgcccatgagcgacaccttcaccgacaactggaccgacggcagccactacgacaacaccggcttcgtggccgaggagaccaccgccgagaacgccaacagcaaccccctgctgagcagcaagagcagaagcaccagcagccacggcagaagacccctgatcagacaggacagaatcgtgggcgtgcccctggagctggagcagagcacccacagacacacccccgagaccgaggtgccccccagcaacccctggcagaactggaccagaacccccagccccttcgaggacagaaccgccttccccagcaagctggagaccacccccaccaccagccccctgcccgagagaaaggagcacatcaaggagagcaccgagatccccagccccttcagccccggcgtgccctgggagtaccacgacagcaaccccaacagaagcctgagcaacgtgttcagccagatccactgcagacccgagagcagcaagggcgtgatcagcatcagcaagagcaccgagagactgagccccctgatgaaggacatcaagagcaacaagttcaagaagagccagagcatcgacgagatcgacatcggcacctacaaggtgtacaacatccccctggagaactacgccagcggcagcgaccacctgggcagccacgagagacccgacaagatgctgggccccgagcacggcatgagcagcatgagcagaagccagagcgtgcccatgctggacgacgagatgctgacctacggcagcagcaagggcccccagcagcagaaggccagcatgaccaagaaggtgtaccagttcgaccagagcttcaacccccagggcagcgtggaggtgaaggccgagaagagaatccccccccccttccagcacaaccccgagtacgtgcagcaggccagcaagaacatcgccaaggacctgatcagccccagagcctacagaggctacccccccatggagcagatgttcagcttcagccagcccagcgtgaacgaggacgccgtggtgaacgcccagttcgccagccagggcgccagagccggcttcctgagaagagccgacagcctggtgagcgccaccgagatggccatgttcagaagagtgaacgagccccacgagctgccccccaccgacagatacggcagacccccctacagaggcggcctggacagacagagcagcgtgaccgtgaccgagagccagttcctgaagagaaacggcagatacgaggacgagcaccccagctaccaggaggtgaaggcccaggccggcagcttccccgtgaagaacctgacccagagaagacccctgagcgccagaagctacagcaccgagagctacggcgccagccagaccagacccgtgagcgccagacccaccatggccgccctgctggagaagatccccagcgactacaacctgggcaactacggcgacaagcccagcgacaacagcgacctgaagaccagacccacccccgtgaagggcgaggagagctgcggcaagatgcccgccgactggagacagcagctgctgagacacatcgaggccagaagactggacagaacccccagccagcagagcaacatcctggacaacggccaggaggacgtgagccccagcggccagtggaacccctaccccctgggcagaagagacgtgccccccgacaccatcaccaagaaggccggcagccacatccagaccctgatgggcagccagagcctgcagcacagaagcagagagcagcagccctacgagggcaacatcaacaaggtgaccatccagcagttccagagccccctgcccatccagatccccagcagccaggccaccagaggcccccagcccggcagatgcctgatccagaccaagggccagagaagcatggacggctaccccgagcagttctgcgtgagaatcgagaagaaccccggcctgggcttcagcatcagcggcggcatcagcggccagggcaaccccttcaagcccagcgacaagggcatcttcgtgaccagagtgcagcccgacggccccgccagcaacctgctgcagcccggcgacaagatcctgcaggccaacggccacagcttcgtgcacatggagcacgagaaggccgtgctgctgctgaagagcttccagaacaccgtggacctggtgatccagagagagctgaccgtgtag

SEQ ID NO: 86711 - DNA, 540 bp, Artificial Sequence
  Description of Artificial Sequence: Synthetic coding sequence
atgaccaccaagagaaagatcatcggcagactggtgccctgcagatgcttcagaggcgaggaggagatcatcagcgtgctggactacagccactgcagcctgcagcaggtgcccaaggaggtgttcaacttcgagagaaccctggaggagctgtacctggacgccaaccagatcgaggagctgcccaagcagctgttcaactgccaggccctgagaaagctgagcatccccgacaacgacctgagcaacctgcccaccaccatcgccagcctggtgaacctgaaggagctggacatcagcaagaacggcgtgcaggagttccccgagaacatcaagtgctgcaagtgcctgaccatcatcgaggccagcgtgaaccccatcagcaagctgcccgacggcttcacccagctgctgaacctgacccagctgtacctgaacgacgccttcctggagttcctgcccgccaacttcggcagactggtgaagctgagaatcctggagctgagagagaaccacctgaagaccctgcccaagatctag

SEQ ID NO: 86712 - DNA, 3942 bp, Artificial Sequence
  Description of Artificial Sequence: Synthetic coding sequence
agaagcatgcacaagctggcccagctggagagactggacctgggcaacaacgagttcggcgagctgcccgaggtgctggaccagatccagaacctgagagagctgtggatggacaacaacgccctgcaggtgctgcccggcagcatcggcaagctgaagatgctggtgtacctggacatgagcaagaacagaatcgagaccgtggacatggacatcagcggctgcgaggccctggaggacctgctgctgagcagcaacatgctgcagcagctgcccgacagcatcggcctgctgaagaagctgaccaccctgaaggtggacgacaaccagctgaccatgctgcccaacaccatcggcaacctgagcctgctggaggagttcgactgcagctgcaacgagctggagagcctgcccagcaccatcggctacctgcacagcctgagaaccctggccgtggacgagaacttcctgcccgagctgcccagagagatcggcagctgcaagaacgtgaccgtgatgagcctgagaagcaacaagctggagttcctgcccgaggagatcggccagatgcagaagctgagagtgctgaacctgagcgacaacagactgaagaacctgcccttcagcttcaccaagctgaaggagctggccgccctgtggctgagcgacaaccagagcaaggccctgatccccctgcagaccgaggcccaccccgagaccaagcagagagtgctgaccaactacatgttcccccagcagcccagaggcgacgaggacttccagagcgacagcgacagcttcaaccccaccctgtgggaggagcagagacagcagagaatgaccgtggccttcgagttcgaggacaagaaggaggacgacgagaacgccggcaaggtgaaggacctgagctgccaggccccctgggagagaggccagagaggcatcaccctgcagcccgccagactgagcggcgactgctgcaccccctgggccagatgcgaccagcagatccaggacatgcccgtgccccagaacgacccccagctggcctggggctgcatcagcggcctgcagcaggagagaagcatgtgcacccccctgcccgtggccgcccagagcaccaccctgcccagcctgagcggcagacaggtggagatcaacctgaagagataccccaccccctaccccgaggacctgaagaacatggtgaagagcgtgcagaacctggtgggcaagcccagccacggcgtgagagtggagaacagcaaccccaccgccaacaccgagcagaccgtgaaggagaagtacgagcacaagtggcccgtggcccccaaggagatcaccgtggaggacagcttcgtgcaccccgccaacgagatgagaatcggcgagctgcaccccagcctggccgagacccccctgtacccccccaagctggtgctgctgggcaaggacaagaaggagagcaccgacgagagcgaggtggacaagacccactgcctgaacaacagcgtgagcagcggcacctacagcgactacagccccagccaggccagcagcggcagcagcaacaccagagtgaaggtgggcagcctgcagaccaccgccaaggacgccgtgcacaacagcctgtggggcaacagaatcgcccccagcttcccccagcccctggacagcaagcccctgctgagccagagagaggccgtgccccccggcaacatcccccagagacccgacagactgcccatgagcgacaccttcaccgacaactggaccgacggcagccactacgacaacaccggcttcgtggccgaggagaccaccgccgagaacgccaacagcaaccccctgctgagcagcaagagcagaagcaccagcagccacggcagaagacccctgatcagacaggacagaatcgtgggcgtgcccctggagctggagcagagcacccacagacacacccccgagaccgaggtgccccccagcaacccctggcagaactggaccagaacccccagccccttcgaggacagaaccgccttccccagcaagctggagaccacccccaccaccagccccctgcccgagagaaaggagcacatcaaggagagcaccgagatccccagccccttcagccccggcgtgccctgggagtaccacgacagcaaccccaacagaagcctgagcaacgtgttcagccagatccactgcagacccgagagcagcaagggcgtgatcagcatcagcaagagcaccgagagactgagccccctgatgaaggacatcaagagcaacaagttcaagaagagccagagcatcgacgagatcgacatcggcacctacaaggtgtacaacatccccctggagaactacgccagcggcagcgaccacctgggcagccacgagagacccgacaagatgctgggccccgagcacggcatgagcagcatgagcagaagccagagcgtgcccatgctggacgacgagatgctgacctacggcagcagcaagggcccccagcagcagaaggccagcatgaccaagaaggtgtaccagttcgaccagagcttcaacccccagggcagcgtggaggtgaaggccgagaagagaatccccccccccttccagcacaaccccgagtacgtgcagcaggccagcaagaacatcgccaaggacctgatcagccccagagcctacagaggctacccccccatggagcagatgttcagcttcagccagcccagcgtgaacgaggacgccgtggtgaacgcccagttcgccagccagggcgccagagccggcttcctgagaagagccgacagcctggtgagcgccaccgagatggccatgttcagaagagtgaacgagccccacgagctgccccccaccgacagatacggcagacccccctacagaggcggcctggacagacagagcagcgtgaccgtgaccgagagccagttcctgaagagaaacggcagatacgaggacgagcaccccagctaccaggaggtgaaggcccaggccggcagcttccccgtgaagaacctgacccagagaagacccctgagcgccagaagctacagcaccgagagctacggcgccagccagaccagacccgtgagcgccagacccaccatggccgccctgctggagaagatccccagcgactacaacctgggcaactacggcgacaagcccagcgacaacagcgacctgaagaccagacccacccccgtgaagggcgaggagagctgcggcaagatgcccgccgactggagacagcagctgctgagacacatcgaggccagaagactggacagaacccccagccagcagagcaacatcctggacaacggccaggaggacgtgagccccagcggccagtggaacccctaccccctgggcagaagagacgtgccccccgacaccatcaccaagaaggccggcagccacatccagaccctgatgggcagccagagcctgcagcacagaagcagagagcagcagccctacgagggcaacatcaacaaggtgaccatccagcagttccagagccccctgcccatccagatccccagcagccaggccaccagaggcccccagcccggcagatgcctgatccagaccaagggccagagaagcatggacggctaccccgagcagttctgcgtgagaatcgagaagaaccccggcctgggcttcagcatcagcggcggcatcagcggccagggcaaccccttcaagcccagcgacaagggcatcttcgtgaccagagtgcagcccgacggccccgccagcaacctgctgcagcccggcgacaagatcctgcaggccaacggccacagcttcgtgcacatggagcacgagaaggccgtgctgctgctgaagagcttccagaacaccgtggacctggtgatccagagagagctgaccgtgtag

SEQ ID NO: 86713 - DNA, 654 bp, Artificial Sequence
  Description of Artificial Sequence: Synthetic coding sequence
atgatggagaacctgatcagaggcagaaaccccccccagtaccagagaagcccctgcaaggaggtgagagccgccctgagaaagagacccgaggaggagctgcagtgcctggagatgaccaccaagagaaagatcatcggcagactggtgccctgcagatgcttcagaggcgaggaggagatcatcagcgtgctggactacagccactgcagcctgcagcaggtgcccaaggaggtgttcaacttcgagagaaccctggaggagctgtacctggacgccaaccagatcgaggagctgcccaagcagctgttcaactgccaggccctgagaaagctgagcatccccgacaacgacctgagcaacctgcccaccaccatcgccagcctggtgaacctgaaggagctggacatcagcaagaacggcgtgcaggagttccccgagaacatcaagtgctgcaagtgcctgaccatcatcgaggccagcgtgaaccccatcagcaagctgcccgacggcttcacccagctgctgaacctgacccagctgtacctgaacgacgccttcctggagttcctgcccgccaacttcggcagactggtgaagctgagaatcctggagctgagagagaaccacctgaagaccctgcccaacatctag

SEQ ID NO: 86714 - DNA, 2466 bp, Artificial Sequence
  Description of Artificial Sequence: Synthetic coding sequence
atgaccaagatgctgggcaagctgagaatcgcccccagcttcccccagcccctggacagcaagcccctgctgagccagagagaggccgtgccccccggcaacatcccccagagacccgacagactgcccatgagcgacaccttcaccgacaactggaccgacggcagccactacgacaacaccggcttcgtggccgaggagaccaccgccgagaacgccaacagcaaccccctgctgagcagcaagagcagaagcaccagcagccacggcagaagacccctgatcagacaggacagaatcgtgggcgtgcccctggagctggagcagagcacccacagacacacccccgagaccgaggtgccccccagcaacccctggcagaactggaccagaacccccagccccttcgaggacagaaccgccttccccagcaagctggagaccacccccaccaccagccccctgcccgagagaaaggagcacatcaaggagagcaccgagatccccagccccttcagccccggcgtgccctgggagtaccacgacagcaaccccaacagaagcctgagcaacgtgttcagccagatccactgcagacccgagagcagcaagggcgtgatcagcatcagcaagagcaccgagagactgagccccctgatgaaggacatcaagagcaacaagttcaagaagagccagagcatcgacgagatcgacatcggcacctacaaggtgtacaacatccccctggagaactacgccagcggcagcgaccacctgggcagccacgagagacccgacaagatgctgggccccgagcacggcatgagcagcatgagcagaagccagagcgtgcccatgctggacgacgagatgctgacctacggcagcagcaagggcccccagcagcagaaggccagcatgaccaagaaggtgtaccagttcgaccagagcttcaacccccagggcagcgtggaggtgaaggccgagaagagaatccccccccccttccagcacaaccccgagtacgtgcagcaggccagcaagaacatcgccaaggacctgatcagccccagagcctacagaggctacccccccatggagcagatgttcagcttcagccagcccagcgtgaacgaggacgccgtggtgaacgcccagttcgccagccagggcgccagagccggcttcctgagaagagccgacagcctggtgagcgccaccgagatggccatgttcagaagagtgaacgagccccacgagctgccccccaccgacagatacggcagacccccctacagaggcggcctggacagacagagcagcgtgaccgtgaccgagagccagttcctgaagagaaacggcagatacgaggacgagcaccccagctaccaggaggtgaaggcccaggccggcagcttccccgtgaagaacctgacccagagaagacccctgagcgccagaagctacagcaccgagagctacggcgccagccagaccagacccgtgagcgccagacccaccatggccgccctgctggagaagatccccagcgactacaacctgggcaactacggcgacaagcccagcgacaacagcgacctgaagaccagacccacccccgtgaagggcgaggagagctgcggcaagatgcccgccgactggagacagcagctgctgagacacatcgaggccagaagactggacagaaacgccgcctacaagcacaacaccgtgaacctgggcatgctgccctacggcggcatcagcgccatgcacgccggcagaagcatgaccctgaacctgcagaccaagagcaagttcgaccaccaggagctgcccctgcagaagacccccagccagcagagcaacatcctggacaacggccaggaggacgtgagccccagcggccagtggaacccctaccccctgggcagaagagacgtgccccccgacaccatcaccaagaaggccggcagccacatccagaccctgatgggcagccagagcctgcagcacagaagcagagagcagcagccctacgagggcaacatcaacaaggtgaccatccagcagttccagagccccctgcccatccagatccccagcagccaggccaccagaggcccccagcccggcagatgcctgatccagaccaagggccagagaagcatggacggctaccccgagcagttctgcgtgagaatcgagaagaaccccggcctgggcttcagcatcagcggcggcatcagcggccagggcaaccccttcaagcccagcgacaagggcatcttcgtgaccagagtgcagcccgacggccccgccagcaacctgctgcagcccggcgacaagatcctgcaggccaacggccacagcttcgtgcacatggagcacgagaaggccgtgctgctgctgaagagcttccagaacaccgtggacctggtgatccagagagagctgaccgtgtag

SEQ ID NO: 86715 - DNA, 2433 bp, Artificial Sequence
  Description of Artificial Sequence: Synthetic coding sequence
atgatccccgtgaccgagctgagatacttcgccgacacccagcccgcctacagaatcctgaagccctggtgggacgtgttcaccgactacatcagcatcgtgatgctgatgatcgccgtgttcggcggcaccctgcaggtgacccaggacaagatgatctgcctgccctgcaagtgggtgaccaaggacagctgcaacgacagcttcagaggctgggccgcccccggccccgagcccacctaccccaacagcaccatcctgcccacccccgacaccggccccaccggcatcaagtacgacctggacagacaccagtacaactacgtggacgccgtgtgctacgagaacagactgcactggttcgccaagtacttcccctacctggtgctgctgcacaccctgatcttcctggcctgcagcaacttctggttcaagttccccagaaccagcagcaagctggagcacttcgtgagcatcctgctgaagtgcttcgacagcccctggaccaccagagccctgagcgagaccgtggtggaggagagcgaccccaagcccgccttcagcaagatgaacggcagcatggacaagaagagcagcaccgtgagcgaggacgtggaggccaccgtgcccatgctgcagagaaccaagagcagaatcgagcagggcatcgtggacagaagcgagaccggcgtgctggacaagaaggagggcgagcaggccaaggccctgttcgagaaggtgaagaagttcagaacccacgtggaggagggcgacatcgtgtacagactgtacatgagacagaccatcatcaaggtgatcaagttcatcctgatcatctgctacaccgtgtactacgtgcacaacatcaagttcgacgtggactgcaccgtggacatcgagagcctgaccggctacagaacctacagatgcgcccaccccctggccaccctgttcaagatcctggccagcttctacatcagcctggtgatcttctacggcctgatctgcatgtacaccctgtggtggatgctgagaagaagcctgaagaagtacagcttcgagagcatcagagaggagagcagctacagcgacatccccgacgtgaagaacgacttcgccttcatgctgcacctgatcgaccagtacgaccccctgtacagcaagagattcgccgtgttcctgagcgaggtgagcgagaacaagctgagacagctgaacctgaacaacgagtggaccctggacaagctgagacagagactgaccaagaacgcccaggacaagctggagctgcacctgttcatgctgagcggcatccccgacaccgtgttcgacctggtggagctggaggtgctgaagctggagctgatccccgacgtgaccatcccccccagcatcgcccagctgaccggcctgaaggagctgtggctgtaccacaccgccgccaagatcgaggcccccgccctggccttcctgagagagaacctgagagccctgcacatcaagttcaccgacatcaaggagatccccctgtggatctacagcctgaagaccctggaggagctgcacctgaccggcaacctgagcgccgagaacaacagatacatcgtgatcgacggcctgagagagctgaagagactgaaggtgctgagactgaagagcaacctgagcaagctgccccaggtggtgaccgacgtgggcgtgcacctgcagaagctgagcatcaacaacgagggcaccaagctgatcgtgctgaacagcctgaagaagatggccaacctgaccgagctggagctgatcagatgcgacctggagagaatcccccacagcatcttcagcctgcacaacctgcaggagatcgacctgaaggacaacaacctgaagaccatcgaggagatcatcagcttccagcacctgcacagactgacctgcctgaagctgtggtacaaccacatcgcctacatccccatccagatcggcaacctgaccaacctggagagactgtacctgaacagaaacaagatcgagaagatccccacccagctgttctactgcagaaagctgagatacctggacctgagccacaacaacctgaccttcctgcccgccgacatcggcctgctgcagaacctgcagaacctggccatcaccgccaacagaatcgagaccctgccccccgagctgttccagtgcagaaagctgagagccctgcacctgggcaacaacgtgctgcagagcctgcccagcagagtgggcgagctgaccaacctgacccagatcgagctgagaggcaacagactggagtgcctgcccgtggagctgggcgagtgccccctgctgaagagaagcggcctggtggtggaggaggacctgttcaacaccctgccccccgaggtgaaggagagactgtggagagccgacaaggagcaggcctag

SEQ ID NO: 86716 - DNA, 2433 bp, Artificial Sequence; identical to SEQ ID NO: 86715
  Description of Artificial Sequence: Synthetic coding sequence

SEQ ID NO: 86717 - DNA, 2433 bp, Artificial Sequence; identical to SEQ ID NO: 86715
  Description of Artificial Sequence: Synthetic coding sequence

SEQ ID NO: 86718 - DNA, 2412 bp, Artificial Sequence
  Description of Artificial Sequence: Synthetic coding sequence
atgatcaccctgaccgagctgaagtgcctggccgacgcccagagcagctaccacatcctgaagccctggtgggacgtgttctggtactacatcaccctgatcatgctgctggtggccgtgctggccggcgccctgcagctgacccagagcagagtgctgtgctgcctgccctgcaaggtggagttcgacaaccactgcgccgtgccctgggacatcctgaaggccagcatgaacaccagcagcaaccccggcacccccctgcccctgcccctgagaatccagaacgacctgcacagacagcagtacagctacatcgacgccgtgtgctacgagaagcagctgcactggttcgccaagttcttcccctacctggtgctgctgcacaccctgatcttcgccgcctgcagcaacttctggctgcactaccccagcaccagcagcagactggagcacttcgtggccatcctgcacaagtgcttcgacagcccctggaccaccagagccctgagcgagaccgtggccgagcagagcgtgagacccctgaagctgagcaagagcaagatcctgctgagcagcagcggctgcagcgccgacatcgacagcggcaagcagagcctgccctacccccagcccggcctggagagcgccggcatcgagagccccaccagcagcgtgctggacaagaaggagggcgagcaggccaaggccatcttcgagaaggtgaagagattcagaatgcacgtggagcagaaggacatcatctacagagtgtacctgaagcagatcatcgtgaaggtgatcctgttcgtgctgatcatcacctacgtgccctacttcctgacccacatcaccctggagatcgactgcagcgtggacgtgcaggccttcaccggctacaagagataccagtgcgtgtacagcctggccgagatcttcaaggtgctggccagcttctacgtgatcctggtgatcctgtacggcctgaccagcagctacagcctgtggtggatgctgagaagcagcctgaagcagtacagcttcgaggccctgagagagaagagcaactacagcgacatccccgacgtgaagaacgacttcgccttcatcctgcacctggccgaccagtacgaccccctgtacagcaagagattcagcatcttcctgagcgaggtgagcgagaacaagctgaagcagatcaacctgaacaacgagtggaccgtggagaagctgaagagcaagctggtgaagaacgcccaggacaagatcgagctgcacctgttcatgctgaacggcctgcccgacaacgtgttcgagctgaccgagatggaggtgctgagcctggagctgatccccgaggtgaagctgcccagcgccgtgagccagctggtgaacctgaaggagctgagagtgtaccacagcagcctggtggtggaccaccccgccctggccttcctggaggagaacctgaagatcctgagactgaagttcaccgagatgggcaagatccccagatgggtgttccacctgaagaacctgaaggagctgtacctgagcggctgcgtgctgcccgagcagctgagcaccatgcagctggagggcttccaggacctgaagaacctgagaaccctgtacctgaagagcagcctgagcagaatcccccaggtggtgaccgacctgctgcccagcctgcagaagctgagcctggacaacgagggcagcaagctggtggtgctgaacaacctgaagaagatggtgaacctgaagagcctggagctgatcagctgcgacctggagagaatcccccacagcatcttcagcctgaacaacctgcacgagctggacctgagagagaacaacctgaagaccgtggaggagatcatcagcttccagcacctgcagaacctgagctgcctgaagctgtggcacaacaacatcgcctacatccccgcccagatcggcgccctgagcaacctggagcagctgagcctggaccacaacaacatcgagaacctgcccctgcagctgttcctgtgcaccaagctgcactacctggacctgagctacaaccacctgaccttcatccccgaggagatccagtacctgagcaacctgcagtacttcgccgtgaccaacaacaacatcgagatgctgcccgacggcctgttccagtgcaagaagctgcagtgcctgctgctgggcaagaacagcctgatgaacctgagcccccacgtgggcgagctgagcaacctgacccacctggagctgatcggcaactacctggagaccctgccccccgagctggagggctgccagagcctgaagagaaactgcctgatcgtggaggagaacctgctgaacaccctgcccctgcccgtgaccgagagactgcagacctgcctggacaagtgctag

SEQ ID NO: 86719 - DNA, 2412 bp, Artificial Sequence; identical to SEQ ID NO: 86718
  Description of Artificial Sequence: Synthetic coding sequence

SEQ ID NO: 86720 - DNA, 2412 bp, Artificial Sequence; identical to SEQ ID NO: 86718
  Description of Artificial Sequence: Synthetic coding sequence

SEQ ID NO: 86721 - DNA, 312 bp, Artificial Sequence
  Description of Artificial Sequence: Synthetic coding sequence
atgatcaccctgaccgagctgaagtgcctggccgacgcccagagcagctaccacatcctgaagccctggtgggacgtgttctggtactacatcaccctgatcatgctgctggtggccgtgctggccggcgccctgcagctgacccagagcagagtgctgtgctgcctgccctgcaaggtggagttcgacaaccactgcgccgtgccctgggacatcctgaaggccagcatgaacaccagcagcaaccccggcacccccctgcccctgcccctgagaatccagaacgacctgcacagacagcagtacagctag

SEQ ID NO: 86722 - DNA, 693 bp, Artificial Sequence
  Description of Artificial Sequence: Synthetic coding sequence
atgatcaccctgaccgagctgaagtgcctggccgacgcccagagcagctaccacatcctgaagccctggtgggacgtgttctggtactacatcaccctgatcatgctgctggtggccgtgctggccggcgccctgcagctgacccagagcagagtgctgtgctgcctgccctgcaaggtggagttcgacaaccactgcgccgtgccctgggacatcctgaaggccagcatgaacaccagcagcaaccccggcacccccctgcccctgcccctgagaatccagaacgacctgcacagacagcagtacagctacatcgacgccgtgtgctacgagaagcagctgcactggttcgccaagttcttcccctacctggtgctgctgcacaccctgatcttcgccgcctgcagcaacttctggctgcactaccccagcaccagcagcagactggagcacttcgtggccatcctgcacaagtgcttcgacagcccctggaccaccagagccctgagcgagaccgtggccgagcagagcgtgagacccctgaagctgagcaagagcaagatcctgctgagcagcagcggctgcagcgccgacatcgacagcggcaagcagagcctgccctacccccagcccggcctggagagcgccggcatcgagagccccaccagcagcgtgctgaccgagggcggctag

SEQ ID NO: 86723 - DNA, 2412 bp, Artificial Sequence
  Description of Artificial Sequence: Synthetic coding sequence
atgatccccgtgaccgagttcagacagttcagcgagcagcagcccgccttcagagtgctgaagccctggtgggacgtgttcaccgactacctgagcgtggccatgctgatgatcggcgtgttcggctgcaccctgcaggtgatgcaggacaagatcatctgcctgcccaagagagtgcagcccgcccagaaccacagcagcctgagcaacgtgagccaggccgtggccagcaccacccccctgcccccccccaagcccagccccgccaaccccatcaccgtggagatgaagggcctgaagaccgacctggacctgcagcagtacagcttcatcaaccagatgtgctacgagagagccctgcactggtacgccaagtacttcccctacctggtgctgatccacaccctggtgttcatgctgtgcagcaacttctggttcaagttccccggcagcagcagcaagatcgagcacttcatcagcatcctgggcaagtgcttcgacagcccctggaccaccagagccctgagcgaggtgagcggcgaggacagcgaggagaaggacaacagaaagaacaacatgaacagaagcaacaccatccagagcggccccgaggacagcctggtgaacagccagagcctgaagagcatccccgagaagttcgtggtggacaagagcaccgccggcgccctggacaagaaggagggcgagcaggccaaggccctgttcgagaaggtgaagaagttcagactgcacgtggaggagggcgacatcctgtacgccatgtacgtgagacagaccgtgctgaaggtgatcaagttcctgatcatcatcgcctacaacagcgccctggtgagcaaggtgcagttcaccgtggactgcaacgtggacatccaggacatgaccggctacaagaacttcagctgcaaccacaccatggcccacctgttcagcaagctgagcttctgctacctgtgcttcgtgagcatctacggcctgacctgcctgtacaccctgtactggctgttctacagaagcctgagagagtacagcttcgagtacgtgagacaggagaccggcatcgacgacatccccgacgtgaagaacgacttcgccttcatgctgcacatgatcgaccagtacgaccccctgtacagcaagagattcgccgtgttcctgagcgaggtgagcgagaacaagctgaagcagctgaacctgaacaacgagtggacccccgacaagctgagacagaagctgcagaccaacgcccacaacagactggagctgcccctgatcatgctgagcggcctgcccgacaccgtgttcgagatcaccgagctgcagagcctgaagctggagatcatcaagaacgtgatgatccccgccaccatcgcccagctggacaacctgcaggagctgagcctgcaccagtgcagcgtgaagatccacagcgccgccctgagcttcctgaaggagaacctgaaggtgctgagcgtgaagttcgacgacatgagagagctgcccccctggatgtacggcctgagaaacctggaggagctgtacctggtgggcagcctgagccacgacatcagcagaaacgtgaccctggagagcctgagagacctgaagagcctgaagatcctgagcatcaagagcaacgtgagcaagatcccccaggccgtggtggacgtgagcagccacctgcagaagatgtgcatccacaacgacggcaccaagctggtgatgctgaacaacctgaagaagatgaccaacctgaccgagctggagctggtgcactgcgacctggagagaatcccccacgccgtgttcagcctgctgagcctgcaggagctggacctgaaggagaacaacctgaagagcatcgaggagatcgtgagcttccagcacctgagaaagctgaccgtgctgaagctgtggcacaacagcatcacctacatccccgagcacatcaagaagctgaccagcctggagagactgagcttcagccacaacaagatcgaggtgctgcccagccacctgttcctgtgcaacaagatcagatacctggacctgagctacaacgacatcagattcatcccccccgagatcggcgtgctgcagagcctgcagtacttcagcatcacctgcaacaaggtggagagcctgcccgacgagctgtacttctgcaagaagctgaagaccctgaagatcggcaagaacagcctgagcgtgctgagccccaagatcggcaacctgctgttcctgagctacctggacgtgaagggcaaccacttcgagatcctgccccccgagctgggcgactgcagagccctgaagagagccggcctggtggtggaggacgccctgttcgagaccctgcccagcgacgtgagagagcagatgaagaccgagtag

SEQ ID NO: 86724 - DNA, 2577 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctggccgtggtgatgctgatggtggccatcttcgccggcaccatgcagctgaccaaggaccaggtggtgtgcctgcccgtgctgcccagccccgtgaacagcaaggcccacaccccccccggcaacgccgaggtgaccaccaacatccccaagatggaggccgccaccaaccaggaccaggacggcagaaccaccaacgacatcagcttcggcaccagcgccgtgacccccgacatccccctgagagccacctaccccagaaccgacttcgccctgcccaaccaggaggccaagaaggagaagaaggaccccaccggcagaaagaccaacctggacttccagcagtacgtgttcatcaaccagatgtgctaccacctggccctgccctggtacagcaagtacttcccctacctggccctgatccacaccatcatcctgatggtgagcagcaacttctggttcaagtaccccaagacctgcagcaaggtggagcacttcgtgagcatcctgggcaagtgcttcgagagcccctggaccaccaaggccctgagcgagaccgcctgcgaggacagcgaggagaacaagcagagaatcaccggcgcccagaccctgcccaagcacgtgagcaccagcagcgacgagggcagccccagcgccagcacccccatgatcaacaagaccggcttcaagttcagcgccgagaagcccgtgatcgaggtgcccagcatgaccatcctggacaagaaggacggcgagcaggccaaggccctgttcgagaaggtgagaaagttcagagcccacgtggaggacagcgacctgatctacaagctgtacgtggtgcagaccgtgatcaagaccgccaagttcatcttcatcctgtgctacaccgccaacttcgtgaacgccatcagcttcgagcacgtgtgcaagcccaaggtggagcacctgatcggctacgaggtgttcgagtgcacccacaacatggcctacatgctgaagaagctgctgatcagctacatcagcatcatctgcgtgtacggcttcatctgcctgtacaccctgttctggctgttcagaatccccctgaaggagtacagcttcgagaaggtgagagaggagagcagcttcagcgacatccccgacgtgaagaacgacttcgccttcctgctgcacatggtggaccagtacgaccagctgtacagcaagagattcggcgtgttcctgagcgaggtgagcgagaacaagctgagagagatcagcctgaaccacgagtggaccttcgagaagctgagacagcacatcagcagaaacgcccaggacaagcaggagctgcacctgttcatgctgagcggcgtgcccgacgccgtgttcgacctgaccgacctggacgtgctgaagctggagctgatccccgaggccaagatccccgccaagatcagccagatgaccaacctgcaggagctgcacctgtgccactgccccgccaaggtggagcagaccgccttcagcttcctgagagaccacctgagatgcctgcacgtgaagttcaccgacgtggccgagatccccgcctgggtgtacctgctgaagaacctgagagagctgtacctgatcggcaacctgaacagcgagaacaacaagatgatcggcctggagagcctgagagagctgagacacctgaagatcctgcacgtgaagagcaacctgaccaaggtgcccagcaacatcaccgacgtggccccccacctgaccaagctggtgatccacaacgacggcaccaagctgctggtgctgaacagcctgaagaagatgatgaacgtggccgagctggagctgcagaactgcgagctggagagaatcccccacgccatcttcagcctgagcaacctgcaggagctggacctgaagagcaacaacatcagaaccatcgaggagatcatcagcttccagcacctgaagagactgacctgcctgaagctgtggcacaacaagatcgtgaccatcccccccagcatcacccacgtgaagaacctggagagcctgtacttcagcaacaacaagctggagagcctgcccgtggccgtgttcagcctgcagaagctgagatgcctggacgtgagctacaacaacatcagcatgatccccatcgagatcggcctgctgcagaacctgcagcacctgcacatcaccggcaacaaggtggacatcctgcccaagcagctgttcaagtgcatcaagctgagaaccctgaacctgggccagaactgcatcaccagcctgcccgagaaggtgggccagctgagccagctgacccagctggagctgaagggcaactgcctggacagactgcccgcccagctgggccagtgcagaatgctgaagaagagcggcctggtggtggaggaccacctgttcgacaccctgcccctggaggtgaaggaggccctgaaccaggacatcaacatccccttcgccaacggcatctag

SEQ ID NO: 86725 - DNA, 2577 bp, Artificial Sequence; identical to SEQ ID NO: 86724
  Description of Artificial Sequence: Synthetic coding sequence

SEQ ID NO: 86726 - DNA, 354 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctggccgtggtgatgctgatggtggccatcttcgccggcaccatgcagctgaccaaggaccaggtggtgtgcctgcccgtgctgcccagccccgtgaacagcaaggcccacaccccccccggcaacgccgaggtgaccaccaacatccccaagatggaggccgccaccaaccaggaccaggacggcagaaccaccaacgacatcagcttcggcaccagcgccgtgacccccgacatccccctgagagccacctaccccagatag

SEQ ID NO: 86727 - DNA, 825 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctggccgtggtgatgctgatggtggccatcttcgccggcaccatgcagctgaccaaggaccaggtggtgtgcctgcccgtgctgcccagccccgtgaacagcaaggcccacaccccccccggcaacgccgaggtgaccaccaacatccccaagatggaggccgccaccaaccaggaccaggacggcagaaccaccaacgacatcagcttcggcaccagcgccgtgacccccgacatccccctgagagccacctaccccagaaccgacttcgccctgcccaaccaggaggccaagaaggagaagaaggaccccaccggcagaaagaccaacctggacttccagcagtacgtgttcatcaaccagatgtgctaccacctggccctgccctggtacagcaagtacttcccctacctggccctgatccacaccatcatcctgatggtgagcagcaacttctggttcaagtaccccaagacctgcagcaaggtggagcacttcgtgagcatcctgggcaagtgcttcgagagcccctggaccaccaaggccctgagcgagaccgcctgcgaggacagcgaggagaacaagcagagaatcaccggcgcccagaccctgcccaagcacgtgagcaccagcagcgacgagggcagccccagcgccagcacccccatgatcaacaagaccggcttcaagttcagcgccgagaagcccgtgatcgaggtgcccagcatgacctag

SEQ ID NO: 86728 - DNA, 96 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctgtag

SEQ ID NO: 86729 - DNA, 564 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctggccgtggtgatgctgatggtggccatcttcgccggcaccatgcagctgaccaaggaccaggtggtgtgcctgcccgtgctgcccagccccgtgaacagcaaggcccacaccccccccggcaacgccgaggtgaccaccaacatccccaagatggaggccgccaccaaccaggaccaggacggcagaaccaccaacgacatcagcttcggcaccagcgccgtgacccccgacatccccctgagagccacctaccccagaaccgacttcgccctgcccaaccaggaggccaagaaggagaagaaggaccccaccggcagaaagaccaacctggacttccagcagtacgtgttcatcaaccagatgtgctaccacctggccctgccctggtacagcaagtacttcccctacctggccctgatccacaccatcatcctgatggtgagcagcaacttctggttcaagtacccctag

SEQ ID NO: 86730 - DNA, 369 bp, Artificial Sequence
  Description of Artificial Sequence: Synthetic coding sequence
atgttcaccctggccgaggtggccagcctgaacgacatccagcccacctacagaatcctgaagccctggtgggacgtgttcatggactacctggccgtggtgatgctgatggtggccatcttcgccggcaccatgcagctgaccaaggaccaggtggtgtgcctgcccgtgctgcccagccccgtgaacagcaaggcccacaccccccccggcaacgccgaggtgaccaccaacatccccaagatggaggccgccaccaaccaggaccaggacggcagaaccaccaacgacatcagcttcggcaccagcgccgtgacccccgacatccccctgagagccacctaccccagaaccgacttcgccctgtag

SEQ ID NO: 86731 - DNA, 2391 bp, Artificial Sequence
  Description of Artificial Sequence: Synthetic coding sequence
atgatccccgtggccgagttcaagcagttcaccgagcagcagcccgccttcaaggtgctgaagccctggtgggacgtgctggccgagtacctgaccgtggccatgctgatgatcggcgtgttcggctgcaccctgcaggtgacccaggacaagatcatctgcctgcccaaccacgagctgcaggagaacctgagcgaggccccctgccagcagctgctgcccagaggcatccccgagcagatcggcgccctgcaggaggtgaagggcctgaagaacaacctggacctgcagcagtacagcttcatcaaccagctgtgctacgagaccgccctgcactggtacgccaagtacttcccctacctggtggtgatccacaccctgatcttcatggtgtgcaccagcttctggttcaagttccccggcaccagcagcaagatcgagcacttcatcagcatcctgggcaagtgcttcgacagcccctggaccaccagagccctgagcgaggtgagcggcgagaaccagaagggccccgccgccaccgagagagccgccgccaccatcgtggccatggccggcaccggccccggcaaggccggcgagggcgagaaggagaaggtgctggccgagcccgagaaggtggtgaccgagccccccgtggtgaccctgctggacaagaaggagggcgagcaggccaaggccctgttcgagaaggtgaagaagttcagaatgcacgtggaggagggcgacatcctgtacaccatgtacatcagacagaccgtgctgaaggtgtgcaagttcctggccatcctggtgtacaacctggtgtacgtggagaagatcagcttcctggtggcctgcagagtggagaccagcgaggtgaccggctacgccagcttctgctgcaaccacaccaaggcccacctgttcagcaagctggccttctgctacatcagcttcgtgtgcatctacggcctgacctgcatctacaccctgtactggctgttccacagacccctgaaggagtacagcttcagaagcgtgagagaggagaccggcatgggcgacatccccgacgtgaagaacgacttcgccttcatgctgcacctgatcgaccagtacgacagcctgtacagcaagagattcgccgtgttcctgagcgaggtgagcgagagcagactgaagcagctgaacctgaaccacgagtggacccccgagaagctgagacagaagctgcagagaaacgccgccggcagactggagctggccctgtgcatgctgcccggcctgcccgacaccgtgttcgagctgagcgaggtggagagcctgagactggaggccatctgcgacatcaccttcccccccggcctgagccagctggtgcacctgcaggagctgagcctgctgcacagccccgccagactgcccttcagcctgcaggtgttcctgagagaccacctgaaggtgatgagagtgaagtgcgaggagctgagagaggtgcccctgtgggtgttcggcctgagaggcctggaggagctgcacctggagggcctgttcccccaggagctggccagagccgccaccctggagagcctgagagagctgaagcagctgaaggtgctgagcctgagaagcaacgccggcaaggtgcccgccagcgtgaccgacgtggccggccacctgcagagactgagcctgcacaacgacggcgccagactggtggccctgaacagcctgaagaagctggccgccctgagagagctggagctggtggcctgcggcctggagagaatcccccacgccgtgttcagcctgggcgccctgcaggagctggacctgaaggacaaccacctgagaagcatcgaggagatcctgagcttccagcactgcagaaagctggtgaccctgagactgtggcacaaccagatcgcctacgtgcccgagcacgtgagaaagctgagaagcctggagcagctgtacctgagctacaacaagctggagaccctgcccagccagctgggcctgtgcagcggcctgagactgctggacgtgagccacaacggcctgcacagcctgccccccgaggtgggcctgctgcagaacctgcagcacctggccctgagctacaacgccctggaggccctgcccgaggagctgttcttctgcagaaagctgagaaccctgctgctgggcgacaaccagctgagccagctgagcccccacgtgggcgccctgagagccctgagcagactggagctgaagggcaacagactggaggccctgcccgaggagctgggcaactgcggcggcctgaagaaggccggcctgctggtggaggacaccctgtaccagggcctgcccgccgaggtgagagacaagatggaggaggagtag

SEQ ID NO: 86732 - DNA, 1569 bp, Artificial Sequence
  Description of Artificial Sequence: Synthetic coding sequence
atggacttcctgctgctgggcctgtgcctgtactggctgctgagaagacccagcggcgtggtgctgtgcctgctgggcgcctgcttccagatgctgcccgccgcccccagcggctgcccccagctgtgcagatgcgagggcagactgctgtactgcgaggccctgaacctgaccgaggccccccacaacctgagcggcctgctgggcctgagcctgagatacaacagcctgagcgagctgagagccggccagttcaccggcctgatgcagctgacctggctgtacctggaccacaaccacatctgcagcgtgcagggcgacgccttccagaagctgagaagagtgaaggagctgaccctgagcagcaaccagatcacccagctgcccaacaccaccttcagacccatgcccaacctgagaagcgtggacctgagctacaacaagctgcaggccctggcccccgacctgttccacggcctgagaaagctgaccaccctgcacatgagagccaacgccatccagttcgtgcccgtgagaatcttccaggactgcagaagcctgaagttcctggacatcggctacaaccagctgaagagcctggccagaaacagcttcgccggcctgttcaagctgaccgagctgcacctggagcacaacgacctggtgaaggtgaacttcgcccacttccccagactgatcagcctgcacagcctgtgcctgagaagaaacaaggtggccatcgtggtgagcagcctggactgggtgtggaacctggagaagatggacctgagcggcaacgagatcgagtacatggagccccacgtgttcgagaccgtgccccacctgcagagcctgcagctggacagcaacagactgacctacatcgagcccagaatcctgaacagctggaagagcctgaccagcatcaccctggccggcaacctgtgggactgcggcagaaacgtgtgcgccctggccagctggctgaacaacttccagggcagatacgacggcaacctgcagtgcgccagccccgagtacgcccagggcgaggacgtgctggacgccgtgtacgccttccacctgtgcgaggacggcgccgagcccaccagcggccacctgctgagcgccgtgaccaacagaagcgacctgggcccccccgccagcagcgccaccaccctggccgacggcggcgagggccagcacgacggcaccttcgagcccgccaccgtggccctgcccggcggcgagcacgccgagaacgccgtgcagatccacaaggtggtgaccggcaccatggccctgatcttcagcttcctgatcgtggtgctggtgctgtacgtgagctggaagtgcttccccgccagcctgagacagctgagacagtgcttcgtgacccagagaagaaagcagaagcagaagcagaccatgcaccagatggccgccatgagcgcccaggagtactacgtggactacaagcccaaccacatcgagggcgccctggtgatcatcaacgagtacggcagctgcacctgccaccagcagcccgccagagagtgcgaggtgtag

SEQ ID NO: 86733 - DNA, 1569 bp, Artificial Sequence; identical to SEQ ID NO: 86732
  Description of Artificial Sequence: Synthetic coding sequence

SEQ ID NO: 86734 - DNA, 330 bp, Artificial Sequence
  Description of Artificial Sequence: Synthetic coding sequence
atggacttcctgctgctgggcctgtgcctgtactggctgctgagaagacccagcggcgtggtgctgtgcctgctgggcgcctgcttccagatgctgcccgccgcccccagcggctgcccccagctgtgcagatgcgagggcagactgctgtactgcgaggccctgaacctgaccgaggccccccacaacctgagcggcctgctgggcctgagcctgagatacaacagcctgagcgagctgagagccggccagttcaccggcctgatgcagctgacctggctgtacctggaccacaaccacatctgcagcgtgcagggcgacgccttctag

SEQ ID NO: 86735 - DNA, 672 bp, Artificial Sequence
  Description of Artificial Sequence: Synthetic coding sequence
atggacttcctgctgctgggcctgtgcctgtactggctgctgagaagacccagcggcgtggtgctgtgcctgctgggcgcctgcttccagatgctgcccgccgcccccagcggctgcccccagctgtgcagatgcgagggcagactgctgtactgcgaggccctgaacctgaccgaggccccccacaacctgagcggcctgctgggcctgagcctgagatacaacagcctgagcgagctgagagccggccagttcaccggcctgatgcagctgacctggctgtacctggaccacaaccacatctgcagcgtgcagggcgacgccttccagaagctgagaagagtgaaggagctgaccctgagcagcaaccagatcacccagctgcccaacaccaccttcagacccatgcccaacctgagaagcgtggacctgagctacaacaagctgcaggccctggcccccgacctgttccacggcctgagaaagctgaccaccctgcacatgagagccaacgccatccagttcgtgcccgtgagaatcttccaggactgcagaagcctgaagttcctggacatcggctacaaccagctgaagagcctggccagaaacagcttcgccggcctgttcaagctgaccgagctgcacctggagcacaacgacctggtgaagtag

SEQ ID NO: 86736 - DNA, 1569 bp, Artificial Sequence; identical to SEQ ID NO: 86732
  Description of Artificial Sequence: Synthetic coding sequence

SEQ ID NO: 86737 - DNA, 1569 bp, Artificial Sequence; identical to SEQ ID NO: 86732
  Description of Artificial Sequence: Synthetic coding sequence

SEQ ID NO: 86738 - DNA, 552 bp, Artificial Sequence
  Description of Artificial Sequence: Synthetic coding sequence
atggacttcctgctgctgggcctgtgcctgtactggctgctgagaagacccagcggcgtggtgctgtgcctgctgggcgcctgcttccagatgctgcccgccgcccccagcggctgcccccagctgtgcagatgcgagggcagactgctgtactgcgaggccctgaacctgaccgaggccccccacaacctgagcggcctgctgggcctgagcctgagatacaacagcctgagcgagctgagagccggccagttcaccggcctgatgcagctgacctggctgtacctggaccacaaccacatctgcagcgtgcagggcgacgccttccagaagctgagaagagtgaaggagctgaccctgagcagcaaccagatcacccagctgcccaacaccaccttcagacccatgcccaacctgagaagcgtggacctgagctacaacaagctgcaggccctggcccccgacctgttccacggcctgagaaagctgaccaccctgcacatgagagccaacgccatccagttcgtgcccgtgagaatcttccaggactag

SEQ ID NO: 86739 - DNA, 1551 bp, Artificial Sequence
  Description of Artificial Sequence: Synthetic coding sequence
atgggcctgcacttcaagtggcccctgggcgcccccatgctggccgccatctacgccatgagcatggtgctgaagatgctgcccgccctgggcatggcctgcccccccaagtgcagatgcgagaagctgctgttctactgcgacagccagggcttccacagcgtgcccaacgccaccgacaagggcagcctgggcctgagcctgagacacaaccacatcaccgagctggagagagaccagttcgccagcttcagccagctgacctggctgcacctggaccacaaccagatcagcaccgtgaaggaggacgccttccagggcctgtacaagctgaaggagctgatcctgagcagcaacaagatcttctacctgcccaacaccaccttcacccagctgatcaacctgcagaacctggacctgagcttcaaccagctgagcagcctgcaccccgagctgttctacggcctgagaaagctgcagaccctgcacctgagaagcaacagcctgagaaccatccccgtgagactgttctgggactgcagaagcctggagttcctggacctgagcaccaacagactgagaagcctggccagaaacggcttcgccggcctgatcaagctgagagagctgcacctggagcacaaccagctgaccaagatcaacttcgcccacttcctgagactgagcagcctgcacaccctgttcctgcagtggaacaagatcagcaacctgacctgcggcatggagtggacctggggcaccctggagaagctggacctgaccggcaacgagatcaaggccatcgacctgaccgtgttcgagaccatgcccaacctgaagatcctgctgatggacaacaacaagctgaacagcctggacagcaagatcctgaacagcctgagaagcctgaccaccgtgggcctgagcggcaacctgtgggagtgcagcgccagaatctgcgccctggccagctggctgggcagcttccagggcagatgggagcacagcatcctgtgccacagccccgaccacacccagggcgaggacatcctggacgccgtgcacggcttccagctgtgctggaacctgagcaccaccgtgaccgtgatggccaccacctacagagaccccaccaccgagtacaccaagagaatcagcagcagcagctaccacgtgggcgacaaggagatccccaccaccgccggcatcgccgtgaccaccgaggagcacttccccgagcccgacaacgccatcttcacccagagagtgatcaccggcaccatggccctgctgttcagcttcttcttcatcatcttcatcgtgttcatcagcagaaagtgctgcccccccaccctgagaagaatcagacagtgcagcatggtgcagaaccacagacagctgagaagccagaccagactgcacatgagcaacatgagcgaccagggcccctacaacgagtacgagcccacccacgagggccccttcatcatcatcaacggctacggccagtgcaagtgccagcagctgccctacaaggagtgcgaggtgtag

SEQ ID NO: 86740 - DNA, 1746 bp, Artificial Sequence
  Description of Artificial Sequence: Synthetic coding sequence
atgggcttcaacgtgatcagactgctgagcggcagcgccgtggccctggtgatcgcccccaccgtgctgctgaccatgctgagcagcgccgagagaggctgccccaagggctgcagatgcgagggcaagatggtgtactgcgagagccagaagctgcaggagatccccagcagcatcagcgccggctgcctgggcctgagcctgagatacaacagcctgcagaagctgaagtacaaccagttcaagggcctgaaccagctgacctggctgtacctggaccacaaccacatcagcaacatcgacgagaacgccttcaacggcatcagaagactgaaggagctgatcctgagcagcaacagaatcagctacttcctgaacaacaccttcagacccgtgaccaacctgagaaacctggacctgagctacaaccagctgcacagcctgggcagcgagcagttcagaggcctgagaaagctgctgagcctgcacctgagaagcaacagcctgagaaccatccccgtgagaatcttccaggactgcagaaacctggagctgctggacctgggctacaacagaatcagaagcctggccagaaacgtgttcgccggcatgatcagactgaaggagctgcacctggagcacaaccagttcagcaagctgaacctggccctgttccccagactggtgagcctgcagaacctgtacctgcagtggaacaagatcagcgtgatcggccagaccatgagctggacctggagcagcctgcagagactggacctgagcggcaacgagatcgaggccttcagcggccccagcgtgttccagtgcgtgcccaacctgcagagactgaacctggacagcaacaagctgaccttcatcggccaggagatcctggacagctggatcagcctgaacgacatcagcctggccggcaacatctgggagtgcagcagaaacatctgcagcctggtgaactggctgaagagcttcaagggcctgagagagaacaccatcatctgcgccagccccaaggagctgcagggcgtgaacgtgatcgacgccgtgaagaactacagcatctgcggcaagagcaccaccgagagattcgacctggccagagccctgcccaagcccaccttcaagcccaagctgcccagacccaagcacgagagcaagccccccctgccccccaccgtgggcgccaccgagcccggccccgagaccgacgccgacgccgagcacatcagcttccacaagatcatcgccggcagcgtggccctgttcctgagcgtgctggtgatcctgctggtgatctacgtgagctggaagagataccccgccagcatgaagcagctgcagcagagaagcctgatgagaagacacagaaagaagaagagacagagcctgaagcagatgacccccagcacccaggagttctacgtggactacaagcccaccaacaccgagaccagcgagatgctgctgaacggcaccggcccctgcacctacaacaagagcggcagcagagagtgcgagatccccctgagcatgaacgtgagcaccttcctggcctacgaccagcccaccatcagctactgcggcgtgcaccacgagctgctgagccacaagagcttcgagaccaacgcccaggaggacaccatggagacccacctggagaccgagctggacctgagcaccatcaccaccgccggcagaatcagcgaccacaagcagcagctggcctag

SEQ ID NO: 86741 - DNA, 1746 bp, Artificial Sequence; identical to SEQ ID NO: 86740
  Description of Artificial Sequence: Synthetic coding sequence

SEQ ID NO: 86742 - DNA, 1557 bp, Artificial Sequence
  Description of Artificial Sequence: Synthetic coding sequence
atgggcttccacctgatcacccagctgaagggcatgagcgtggtgctggtgctgctgcccaccctgctgctggtgatgctgaccggcgcccagagagcctgccccaagaactgcagatgcgacggcaagatcgtgtactgcgagagccacgccttcgccgacatccccgagaacatcagcggcggcagccagggcctgagcctgagattcaacagcatccagaagctgaagagcaaccagttcgccggcctgaaccagctgatctggctgtacctggaccacaactacatcagcagcgtggacgaggacgccttccagggcatcagaagactgaaggagctgatcctgagcagcaacaagatcacctacctgcacaacaagaccttccaccccgtgcccaacctgagaaacctggacctgagctacaacaagctgcagaccctgcagagcgagcagttcaagggcctgagaaagctgatcatcctgcacctgagaagcaacagcctgaagaccgtgcccatcagagtgttccaggactgcagaaacctggacttcctggacctgggctacaacagactgagaagcctgagcagaaacgccttcgccggcctgctgaagctgaaggagctgcacctggagcacaaccagttcagcaagatcaacttcgcccacttccccagactgttcaacctgagaagcatctacctgcagtggaacagaatcagaagcatcagccagggcctgacctggacctggagcagcctgcacaacctggacctgagcggcaacgacatccagggcatcgagcccggcaccttcaagtgcctgcccaacctgcagaagctgaacctggacagcaacaagctgaccaacatcagccaggagaccgtgaacgcctggatcagcctgatcagcatcaccctgagcggcaacatgtgggagtgcagcagaagcatctgccccctgttctactggctgaagaacttcaagggcaacaaggagagcaccatgatctgcgccggccccaagcacatccagggcgagaaggtgagcgacgccgtggagacctacaacatctgcagcgaggtgcaggtggtgaacaccgagagaagccacctggtgccccagaccccccagaagcccctgatcatccccagacccaccatcttcaagcccgacgtgacccagagcaccttcgagacccccagccccagccccggcttccagatccccggcgccgagcaggagtacgagcacgtgagcttccacaagatcatcgccggcagcgtggccctgttcctgagcgtggccatgatcctgctggtgatctacgtgagctggaagagataccccgccagcatgaagcagctgcagcagcacagcctgatgaagagaagaagaaagaaggccagagagagcgagagacagatgaacagccccctgcaggagtactacgtggactacaagcccaccaacagcgagaccatggacatcagcgtgaacggcagcggcccctgcacctacaccatcagcggcagcagagagtgcgaggtgtag

SEQ ID NO: 86743 - DNA, 1773 bp, Artificial Sequence
  Description of Artificial Sequence: Synthetic coding sequence
atgggcttccacctgatcacccagctgaagggcatgagcgtggtgctggtgctgctgcccaccctgctgctggtgatgctgaccggcgcccagagagcctgccccaagaactgcagatgcgacggcaagatcgtgtactgcgagagccacgccttcgccgacatccccgagaacatcagcggcggcagccagggcctgagcctgagattcaacagcatccagaagctgaagagcaaccagttcgccggcctgaaccagctgatctggctgtacctggaccacaactacatcagcagcgtggacgaggacgccttccagggcatcagaagactgaaggagctgatcctgagcagcaacaagatcacctacctgcacaacaagaccttccaccccgtgcccaacctgagaaacctggacctgagctacaacaagctgcagaccctgcagagcgagcagttcaagggcctgagaaagctgatcatcctgcacctgagaagcaacagcctgaagaccgtgcccatcagagtgttccaggactgcagaaacctggacttcctggacctgggctacaacagactgagaagcctgagcagaaacgccttcgccggcctgctgaagctgaaggagctgcacctggagcacaaccagttcagcaagatcaacttcgcccacttccccagactgttcaacctgagaagcatctacctgcagtggaacagaatcagaagcatcagccagggcctgacctggacctggagcagcctgcacaacctggacctgagcggcaacgacatccagggcatcgagcccggcaccttcaagtgcctgcccaacctgcagaagctgaacctggacagcaacaagctgaccaacatcagccaggagaccgtgaacgcctggatcagcctgatcagcatcaccctgagcggcaacatgtgggagtgcagcagaagcatctgccccctgttctactggctgaagaacttcaagggcaacaaggagagcaccatgatctgcgccggccccaagcacatccagggcgagaaggtgagcgacgccgtggagacctacaacatctgcagcgaggtgcaggtggtgaacaccgagagaagccacctggtgccccagaccccccagaagcccctgatcatccccagacccaccatcttcaagcccgacgtgacccagagcaccttcgagacccccagccccagccccggcttccagatccccggcgccgagcaggagtacgagcacgtgagcttccacaagatcatcgccggcagcgtggccctgttcctgagcgtggccatgatcctgctggtgatctacgtgagctggaagagataccccgccagcatgaagcagctgcagcagcacagcctgatgaagagaagaagaaagaaggccagagagagcgagagacagatgaacagccccctgcaggagtactacgtggactacaagcccaccaacagcgagaccatggacatcagcgtgaacggcagcggcccctgcacctacaccatcagcggcagcagagagtgcgagatgccccaccacatgaagcccctgccctactacagctacgaccagcccgtgatcggctactgccaggcccaccagcccctgcacgtgaccaagggctacgagaccgtgagccccgagcaggacgagagccccggcctggagctgggcagagaccacagcttcatcgccaccatcgccagaagcgccgcccccgccatctacctggagagaatcgccaactag

SEQ ID NO: 86744 - DNA, 1773 bp, Artificial Sequence; identical to SEQ ID NO: 86743
  Description of Artificial Sequence: Synthetic coding sequence

SEQ ID NO: 86745 - DNA, 1776 bp, Artificial Sequence
  Description of Artificial Sequence: Synthetic coding sequence
atgcccggcttccacctgatcacccagctgaagggcatgagcgtggtgctggtgctgctgcccaccctgctgctggtgatgctgaccggcgcccagagagcctgccccaagaactgcagatgcgacggcaagatcgtgtactgcgagagccacgccttcgccgacatccccgagaacatcagcggcggcagccagggcctgagcctgagattcaacagcatccagaagctgaagagcaaccagttcgccggcctgaaccagctgatctggctgtacctggaccacaactacatcagcagcgtggacgaggacgccttccagggcatcagaagactgaaggagctgatcctgagcagcaacaagatcacctacctgcacaacaagaccttccaccccgtgcccaacctgagaaacctggacctgagctacaacaagctgcagaccctgcagagcgagcagttcaagggcctgagaaagctgatcatcctgcacctgagaagcaacagcctgaagaccgtgcccatcagagtgttccaggactgcagaaacctggacttcctggacctgggctacaacagactgagaagcctgagcagaaacgccttcgccggcctgctgaagctgaaggagctgcacctggagcacaaccagttcagcaagatcaacttcgcccacttccccagactgttcaacctgagaagcatctacctgcagtggaacagaatcagaagcatcagccagggcctgacctggacctggagcagcctgcacaacctggacctgagcggcaacgacatccagggcatcgagcccggcaccttcaagtgcctgcccaacctgcagaagctgaacctggacagcaacaagctgaccaacatcagccaggagaccgtgaacgcctggatcagcctgatcagcatcaccctgagcggcaacatgtgggagtgcagcagaagcatctgccccctgttctactggctgaagaacttcaagggcaacaaggagagcaccatgatctgcgccggccccaagcacatccagggcgagaaggtgagcgacgccgtggagacctacaacatctgcagcgaggtgcaggtggtgaacaccgagagaagccacctggtgccccagaccccccagaagcccctgatcatccccagacccaccatcttcaagcccgacgtgacccagagcaccttcgagacccccagccccagccccggcttccagatccccggcgccgagcaggagtacgagcacgtgagcttccacaagatcatcgccggcagcgtggccctgttcctgagcgtggccatgatcctgctggtgatctacgtgagctggaagagataccccgccagcatgaagcagctgcagcagcacagcctgatgaagagaagaagaaagaaggccagagagagcgagagacagatgaacagccccctgcaggagtactacgtggactacaagcccaccaacagcgagaccatggacatcagcgtgaacggcagcggcccctgcacctacaccatcagcggcagcagagagtgcgagatgccccaccacatgaagcccctgccctactacagctacgaccagcccgtgatcggctactgccaggcccaccagcccctgcacgtgaccaagggctacgagaccgtgagccccgagcaggacgagagccccggcctggagctgggcagagaccacagcttcatcgccaccatcgccagaagcgccgcccccgccatctacctggagagaatcgccaactag

SEQ ID NO: 86746 - DNA, 579 bp, Artificial Sequence
  Description of Artificial Sequence: Synthetic coding sequence
atgaacaagagagactacatgaacaccagcgtgcaggagccccccctggactacagcttcagaagcatccacgtgatccaggacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgaccagcatcgaccccgtgctgaccaccttcttcaacctgagcgtgctgtacctgcacggcaacagcatccagagactgggcgaggtgaacaagctggccgtgctgcccagactgagaagcctgaccctgcacggcaaccccatggaggaggagaagggctacagacagtacgtgctgtgcaccctgagcagaatcaccaccttcgacttcagcggcgtgaccaaggccgacagaaccaccgccgaggtgtggaagagaatgaacatcaagcccaagaaggcctggaccaagcagaacaccctgtag

SEQ ID NO: 86747 - DNA, 876 bp, Artificial Sequence
  Description of Artificial Sequence: Synthetic coding sequence
atgggcaccccctggagaaagagaaagggcatcgccggccccggcctgcccgacctgagctgcgccctggtgctgcagcccagagcccaggtgggcaccatgagccccgccatcgccctggccttcctgcccctggtggtgaccctgctggtgagatacagacactacttcagactgctggtgagaaccgtgctgctgagaagcctgagagactgcctgagcggcctgagaatcgaggagagagccttcagctacgtgctgacccacgccctgcccggcgaccccggccacatcctgaccaccctggaccactggagcagcagatgcgagtacctgagccacatgggccccgtgaagggccagatcctgatgagactggtggaggagaaggcccccgcctgcgtgctggagctgggcacctactgcggctacagcaccctgctgatcgccagagccctgccccccggcggcagactgctgaccgtggagagagaccccagaaccgccgccgtggccgagaagctgatcagactggccggcttcgacgagcacatggtggagctgatcgtgggcagcagcgaggacgtgatcccctgcctgagaacccagtaccagctgagcagagccgacctggtgctgctggcccacagacccagatgctacctgagagacctgcagctgctggaggcccacgccctgctgcccgccggcgccaccgtgctggccgaccacgtgctgttccccggcgcccccagattcctgcagtacgccaagagctgcggcagatacagatgcagactgcaccacaccggcctgcccgacttccccgccatcaaggacggcatcgcccagctgacctacgccggccccggctag

SEQ ID NO: 86748 - DNA, 441 bp, Artificial Sequence
  Description of Artificial Sequence: Synthetic coding sequence
atgaacaagagagactacatgaacaccagcgtgcaggagccccccctggactacagcttcagaagcatccacgtgatccaggacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgaccagcatcgaccccgtgctgaccaccttcttcaacctgagcgtgctgtacctgcacggcaacagcatccagagactgggcgaggtgaacaagctggccgtgctgcccagactgagaagcctgaccctgcacggcaaccccatggaggaggagaagggctacagatag

SEQ ID NO: 86749 - DNA, 756 bp, Artificial Sequence
  Description of Artificial Sequence: Synthetic coding sequence
atgggcaccccctggagaaagagaaagggcatcgccggccccggcctgcccgacctgagctgcgccctggtgctgcagcccagcctgagagactgcctgagcggcctgagaatcgaggagagagccttcagctacgtgctgacccacgccctgcccggcgaccccggccacatcctgaccaccctggaccactggagcagcagatgcgagtacctgagccacatgggccccgtgaagggccagatcctgatgagactggtggaggagaaggcccccgcctgcgtgctggagctgggcacctactgcggctacagcaccctgctgatcgccagagccctgccccccggcggcagactgctgaccgtggagagagaccccagaaccgccgccgtggccgagaagctgatcagactggccggcttcgacgagcacatggtggagctgatcgtgggcagcagcgaggacgtgatcccctgcctgagaacccagtaccagctgagcagagccgacctggtgctgctggcccacagacccagatgctacctgagagacctgcagctgctggaggcccacgccctgctgcccgccggcgccaccgtgctggccgaccacgtgctgttccccggcgcccccagattcctgcagtacgccaagagctgcggcagatacagatgcagactgcaccacaccggcctgcccgacttccccgccatcaaggacggcatcgcccagctgacctacgccggccccggctag

SEQ ID NO: 86750 - DNA, 876 bp, Artificial Sequence; identical to SEQ ID NO: 86747
  Description of Artificial Sequence: Synthetic coding sequence

SEQ ID NO: 86751 - DNA, 477 bp, Artificial Sequence
  Description of Artificial Sequence: Synthetic coding sequence
atgaacaagagagactacatgaacaccagcgtgcaggagccccccctggactacagcttcagaagcatccacgtgatccaggacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgaccagcatcgaccccgtgctgaccaccttcttcaacctgagcgtgctgtacctgcacggcaacagcatccagagactgggcgaggtgaacaagctggccgtgctgcccagactgagaagcctgaccctgcacggcaaccccatggaggaggagaagggctacagagtgcccggcagcgtggagatgccccacagacccccctag

SEQ ID NO: 86752 - DNA, 279 bp, Artificial Sequence
  Description of Artificial Sequence: Synthetic coding sequence
atgaacaagagagactacatgaacaccagcgtgcaggagccccccctggactacagcttcagaagcatccacgtgatccaggacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgacctag

SEQ ID NO: 86753 - DNA, 579 bp, Artificial Sequence; identical to SEQ ID NO: 86746
  Description of Artificial Sequence: Synthetic coding sequence

SEQ ID NO: 86754 - DNA, 477 bp, Artificial Sequence; identical to SEQ ID NO: 86751
  Description of Artificial Sequence: Synthetic coding sequence

SEQ ID NO: 86755 - DNA, 315 bp, Artificial Sequence
  Description of Artificial Sequence: Synthetic coding sequence
atgaacaagagagactacatgaacaccagcgtgcaggagccccccctggactacagcttcagaagcatccacgtgatccaggacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgaccagcatcgaccccgtgctgaccaccttcttcaacctgtag

SEQ ID NO: 86756 - DNA, 525 bp, Artificial Sequence
  Description of Artificial Sequence: Synthetic coding sequence
atggtggagttccagcccagcgtgaccgacctggtgaacgaggagcccagaaccggcctgagacccctgaagagaagcaagagcggcaagagcctgacccagagcctgtggctgaacaacaacgtgctgaacgacctgagagacttcaaccaggtggccagccagctgctggagcaccccgagaacctggcctggatcgacctgagcttcaacgacctgaccagcatcgaccccgtgctgaccaccttcttcaacctgagcgtgctgtacctgcacggcaacagcatccagagactgggcgaggtgaacaagctggccgtgctgcccagactgagaagcctgaccctgcacggcaaccccatggaggaggagaagggctacagacagtacgtgctgtgcaccctgagcagaatcaccaccttcgacttcagcggcgtgaccaaggccgacagaaccaccgccgaggtgtggaagagaatgaacatcaagcccaagaaggcctggaccaagcagaacaccctgtag

SEQ ID NO: 86757 - DNA, 3231 bp, Artificial Sequence
  Description of Artificial Sequence: Synthetic coding sequence
atggccgagttcaccagctacaaggagaccgccagcagcagacacctgagattcaagctgcagagcctgagcagaagactggacgagctggaggaggccaccaagaacctgcagaaggccgaggacgagctgctggacctgcaggacaaggtgatccaggccgagggcagcaacagcagcatgctggccgagatcgaggtgctgagacagagagtgctgagaatcgagggcaaggacgaggagatcaagagagccgaggacctgtgcagactgatgaaggagaagctggaggaggaggagaacctgaccagagagctgaagagcgagatcgagagactgcagaagagaatggccgagctggagaagctggaggaggccttcagcagaagcaagaacgactgcacccagctgtgcctgagcctgaacgaggagagaaacctgaccaagaagatcagcagcgagctggagatgctgagagtgaaggtgaaggagctggagagcagcgaggacagactggacaagaccgagcagagcctggccagcgagctggagaagctgaagagcctgaccctgagcttcgtgagcgagagaaagtacctgaacgagaaggagaaggagaacgagaagctgatcaaggagctgacccagaagctggagcagaacaagaagatgaacagagactacaccagaaacgccagcaacctggagagaaacgacctgagaatcgaggacggcatcagcagcaccctgcccagcaaggagagcagaagaaagggcggcctggactacctgaagcaggtggagaacgagaccagaaacaagagcgagaacgagaagaacagaaaccaggaggacaacaaggtgaaggacctgaaccaggagatcgagaagctgaagacccagatcaagcacttcgagagcctggaggaggagctgaagaagatgaagagcaagaacaacgacctgcaggacaactacctgagcgagcagaacaagaacaagctgctggccagccagctggaggagatcaagctgcagatcaagaagcagaaggagctggagaacggcgaggtggagggcgaggacgccttcctgagcagcaagggcagacacgagagaaccaagttcagaggccacggcagcgaggccagcgtgagcaagcacaccgccagagagctgagcccccagcacaagagagagagactgagaaacagagagttcgccctgaacaacgagaactacagcctgagcaacagacaggtgagcagccccagcttcaccaacagaagagccgccaaggccagccacatgggcgtgagcaccgacagcggcacccaggagaccaagaagaccgaggacagattcgtgcccggcagcagccagagcgagggcaagaagagcagagagcagcccagcgtgctgagcagatacccccccgccgcccaggagcacagcaaggcctggaagggcaccagcaagcccggcaccgagagcggcctgaagggcaaggtggagaagaccaccagaaccttcagcgacaccacccacggcagcgtgcccagcgaccccctgggcagagccgacaaggccagcgacaccagcagcgagaccgtgttcggcaagagaggccacgtgctgggcaacggcagccaggtgacccaggccgccaacagcggctgcagcaaggccatcggcgccctggccagcagcagaagaagcagcagcgagggcctgagcaagggcaagaaggccgccaacggcctggaggccgacaacagctgccccaacagcaaggcccccgtgctgagcaagtacccctacagctgcagaagccaggagaacatcctgcagggcttcagcaccagccacaaggagggcgtgaaccagcccgccgccgtggtgatggaggacagcagcccccacgaggccctgagatgcagagtgatcaagagcagcggcagagagaagcccgacagcgacgacgacctggacatcgccagcctggtgaccgccaagctggtgaacaccaccatcacccccgagcccgagcccaagccccagcccaacagcagagagaaggccaagaccagaggcgcccccagaaccagcctgttcgagaacgacaaggacgccggcatggagaacgagagcgtgaagagcgtgagagccagcaccaacaccatggagctgcccgacaccaacggcgccggcgtgaagagccagagacccttcagccccagagaggccctgagaagcagagccatcatcaagcccgtgatcgtggacaaggacgtgaagaagatcatgggcggcagcggcaccgagaccaccctggagaagcagaagcccgtgagcaagcccggccccaacaaggtgaccagcagcatcaccatctaccccagcgacagcagcagccccagagccgcccccggcgaggccctgagagagagacacaccagcaccagcaacatccaggtgggcctggccgagctgaccagcgtgagcaaccacgtgagcagccccttcgagctgagcatccacaagcacgacatcaccctgcagctggccgaggccgagagaatggccgacggccccctgaaggacagacccgagaccgtggtgagcagaagcagcatcatcatcaagcccagcgaccccgtggagagaaacagccacgccccccccgccgagaccatcagatggaagagccacagcgcccccagcgaggtgggcttcagcgacgccagacacgtgaccgtgagaaacgcctggaagagcagaagagacctgaagagcctggaggacccccccaccagaatcggcaagaacgtggagagcaccaacagcaacgcctacacccagagaagcagcaccgacttcagcgagctggagcagcccagaagctgcctgttcgagcagggcaccagaagagtgggccccagcagcggcgacgcccccgagcccagcagcagaagaacccagagcagcctgaccgtgagcgaggtgctgaccagaagaaacagagtgggcgacaccatcaccgtggccgcctggaaccacagcgccagcatggaggaggagggcgaggactgcaccctgagcgtgtacagacagctgcacaacagcctggaccccagcgagctgcccggcaagcagggcctgcccgagagcggcagagtgagagccgaggagagactgagacccaccagaccctgcgccgaggagaactag

SEQ ID NO: 86758 - DNA, 3081 bp, Artificial Sequence
  Description of Artificial Sequence: Synthetic coding sequence
atggccgagttcaccagctacaaggagaccgccagcagcagacacctgagattcaagctgcagagcctgagcagaagactggacgagctggaggaggccaccaagaacctgcagaaggccgaggacgagctgctggacctgcaggacaaggtgatccaggccgagggcagcaacagcagcatgctggccgagatcgaggtgctgagacagagagtgctgagaatcgagggcaaggacgaggagatcaagagagccgaggacctgtgcagactgatgaaggagaagctggaggaggaggagaacctgaccagagagctgaagagcgagatcgagagactgcagaagagaatggccgagctggagaagctggaggaggccttcagcagaagcaagaacgactgcacccagctgtgcctgagcctgaacgaggagagaaacctgaccaagaagatcagcagcgagctggagatgctgagagtgaaggtgaaggagctggagagcagcgaggacagactggacaagaccgagcagagcctggccagcgagctggagaagctgaagagcctgaccctgagcttcgtgagcgagagaaagtacctgaacgagaaggagaaggagaacgagaagctgatcaaggagctgacccagaagctggagcagaacaagaagatgaacagagactacaccagaaacgccagcaacctggagagaaacgacctgagaatcgaggacggcatcagcagcaccctgcccagcaaggagagcagaagaaagggcggcctggactacctgaagcaggtggagaacgagaccagaaacaagagcgagaacgagaagaacagaaaccaggaggacaacaaggtgaaggacctgaaccaggagatcgagaagctgaagacccagatcaagcacttcgagagcctggaggaggagctgaagaagatgaagagcaagaacaacgacctgcaggacaactacctgagcgagcagaacaagaacaagctgctggccagccagctggaggagatcaagctgcagatcaagaagcagaaggagctggagaacggcgaggtggagggcgaggacgccttcctgagcagcaagggcagacacgagagaaccaagttcagaggccacggcagcgaggccagcgtgagcaagcacaccgccagagagctgagcccccagcacaagagagagagactgagaaacagagagttcgccctgaacaacgagaactacagcctgagcaacagacaggtgagcagccccagcttcaccaacagaagagccgccaaggccagccacatgggcgtgagcaccgacagcggcacccaggagaccaagaagaccgaggacagattcgtgcccggcagcagccagagcgagggcaagaagagcagagagcagcccagcgtgctgagcagatacccccccgccgcccaggagcacagcaaggcctggaagggcaccagcaagcccggcaccgagagcggcctgaagggcaaggtggagaagaccaccagaaccttcagcgacaccacccacggcagcgtgcccagcgaccccctgggcagagccgacaaggccagcgacaccagcagcgagaccgtgttcggcaagagaggccacgtgctgggcaacggcagccaggtgacccaggccgccaacagcggctgcagcaaggccatcggcgccctggccagcagcagaagaagcagcagcgagggcctgagcaagggcaagaaggccgccaacggcctggaggccgacaacagctgccccaacagcaaggcccccgtgctgagcaagtacccctacagctgcagaagccaggagaacatcctgcagggcttcagcaccagccacaaggagggcgtgaaccagcccgccgccgtggtgatggaggacagcagcccccacgaggccctgagatgcagagtgatcaagagcagcggcagagagaagcccgacagcgacgacgacctggacatcgccagcctggtgaccgccaagctggtgaacaccaccatcacccccgagcccgagcccaagccccagcccaacagcagagagaaggccaagaccagaggcgcccccagaaccagcctgttcgagaacgacaaggacgccggcatggagaacgagagcgtgaagagcgtgagagccagcaccaacaccatggagctgcccgacaccaacggcgccggcgtgaagagccagagacccttcagccccagagaggccctgagaagcagagccatcatcaagcccgtgatcgtggacaaggacgtgaagaagatcatgggcggcagcggcaccgagaccaccctggagaagcagaagcccgtgagcaagcccggccccaacaaggtgaccagcagcatcaccatctaccccagcgacagcagcagccccagagccgcccccggcgaggccctgagagagagacacaccagcaccagcaacatccaggtgggcctggccgagctgaccagcgtgagcaaccacgtgagcagccccttcgagctgagcatccacaagcacgacatcaccctgcagctggccgaggccgagagaatggccgacggccccctgaaggacagacccgagaccgtggtgagcagaagcagcatcatcatcaagcccagcgaccccgtggagagaaacagccacgccccccccgccgagaccatcagatggaagagccacagcgcccccagcgaggtgggcttcagcgacgccagacacgtgaccgtgagaaacgcctggaagagcagaagagacctgaagagcctggaggacccccccaccagaatcggcaagaacgtggagagcaccaacagcaacgcctacacccagagaagcagcaccgacttcagcgagctggagcagcccagaagctgcctgttcgagcagggcaccagaagagtgggccccagcagcggcgacgcccccgagcccagcagcagaagaacccagagcagcctgaccgtgagcgaggtgctgaccagaagaaacagagtgggcgacaccatcaccgtggccgcctggaaccacagcgccagcatgagcagctag

SEQ ID NO: 86759 - DNA, 3231 bp, Artificial Sequence; identical to SEQ ID NO: 86757
  Description of Artificial Sequence: Synthetic coding sequence

SEQ ID NO: 86760 - DNA, 3231 bp, Artificial Sequence; identical to SEQ ID NO: 86757
  Description of Artificial Sequence: Synthetic coding sequence

SEQ ID NO: 86761 - DNA, 822 bp, Artificial Sequence
  Description of Artificial Sequence: Synthetic coding sequence
atggccgagttcaccagctacaaggagaccgccagcagcagacacctgagattcaagctgcagagcctgagcagaagactggacgagctggaggaggccaccaagaacctgcagaaggccgaggacgagctgctggacctgcaggacaaggtgatccaggccgagggcagcaacagcagcatgctggccgagatcgaggtgctgagacagagagtgctgagaatcgagggcaaggacgaggagatcaagagagccgaggacctgtgcagactgatgaaggagaagctggaggaggaggagaacctgaccagagagctgaagagcgagatcgagagactgcagaagagaatggccgagctggagaagctggaggaggccttcagcagaagcaagaacgactgcacccagctgtgcctgagcctgaacgaggagagaaacctgaccaagaagatcagcagcgagctggagatgctgagagtgaaggtgaaggagctggagagcagcgaggacagactggacaagaccgagcagagcctggccagcgagctggagaagctgaagagcctgaccctgagcttcgtgagcgagagaaagtacctgaacgagaaggagaaggagaacgagaagctgatcaaggagctgacccagaagctggagcagaacaagaagatgaacagagactacaccagaaacgccagcaacctggagagaaacgacctgagaatcgaggacggcatcagcagcaccctgcccagcaaggagagcagaagaaagggcggcctggactacctgaagcaggtggagaacgagaccagaaactag

SEQ ID NO: 86762 - DNA, 108 bp, Artificial Sequence
  Description of Artificial Sequence: Synthetic coding sequence
atggccgagttcaccagctacaaggagaccgccagcagcagacacctgagattcaagctgcagagcctgagcagaagactggacgagctggaggaggccaccaagtag

SEQ ID NO: 86763 - DNA, 1041 bp, Artificial Sequence
  Description of Artificial Sequence: Synthetic coding sequence
atgaagttcagccccgcccactacctgctgcccctgctgcccgccctggtgctgagcaccagacaggactacgaggagctggagaagcagctgaaggaggtgttcaaggagagaagcaccatcctgagacagctgaccaagaccagcagagagctggacggcatcaaggtgaacctgcagagcctgaagaacgacgagcagagcgccaagaccgacgtgcagaagctgctggagctgggccagaagcagagagaggagatgaagagcctgcaggaggccctgcagaaccagctgaaggagaccagcgagaaggccgagaagcaccaggccaccatcaacttcctgaagaccgaggtggagagaaagagcaagatgatcagagacctgcagaacgagaacaagagcctgaagaacaagctgctgagcggcaacaagctgtgcggcatccacgccgaggagagcaagaagatccaggcccagctgaaggagctgagatacggcaagaaggacctgctgttcaaggcccagcagctgaccgacctggagcagaagctggccgtggccaagaacgagctggagaaggccgccctggacagagagagccagatgaaggccatgaaggagaccgtgcagctgtgcctgaccagcgtgttcagagaccagccccccccccccctgagcctgatcaccagcaaccccaccagaatgctgctgccccccagaaacatcgccagcaagctgcccgacgccgccgccaagagcaagccccagcagagcgccagcggcaacaacgagagcagccaggtggagagcaccaaggagggcaaccccagcaccaccgcctgcgacagccaggacgagggcagaccctgcagcatgaagcacaaggagagcccccccagcaacgccaccgccgagaccgagcccatcccccagaagctgcagatgcccccctgcagcgagtgcgaggtgaagaaggcccccgagaagcccctgaccagcttcgagggcatggccgccagagaggagaagatcctgtag

SEQ ID NO: 86764 - DNA, 783 bp, Artificial Sequence
  Description of Artificial Sequence: Synthetic coding sequence
atgaagagcctgcaggaggccctgcagaaccagctgaaggagaccagcgagaaggccgagaagcaccaggccaccatcaacttcctgaagaccgaggtggagagaaagagcaagatgatcagagacctgcagaacgagaacaagagcctgaagaacaagctgctgagcggcaacaagctgtgcggcatccacgccgaggagagcaagaagatccaggcccagctgaaggagctgagatacggcaagaaggacctgctgttcaaggcccagcagctgaccgacctggagcagaagctggccgtggccaagaacgagctggagaaggccgccctggacagagagagccagatgaaggccatgaaggagaccgtgcagctgtgcctgaccagcgtgttcagagaccagccccccccccccctgagcctgatcaccagcaaccccaccagaatgctgctgccccccagaaacatcgccagcaagctgcccgacgccgccgccaagagcaagccccagcagagcgccagcggcaacaacgagagcagccaggtggagagcaccaaggagggcaaccccagcaccaccgcctgcgacagccaggacgagggcagaccctgcagcatgaagcacaaggagagcccccccagcaacgccaccgccgagaccgagcccatcccccagaagctgcagatgcccccctgcagcgagtgcgaggtgaagaaggcccccgagaagcccctgaccagcttcgagggcatggccgccagagaggagaagatcctgtag

SEQ ID NO: 86765 - DNA, 900 bp, Artificial Sequence
  Description of Artificial Sequence: Synthetic coding sequence
atggccgagctgggcctgaacgagcaccaccagaacgaggtgatcaactacatgagattcgccagaagcaagagaggcctgagactgaagaccgtggacagctgcttccaggacctgaaggagagcagactggtggaggacaccttcaccatcgacgaggtgagcgaggtgctgaacggcctgcaggccgtggtgcacagcgaggtggagagcgagctgatcaacaccgcctacaccaacgtgctgctgctgagacagctgttcgcccaggccgagaagtggtacctgaagctgcagaccgacatcagcgagctggagaacagagagctgctggagcaggtggccgagttcgagaaggccgagatcaccagcagcaacaagaagcccatcctggacgtgaccaagcccaagctggcccccctgaacgagggcggcaccgccgagctgctgaacaaggagatcctgagactgcaggaggagaacgagaagctgaagagcagactgaagaccatcgagatccaggccaccaacgccctggacgagaagagcaagctggagaaggccctgcaggacctgcagctggaccagggcaaccagaaggacttcatcaaggcccaggacctgagcaacctggagaacaccgtggccgccctgaagagcgagttccagaagaccctgaacgacaagaccgagaaccagaagagcctggaggagaacctggccaccgccaagcacgacctgctgagagtgcaggagcagctgcacatggccgagaaggagctggagaagaagttccagcagaccgccgcctacagaaacatgaaggagatcctgaccaagaagaacgaccagatcaaggacctgagaaagagactggcccagtacgagcccgaggactag

SEQ ID NO: 86766 - DNA, 849 bp, Artificial Sequence
  Description of Artificial Sequence: Synthetic coding sequence
atgagattcgccagaagcaagagaggcctgagactgaagaccgtggacagctgcttccaggacctgaaggagagcagactggtggaggacaccttcaccatcgacgaggtgagcgaggtgctgaacggcctgcaggccgtggtgcacagcgaggtggagagcgagctgatcaacaccgcctacaccaacgtgctgctgctgagacagctgttcgcccaggccgagaagtggtacctgaagctgcagaccgacatcagcgagctggagaacagagagctgctggagcaggtggccgagttcgagaaggccgagatcaccagcagcaacaagaagcccatcctggacgtgaccaagcccaagctggcccccctgaacgagggcggcaccgccgagctgctgaacaaggagatcctgagactgcaggaggagaacgagaagctgaagagcagactgaagaccatcgagatccaggccaccaacgccctggacgagaagagcaagctggagaaggccctgcaggacctgcagctggaccagggcaaccagaaggacttcatcaaggcccaggacctgagcaacctggagaacaccgtggccgccctgaagagcgagttccagaagaccctgaacgacaagaccgagaaccagaagagcctggaggagaacctggccaccgccaagcacgacctgctgagagtgcaggagcagctgcacatggccgagaaggagctggagaagaagttccagcagaccgccgcctacagaaacatgaaggagatcctgaccaagaagaacgaccagatcaaggacctgagaaagagactggcccagtacgagcccgaggactag

SEQ ID NO: 86767 - DNA, 771 bp, Artificial Sequence
  Description of Artificial Sequence: Synthetic coding sequence
atgagaaaccaggaccccggcaagatgggcagacagagaaagagcatcaagctgtaccccacccaccccctggtgaccttccccagaagctgggccaagttccaggagaaggccctgctggtggaggacaccttcaccatcgacgaggtgagcgaggtgctgaacggcctgcaggccgtggtgcacagcgaggtggagagcgagctgatcaacaccgcctacaccaacgtgctgctgctgagacagctgttcgcccaggccgagaagtggtacctgaagctgcagaccgacatcagcgagctggagaacagagagctgctggagcaggtggccgagttcgagaaggccgagatcaccagcagcaacaagaagcccatcctggacgtgaccaagcccaagctggcccccctgaacgagggcggcaccgccgagctgctgaacaaggagatcctgagactgcaggaggagaacgagaagctgaagagcagactgaagaccatcgagatccaggccaccaacgccctggacgagaagagcaagctggagaaggccctgcaggacctgcagctggaccagggcaaccagaaggacttcatcaaggcccaggacctgagcaacctggagaacaccgtggccgccctgaagagcgagttccagaagaccctgaacgacaagaccgagaaccagaagagcctggaggagaacctggccaccgccaagcacgacctgctgagagtgcaggagcagctgcacatggccgagaagatctag

SEQ ID NO: 86768 - DNA, 441 bp, Artificial Sequence
  Description of Artificial Sequence: Synthetic coding sequence
atggtggacgagctggtgctgctgctgcacgccctgctgatgagacacagagccctgagcatcgagaacagccagctgatggagcagctgagactgctggtgtgcgagagagccagcctgctgagacaggtgagaccccccagctgccccgtgcccttccccgagaccttcaacggcgagagcagcagactgcccgagttcatcgtgcagaccgccagctacatgctggtgaacgagaacagattctgcaacgacgccatgaaggtggccttcctgatcagcctgctgaccggcgaggccgaggagtgggtggtgccctacatcgagatggacagccccatcctgggcgactacagagccttcctggacgagatgaagcagtgcttcggctgggacgacgacgaggacgacgacgacgaggaggaggaggacgactactag

SEQ ID NO: 86769 - DNA, 2220 bp, Artificial Sequence
  Description of Artificial Sequence: Synthetic coding sequence
atggccagcatcctgctgagaagctgcagaggcagagcccccgccagactgccccccccccccagatacaccgtgcccagaggcagccccggcgaccccgcccacctgagctgcgccagcaccctgggcctgagaaactgcctgaacgtgcccttcggctgctgcacccccatccaccccgtgtacaccagcagcagaggcgaccacctgggctgctgggccctgagacccgagtgcctgagaatcgtgagcagagccccctggaccagcaccagcgtgggcttcgtggccgtgggcccccagtgcctgcccgtgagaggctggcacagcagcagacccgtgagagacgacagcgtggtggagaagagcctgaagagcctgaaggacaagaacaagaagctggaggagggcggccccgtgtacagcccccccgccgaggtggtggtgaagaagagcctgggccagagagtgctggacgagctgaagcactactaccacggcttcagactgctgtggatcgacaccaagatcgccgccagaatgctgtggagaatcctgaacggccacagcctgaccagaagagagagaagacagttcctgagaatctgcgccgacctgttcagactggtgcccttcctggtgttcgtggtggtgcccttcatggagttcctgctgcccgtggccgtgaagctgttccccaacatgctgcccagcaccttcgagacccagagcctgaaggaggagagactgaagaaggagctgagagtgaagctggagctggccaagttcctgcaggacaccatcgaggagatggccctgaagaacaaggccgccaagggcagcgccaccaaggacttcagcgtgttcttccagaagatcagagagaccggcgagagacccagcaacgaggagatcatgagattcagcaagctgttcgaggacgagctgaccctggacaacctgaccagaccccagctggtggccctgtgcaagctgctggagctgcagagcatcggcaccaacaacttcctgagattccagctgaccatgagactgagaagcatcaaggccgacgacaagctgatcgccgaggagggcgtggacagcctgaacgtgaaggagctgcaggccgcctgcagagccagaggcatgagagccctgggcgtgaccgaggacagactgagaggccagctgaagcagtggctggacctgcacctgcaccaggagatccccaccagcctgctgatcctgagcagagccatgtacctgcccgacaccctgagccccgccgaccagctgaagagcaccctgcagaccctgcccgagatcgtggccaaggaggcccaggtgaaggtggccgaggtggagggcgagcaggtggacaacaaggccaagctggaggccaccctgcaggaggaggccgccatccagcaggagcacagagagaaggagctgcagaagagaagcgaggtggccaaggacttcgagcccgagagagtggtggccgccccccagagacccggcaccgagccccagcccgagatgcccgacaccgtgctgcagagcgagaccctgaaggacaccgcccccgtgctggagggcctgaaggaggaggagatcaccaaggaggagatcgacatcctgagcgacgcctgcagcaagctgcaggagcagaagaagagcctgaccaaggagaaggaggagctggagctgctgaaggaggacgtgcaggactacagcgaggacctgcaggagatcaagaaggagctgagcaagaccggcgaggagaagtacgtggaggagagcaaggccagcaagagactgaccaagagagtgcagcagatgatcggccagatcgacggcctgatcagccagctggagatggaccagcaggccggcaagctggcccccgccaacggcatgcccaccggcgagaacgtgatcagcgtggccgagctgatcaacgccatgaagcaggtgaagcacatccccgagagcaagctgaccagcctggccgccgccctggacgagaacaaggacggcaaggtgaacatcgacgacctggtgaaggtgatcgagctggtggacaaggaggacgtgcacatcagcaccagccaggtggccgagatcgtggccaccctggagaaggaggagaaggtggaggagaaggagaaggccaaggagaaggccgagaaggaggtggccgaggtgaagagctag

SEQ ID NO: 86770 - DNA, 759 bp, Artificial Sequence
  Description of Artificial Sequence: Synthetic coding sequence
atgagacacacctggcccttcagaaacgtgcccttcggctgctgcacccccatccaccccgtgtacaccagcagcagaggcgaccacctgggctgctgggccctgagacccgagtgcctgagaatcgtgagcagagccccctggaccagcaccagcgtgggcttcgtggccgtgggcccccagtgcctgcccgtgagaggctggcacagcagcagacccgtgagagacgacagcgtggtggagaagagcctgaagagcctgaaggacaagaacaagaagctggaggagggcggccccgtgtacagcccccccgccgaggtggtggtgaagaagagcctgggccagagagtgctggacgagctgaagcactactaccacggcttcagactgctgtggatcgacaccaagatcgccgccagaatgctgtggagaatcctgaacggccacagcctgaccagaagagagagaagacagttcctgagaatctgcgccgacctgttcagactggtgcccttcctggtgttcgtggtggtgcccttcatggagttcctgctgcccgtggccgtgaagctgttccccaacatgctgcccagcaccttcgagacccagagcctgaaggaggagagactgaagaaggagctgagagtgaagctggagctggccaagttcctgcaggacaccatcgaggagatggccctgaagaacaaggccgccaagggcagcgccaccaaggacttcagcgtgttcttccagaagtag

SEQ ID NO: 86771 - DNA, 4185 bp, Artificial Sequence
  Description of Artificial Sequence: Synthetic coding sequence
atggccgccctgctgagaagcgccagatggctgctgagagccggcgccgcccccagactgcccctgagcctgagactgctgcccggcggccccggcagactgcacgccgccagctacctgcccgccgccagagccggccccgtggccggcggcctgctgagccccgccagactgtacgccatcgccgccaaggagaaggacatccaggaggagagcaccttcagcagcagaaagatcagcaaccagttcgactgggccctgatgagactggacctgagcgtgagaagaaccggcagaatccccaagaagctgctgcagaaggtgttcaacgacacctgcagaagcggcggcctgggcggcagccacgccctgctgctgctgagaagctgcggcagcctgctgcccgagctgaagctggaggagagaaccgagttcgcccacagaatctgggacaccctgcagaagctgggcgccgtgtacgacgtgagccactacaacgccctgctgaaggtgtacctgcagaacgagtacaagttcagccccaccgacttcctggccaagatggaggaggccaacatccagcccaacagagtgacctaccagagactgatcgccagctactgcaacgtgggcgacatcgagggcgccagcaagatcctgggcttcatgaagaccaaggacctgcccgtgaccgaggccgtgttcagcgccctggtgaccggccacgccagagccggcgacatggagaacgccgagaacatcctgaccgtgatgagagacgccggcatcgagcccggccccgacacctacctggccctgctgaacgcctacgccgagaagggcgacatcgaccacgtgaagcagaccctggagaaggtggagaagagcgagctgcacctgatggacagagacctgctgcagatcatcttcagcttcagcaaggccggctacccccagtacgtgagcgagatcctggagaaggtgacctgcgagagaagatacatccccgacgccatgaacctgatcctgctgctggtgaccgagaagctggaggacgtggccctgcagatcctgctggcctgccccgtgagcaaggaggacggccccagcgtgttcggcagcttcttcctgcagcactgcgtgaccatgaacacccccgtggagaagctgaccgactactgcaagaagctgaaggaggtgcagatgcacagcttccccctgcagttcaccctgcactgcgccctgctggccaacaagaccgacctggccaaggccctgatgaaggccgtgaaggaggagggcttccccatcagaccccactacttctggcccctgctggtgggcagaagaaaggagaagaacgtgcagggcatcatcgagatcctgaagggcatgcaggagctgggcgtgcaccccgaccaggagacctacaccgactacgtgatcccctgcttcgacagcgtgaacagcgccagagccatcctgcaggagaacggctgcctgagcgacagcgacatgttcagccaggccggcctgagaagcgaggccgccaacggcaacctggacttcgtgctgagcttcctgaagagcaacaccctgcccatcagcctgcagagcatcagaagcagcctgctgctgggcttcagaagaagcatgaacatcaacctgtggagcgagatcaccgagctgctgtacaaggacggcagatactgccaggagcccagaggccccaccgaggccgtgggctacttcctgtacaacctgatcgacagcatgagcgacagcgaggtgcaggccaaggaggagcacctgagacagtacttccaccagctggagaagatgaacgtgaagatccccgagaacatctacagaggcatcagaaacctgctggagagctaccacgtgcccgagctgatcaaggacgcccacctgctggtggagagcaagaacctggacttccagaagaccgtgcagctgaccagcagcgagctggagagcaccctggagaccctgaaggccgagaaccagcccatcagagacgtgctgaagcagctgatcctggtgctgtgcagcgaggagaacatgcagaaggccctggagctgaaggccaagtacgagagcgacatggtgaccggcggctacgccgccctgatcaacctgtgctgcagacacgacaaggtggaggacgccctgaacctgaaggaggagttcgacagactggacagcagcgccgtgctggacaccggcaagtacgtgggcctggtgagagtgctggccaagcacggcaagctgcaggacgccatcaacatcctgaaggagatgaaggagaaggacgtgctgatcaaggacaccaccgccctgagcttcttccacatgctgaacggcgccgccctgagaggcgagatcgagaccgtgaagcagctgcacgaggccatcgtgaccctgggcctggccgagcccagcaccaacatcagcttccccctggtgaccgtgcacctggagaagggcgacctgagcaccgccctggaggtggccatcgactgctacgagaagtacaaggtgctgcccagaatccacgacgtgctgtgcaagctggtggagaagggcgagaccgacctgatccagaaggccatggacttcgtgagccaggagcagggcgagatggtgatgctgtacgacctgttcttcgccttcctgcagaccggcaactacaaggaggccaagaagatcatcgagacccccggcatcagagccagaagcgccagactgcagtggttctgcgacagatgcgtggccaacaaccaggtggagaccctggagaagctggtggagctgacccagaagctgttcgagtgcgacagagaccagatgtactacaacctgctgaagctgtacaagatcaacggcgactggcagagagccgacgccgtgtggaacaagatccaggaggagaacgtgatccccagagagaagaccctgagactgctggccgagatcctgagagagggcaaccaggaggtgcccttcgacgtgcccgagctgtggtacgaggacgagaagcacagcctgaacagcagcagcgccagcaccaccgagcccgacttccagaaggacatcctgatcgcctgcagactgaaccagaagaagggcgcctacgacatcttcctgaacgccaaggagcagaacatcgtgttcaacgccgagacctacagcaacctgatcaagctgctgatgagcgaggactacttcacccaggccatggaggtgaaggccttcgccgagacccacatcaagggcttcaccctgaacgacgccgccaacagcagactgatcatcacccaggtgagaagagactacctgaaggaggccgtgaccaccctgaagaccgtgctggaccagcagcagacccccagcagactggccgtgaccagagtgatccaggccctggccatgaagggcgacgtggagaacatcgaggtggtgcagaagatgctgaacggcctggaggacagcatcggcctgagcaagatggtgttcatcaacaacatcgccctggcccagatcaagaacaacaacatcgacgccgccatcgagaacatcgagaacatgctgaccagcgagaacaaggtgatcgagccccagtacttcggcctggcctacctgttcagaaaggtgatcgaggagcagctggagcccgccgtggagaagatcagcatcatggccgagagactggccaaccagttcgccatctacaagcccgtgaccgacttcttcctgcagctggtggacgccggcaaggtggacgacgccagagccctgctgcagagatgcggcgccatcgccgagcagacccccatcctgctgctgttcctgctgagaaacagcagaaagcagggcaaggccagcaccgtgaagagcgtgctggagctgatccccgagctgaacgagaaggaggaggcctacaacagcctgatgaagagctacgtgagcgagaaggacgtgaccagcgccaaggccctgtacgagcacctgaccgccaagaacaccaagctggacgacctgttcctgaagagatacgccagcctgctgaagtacgccggcgagcccgtgcccttcatcgagccccccgagagcttcgagttctacgcccagcagctgagaaagctgagagagaacagcagctag

SEQ ID NO: 86772 - DNA, 3264 bp, Artificial Sequence
  Description of Artificial Sequence: Synthetic coding sequence
atgcccccccccatctgcccccccctggcccccggcccctggcccggcggcctgggcggcagccacgccctgctgctgctgagaagctgcggcagcctgctgcccgagctgaagctggaggagagaaccgagttcgcccacagaatctgggacaccctgcagaagctgggcgccgtgtacgacgtgagccactacaacgccctgctgaaggtgtacctgcagaacgagtacaagttcagccccaccgacttcctggccaagatggaggaggccaacatccagcccaacagagtgacctaccagagactgatcgccagctactgcaacgtgggcgacatcgagggcgccagcaagatcctgggcttcatgaagaccaaggacctgcccgtgaccgaggccgtgttcagcgccctggtgaccggccacgccagagccggcgacatggagaacgccgagaacatcctgaccgtgatgagagacgccggcatcgagcccggccccgacacctacctggccctgctgaacgcctacgccgagaagggcgacatcgaccacgtgaagcagaccctggagaaggtggagaagagcgagctgcacctgatggacagagacctgctgcagatcatcttcagcttcagcaaggccggctacccccagtacgtgagcgagatcctggagaaggtgacctgcgagagaagatacatccccgacgccatgaacctgatcctgctgctggtgaccgagaagctggaggacgtggccctgcagatcctgctggcctgccccgtgagcaaggaggacggccccagcgtgttcggcagcttcttcctgcagcactgcgtgaccatgaacacccccgtggagaagctgaccgactactgcaagaagctgaaggaggtgcagatgcacagcttccccctgcagttcaccctgcactgcgccctgctggccaacaagaccgacctggccaaggccctgatgaaggccgtgaaggaggagggcttccccatcagaccccactacttctggcccctgctggtgggcagaagaaaggagaagaacgtgcagggcatcatcgagatcctgaagggcatgcaggagctgggcgtgcaccccgaccaggagacctacaccgactacgtgatcccctgcttcgacagcgtgaacagcgccagagccatcctgcaggagaacggctgcctgagcgacagcgacatgttcagccaggccggcctgagaagcgaggccgccaacggcaacctggacttcgtgctgagcttcctgaagagcaacaccctgcccatcagcctgcagagcatcagaagcagcctgctgctgggcttcagaagaagcatgaacatcaacctgtggagcgagatcaccgagctgctgtacaaggacggcagatactgccaggagcccagaggccccaccgaggccgtgggctacttcctgtacaacctgatcgacagcatgagcgacagcgaggtgcaggccaaggaggagcacctgagacagtacttccaccagctggagaagatgaacgtgaagatccccgagaacatctacagaggcatcagaaacctgctggagagctaccacgtgcccgagctgatcaaggacgcccacctgctggtggagagcaagaacctggacttccagaagaccgtgcagctgaccagcagcgagctggagagcaccctggagaccctgaaggccgagaaccagcccatcagagacgtgctgaagcagctgatcctggtgctgtgcagcgaggagaacatgcagaaggccctggagctgaaggccaagtacgagagcgacatggtgaccggcggctacgccgccctgatcaacctgtgctgcagacacgacaaggtggaggacgccctgaacctgaaggaggagttcgacagactggacagcagcgccgtgctggacaccggcaagtacgtgggcctggtgagagtgctggccaagcacggcaagctgcaggacgccatcaacatcctgaaggagatgaaggagaaggacgtgctgatcaaggacaccaccgccctgagcttcttccacatgctgaacggcgccgccctgagaggcgagatcgagaccgtgaagcagctgcacgaggccatcgtgaccctgggcctggccgagcccagcaccaacatcagcttccccctggtgaccgtgcacctggagaagggcgacctgagcaccgccctggaggtggccatcgactgctacgagaagtacaaggtgctgcccagaatccacgacgtgctgtgcaagctggtggagaagggcgagaccgacctgatccagaaggccatggacttcgtgagccaggagcagggcgagatggtgatgctgtacgacctgttcttcgccttcctgcagaccggcaactacaaggaggccaagaagatcatcgagacccccggcatcagagccagaagcgccagactgcagtggttctgcgacagatgcgtggccaacaaccaggtggagaccctggagaagctggtggagctgacccagaagctgttcgagtgcgacagagaccagatgtactacaacctgctgaagctgtacaagatcaacggcgactggcagagagccgacgccgtgtggaacaagatccaggaggagaacgtgatccccagagagaagaccctgagactgctggccgagatcctgagagagggcaaccaggaggtgcccttcgacgtgcccgagctgtggtacgaggacgagaagcacagcctgaacagcagcagcgccagcaccaccgagcccgacttccagaaggacatcctgatcgcctgcagactgaaccagaagaagggcgcctacgacatcttcctgaacgccaaggagcagaacatcgtgttcaacgccgagacctacagcaacctgatcaagctgctgatgagcgaggactacttcacccaggccatggaggtgaaggccttcgccgagacccacatcaagggcttcaccctgaacgacgccgccaacagcagactgatcatcacccaggtgagaagagactacctgaaggaggccgtgaccaccctgaagaccgtgctggaccagcagcagacccccagcagactggccgtgaccagagtgatccaggccctggccatgaagggcgacgtggagaacatcgaggtggtgcagaagatgctgaacggcctggaggacagcatcggcctgagcaagatggtgttcatcaacaacatcgccctggcccagtag

SEQ ID NO: 86773 - DNA, 2856 bp, Artificial Sequence
  Description of Artificial Sequence: Synthetic coding sequence
atgcccggccccctgggcctgctgtgcttcctggccctgggcctgctgggcagcgccggccccagcggcgccgccccccccctgtgcgccgccccctgcagctgcgacggcgacagaagagtggactgcagcggcaagggcctgaccgccgtgcccgagggcctgagcgccttcacccaggccctggacatcagcatgaacaacatcacccagctgcccgaggacgccttcaagaacttccccttcctggaggagctgcagctggccggcaacgacctgagcttcatccaccccaaggccctgagcggcctgaaggagctgaaggtgctgaccctgcagaacaaccagctgaagaccgtgcccagcgaggccatcagaggcctgagcgccctgcagagcctgagactggacgccaaccacatcaccagcgtgcccgaggacagcttcgagggcctggtgcagctgagacacctgtggctggacgacaacagcctgaccgaggtgcccgtgcaccccctgagcaacctgcccaccctgcaggccctgaccctggccctgaacaagatcagcagcatccccgacttcgccttcaccaacctgagcagcctggtggtgctgcacctgcacaacaacaagatcagaagcctgagccagcactgcttcgacggcctggacaacctggagaccctggacctgaactacaacaacctgggcgagttcccccaggccatcaaggccctgcccagcctgaaggagctgggcttccacagcaacagcatcagcgtgatccccgacggcgccttcgacggcaaccccctgctgagaaccatccacctgtacgacaaccccctgagcttcgtgggcaacagcgccttccacaacctgagcgacctgcacagcctggtgatcagaggcgccagcatggtgcagcagttccccaacctgaccggcaccgtgcacctggagagcctgaccctgaccggcaccaagatcagcagcatccccaacaacctgtgccaggagcagaagatgctgagaaccctggacctgagctacaacaacatcagagacctgcccagcttcaacggctgccacgccctggaggagatcagcctgcagagaaaccagatctaccagatcaaggagggcaccttccagggcctgatcagcctgagaatcctggacctgagcagaaacctgatccacgagatccacagcagagccttcgccaccctgggccccatcaccaacctggacgtgagcttcaacgagctgaccagcttccccaccgagggcctgaacggcctgaaccagctgaagctggtgggcaacttcaagctgaaggaggccctggccgccaaggacttcgtgaacctgagaagcctgagcgtgccctacgcctaccagtgctgcgccttctggggctgcgacagctacgccaacctgaacaccgaggacaacagcctgcaggaccacagcgtggcccaggagaagggcaccgccgacgccgccaacgtgaccagcaccctggagaacgaggagcacagccagatcatcatccactgcacccccagcaccggcgccttcaagccctgcgagtacctgctgggcagctggatgatcagactgaccgtgtggttcatcttcctggtggccctgttcttcaacctgctggtgatcctgaccaccttcgccagctgcaccagcctgcccagcagcaagctgttcatcggcctgatcagcgtgagcaacctgttcatgggcatctacaccggcatcctgaccttcctggacgccgtgagctggggcagattcgccgagttcggcatctggtgggagaccggcagcggctgcaaggtggccggcttcctggccgtgttcagcagcgagagcgccatcttcctgctgatgctggccaccgtggagagaagcctgagcgccaaggacatcatgaagaacggcaagagcaaccacctgaagcagttcagagtggccgccctgctggccttcctgggcgccaccgtggccggctgcttccccctgttccacagaggcgagtacagcgccagccccctgtgcctgcccttccccaccggcgagacccccagcctgggcttcaccgtgaccctggtgctgctgaacagcctggccttcctgctgatggccgtgatctacaccaagctgtactgcaacctggagaaggaggacctgagcgagaacagccagagcagcatgatcaagcacgtggcctggctgatcttcaccaactgcatcttcttctgccccgtggccttcttcagcttcgcccccctgatcaccgccatcagcatcagccccgagatcatgaagagcgtgaccctgatcttcttccccctgcccgcctgcctgaaccccgtgctgtacgtgttcttcaaccccaagttcaaggaggactggaagctgctgaagagaagagtgaccaagaagagcggcagcgtgagcgtgagcatcagcagccagggcggctgcctggagcaggacttctactacgactgcggcatgtacagccacctgcagggcaacctgaccgtgtgcgactgctgcgagagcttcctgctgaccaagcccgtgagctgcaagcacctgatcaagagccacagctgccccgccctggccgtggccagctgccagagacccgagggctactggagcgactgcggcacccagagcgcccacagcgactacgccgacgaggaggacagcttcgtgagcgacagcagcgaccaggtgcaggcctgcggcagagcctgcttctaccagagcagaggcttccccctggtgagatacgcctacaacctgcccagagtgaaggactag

SEQ ID NO: 86774 - DNA, 2724 bp, Artificial Sequence
  Description of Artificial Sequence: Synthetic coding sequence
atggacaccagcagactgggcgtgctgctgagcctgcccgtgctgctgcagctggccaccggcggcagcagccccagaagcggcgtgctgctgagaggctgccccacccactgccactgcgagcccgacggcagaatgctgctgagagtggactgcagcgacctgggcctgagcgagctgcccagcaacctgagcgtgttcaccagctacctggacctgagcatgaacaacatcagccagctgctgcccaaccccctgcccagcctgagattcctggaggagctgagactggccggcaacgccctgacctacatccccaagggcgccttcaccggcctgtacagcctgaaggtgctgatgctgcagaacaaccagctgagacacgtgcccaccgaggccctgcagaacctgagaagcctgcagagcctgagactggacgccaaccacatcagctacgtgccccccagctgcttcagcggcctgcacagcctgagacacctgtggctggacgacaacgccctgaccgagatccccgtgcaggccttcagaagcctgagcgccctgcaggccatgaccctggccctgaacaagatccaccacatccccgactacgccttcggcaacctgagcagcctggtggtgctgcacctgcacaacaacagaatccacagcctgggcaagaagtgcttcgacggcctgcacagcctggagaccctggacctgaactacaacaacctggacgagttccccaccgccatcagaaccctgagcaacctgaaggagctgggcttccacagcaacaacatcagaagcatccccgagaaggccttcgtgggcaaccccagcctgatcaccatccacttctacgacaaccccatccagttcgtgggcagaagcgccttccagcacctgcccgagctgagaaccctgaccctgaacggcgccagccagatcaccgagttccccgacctgaccggcaccgccaacctggagagcctgaccctgaccggcgcccagatcagcagcctgccccagaccgtgtgcaaccagctgcccaacctgcaggtgctggacctgagctacaacctgctggaggacctgcccagcttcagcgtgtgccagaagctgcagaagatcgacctgagacacaacgagatctacgagatcaaggtggacaccttccagcagctgctgagcctgagaagcctgaacctggcctggaacaagatcgccatcatccaccccaacgccttcagcaccctgcccagcctgatcaagctggacctgagcagcaacctgctgagcagcttccccatcaccggcctgcacggcctgacccacctgaagctgaccggcaaccacgccctgcagagcctgatcagcagcgagaacttccccgagctgaaggtgatcgagatgccctacgcctaccagtgctgcgccttcggcgtgtgcgagaacgcctacaagatcagcaaccagtggaacaagggcgacaacagcagcatggacgacctgcacaagaaggacgccggcatgttccaggcccaggacgagagagacctggaggacttcctgctggacttcgaggaggacctgaaggccctgcacagcgtgcagtgcagccccagccccggccccttcaagccctgcgagcacctgctggacggctggctgatcagaatcggcgtgtggaccatcgccgtgctggccctgacctgcaacgccctggtgaccagcaccgtgttcagaagccccctgtacatcagccccatcaagctgctgatcggcgtgatcgccgccgtgaacatgctgaccggcgtgagcagcgccgtgctggccggcgtggacgccttcaccttcggcagcttcgccagacacggcgcctggtgggagaacggcgtgggctgccacgtgatcggcttcctgagcatcttcgccagcgagagcagcgtgttcctgctgaccctggccgccctggagagaggcttcagcgtgaagtacagcgccaagttcgagaccaaggcccccttcagcagcctgaaggtgatcatcctgctgtgcgccctgctggccctgaccatggccgccgtgcccctgctgggcggcagcaagtacggcgccagccccctgtgcctgcccctgcccttcggcgagcccagcaccatgggctacatggtggccctgatcctgctgaacagcctgtgcttcctgatgatgaccatcgcctacaccaagctgtactgcaacctggacaagggcgacctggagaacatctgggactgcagcatggtgaagcacatcgccctgctgctgttcaccaactgcatcctgaactgccccgtggccttcctgagcttcagcagcctgatcaacctgaccttcatcagccccgaggtgatcaagttcatcctgctggtggtggtgcccctgcccgcctgcctgaaccccctgctgtacatcctgttcaacccccacttcaaggaggacctggtgagcctgagaaagcagacctacgtgtggaccagaagcaagcaccccagcctgatgagcatcaacagcgacgacgtggagaagcagagctgcgacagcacccaggccctggtgaccttcaccagcagcagcatcacctacgacctgccccccagcagcgtgcccagccccgcctaccccgtgaccgagagctgccacctgagcagcgtggccttcgtgccctgcctgtag

SEQ ID NO: 86775 - DNA, 2334 bp, Artificial Sequence
  Description of Artificial Sequence: Synthetic coding sequence
atggacaccagcagactgggcgtgctgctgagcctgcccgtgctgctgcagctggccaccggcggcagcagccccagaagcggcgtgctgctgagaggctgccccacccactgccactgcgagcccgacggcagaatgctgctgagagtggactgcagcgacctgggcctgagcgagctgcccagcaacctgagcgtgttcaccagctacctggacctgagcatgaacaacatcagccagctgctgcccaaccccctgcccagcctgagattcctggaggagctgagactggccggcaacgccctgacctacatccccaagggcgccttcaccggcctgtacagcctgaaggtgctgatgctgcagaacaaccagctgagacacgtgcccaccgaggccctgcagaacctgagaagcctgcagagcctgagactggacgccaaccacatcagctacgtgccccccagctgcttcagcggcctgcacagcctgagacacctgtggctggacgacaacgccctgaccgagatccccgtgcaggccttcagaagcctgagcgccctgcaggccatgaccctggccctgaacaagatccaccacatccccgactacgccttcggcaacctgagcagcctggtggtgctgcacctgcacaacaacagaatccacagcctgggcaagaagtgcttcgacggcctgcacagcctggagaccctggacctgaactacaacaacctggacgagttccccaccgccatcagaaccctgagcaacctgaaggagctgggcttccacagcaacaacatcagaagcatccccgagaaggccttcgtgggcaaccccagcctgatcaccatccacttctacgacaaccccatccagttcgtgggcagaagcgccttccagcacctgcccgagctgagaaccctgaccctgaacggcgccagccagatcaccgagttccccgacctgaccggcaccgccaacctggagagcctgaccctgaccggcgcccagatcagcagcctgccccagaccgtgtgcaaccagctgcccaacctgcaggtgctggacctgagctacaacctgctggaggacctgcccagcttcagcgtgtgccagaagctgcagaagatcgacctgagacacaacgagatctacgagatcaaggtggacaccttccagcagctgctgagcctgagaagcctgaacctggcctggaacaagatcgccatcatccaccccaacgccttcagcaccctgcccagcctgatcaagctggacctgagcagcaacctgctgagcagcttccccatcaccggcctgcacggcctgacccacctgaagctgaccggcaaccacgccctgcagagcctgatcagcagcgagaacttccccgagctgaaggtgatcgagatgccctacgcctaccagtgctgcgccttcggcgtgtgcgagaacgcctacaagatcagcaaccagtggaacaagggcgacaacagcagcatggacgacctgcacaagaaggacgccggcatgttccaggcccaggacgagagagacctggaggacttcctgctggacttcgaggaggacctgaaggccctgcacagcgtgcagtgcagccccagccccggccccttcaagccctgcgagcacctgctggacggctggctgatcagaatcggcgtgtggaccatcgccgtgctggccctgacctgcaacgccctggtgaccagcaccgtgttcagaagccccctgtacatcagccccatcaagctgctgatcggcgtgatcgccgccgtgaacatgctgaccggcgtgagcagcgccgtgctggccggcgtggacgccttcaccttcggcagcttcgccagacacggcgcctggtgggagaacggcgtgggctgccacgtgatcggcttcctgagcatcttcgccagcgagagcagcgtgttcctgctgaccctggccgccctggagagaggcttcagcgtgaagtacagcgccaagttcgagaccaaggcccccttcagcagcctgaaggtgatcatcctgctgtgcgccctgctggccctgaccatggccgccgtgcccctgctgggcggcagcaagtacggcgccagccccctgtgcctgcccctgctgccccacgacgaccactgcctgcaccaggccctgctgcagttcggccagggcagacccggcgagtacctgggcctgctgtacggcaagacccactgccccgtggccctgcaccagctgcaccccaagctgccctgcggcttcctggtgctgctgctgttcaacaagccctacatctaccagagctag

SEQ ID NO: 86776 - DNA, 2508 bp, Artificial Sequence
  Description of Artificial Sequence: Synthetic coding sequence
atggacaccagcagactgggcgtgctgctgagcctgcccgtgctgctgcagctggccaccggcggcagcagccccagaagcggcgtgctgctgagaggctgccccacccactgccactgcgagcccgacggcagaatgctgctgagagtggactgcagcgacctgggcctgagcgagctgcccagcaacctgagcgtgttcaccagctacctggacctgagcatgaacaacatcagccagctgctgcccaaccccctgcccagcctgagattcctggaggagctgagactggccggcaacgccctgacctacatccccaagggcgccttcaccggcctgtacagcctgaaggtgctgatgctgcagaacaaccagctgagacacgtgcccaccgaggccctgcagaacctgagaagcctgcagagcctgcacctgcacaacaacagaatccacagcctgggcaagaagtgcttcgacggcctgcacagcctggagaccctggacctgaactacaacaacctggacgagttccccaccgccatcagaaccctgagcaacctgaaggagctgggcttccacagcaacaacatcagaagcatccccgagaaggccttcgtgggcaaccccagcctgatcaccatccacttctacgacaaccccatccagttcgtgggcagaagcgccttccagcacctgcccgagctgagaaccctgaccctgaacggcgccagccagatcaccgagttccccgacctgaccggcaccgccaacctggagagcctgaccctgaccggcgcccagatcagcagcctgccccagaccgtgtgcaaccagctgcccaacctgcaggtgctggacctgagctacaacctgctggaggacctgcccagcttcagcgtgtgccagaagctgcagaagatcgacctgagacacaacgagatctacgagatcaaggtggacaccttccagcagctgctgagcctgagaagcctgaacctggcctggaacaagatcgccatcatccaccccaacgccttcagcaccctgcccagcctgatcaagctggacctgagcagcaacctgctgagcagcttccccatcaccggcctgcacggcctgacccacctgaagctgaccggcaaccacgccctgcagagcctgatcagcagcgagaacttccccgagctgaaggtgatcgagatgccctacgcctaccagtgctgcgccttcggcgtgtgcgagaacgcctacaagatcagcaaccagtggaacaagggcgacaacagcagcatggacgacctgcacaagaaggacgccggcatgttccaggcccaggacgagagagacctggaggacttcctgctggacttcgaggaggacctgaaggccctgcacagcgtgcagtgcagccccagccccggccccttcaagccctgcgagcacctgctggacggctggctgatcagaatcggcgtgtggaccatcgccgtgctggccctgacctgcaacgccctggtgaccagcaccgtgttcagaagccccctgtacatcagccccatcaagctgctgatcggcgtgatcgccgccgtgaacatgctgaccggcgtgagcagcgccgtgctggccggcgtggacgccttcaccttcggcagcttcgccagacacggcgcctggtgggagaacggcgtgggctgccacgtgatcggcttcctgagcatcttcgccagcgagagcagcgtgttcctgctgaccctggccgccctggagagaggcttcagcgtgaagtacagcgccaagttcgagaccaaggcccccttcagcagcctgaaggtgatcatcctgctgtgcgccctgctggccctgaccatggccgccgtgcccctgctgggcggcagcaagtacggcgccagccccctgtgcctgcccctgcccttcggcgagcccagcaccatgggctacatggtggccctgatcctgctgaacagcctgtgcttcctgatgatgaccatcgcctacaccaagctgtactgcaacctggacaagggcgacctggagaacatctgggactgcagcatggtgaagcacatcgccctgctgctgttcaccaactgcatcctgaactgccccgtggccttcctgagcttcagcagcctgatcaacctgaccttcatcagccccgaggtgatcaagttcatcctgctggtggtggtgcccctgcccgcctgcctgaaccccctgctgtacatcctgttcaacccccacttcaaggaggacctggtgagcctgagaaagcagacctacgtgtggaccagaagcaagcaccccagcctgatgagcatcaacagcgacgacgtggagaagcagagctgcgacagcacccaggccctggtgaccttcaccagcagcagcatcacctacgacctgccccccagcagcgtgcccagccccgcctaccccgtgaccgagagctgccacctgagcagcgtggccttcgtgccctgcctgtag

SEQ ID NO: 86777 - DNA, 2652 bp, Artificial Sequence
  Description of Artificial Sequence: Synthetic coding sequence
atggacaccagcagactgggcgtgctgctgagcctgcccgtgctgctgcagctggccaccggcggcagcagccccagaagcggcgtgctgctgagaggctgccccacccactgccactgcgagcccgacggcagaatgctgctgagagtggactgcagcgacctgggcctgagcgagctgcccagcaacctgagcgtgttcaccagctacctggacctgagcatgaacaacatcagccagctgctgcccaaccccctgcccagcctgagattcctggaggagctgagactggccggcaacgccctgacctacatccccaagggcgccttcaccggcctgtacagcctgaaggtgctgatgctgcagaacaaccagctgagacacgtgcccaccgaggccctgcagaacctgagaagcctgcagagcctgagactggacgccaaccacatcagctacgtgccccccagctgcttcagcggcctgcacagcctgagacacctgtggctggacgacaacgccctgaccgagatccccgtgcaggccttcagaagcctgagcgccctgcaggccatgaccctggccctgaacaagatccaccacatccccgactacgccttcggcaacctgagcagcctggtggtgctgcacctgcacaacaacagaatccacagcctgggcaagaagtgcttcgacggcctgcacagcctggagaccctggacctgaactacaacaacctggacgagttccccaccgccatcagaaccctgagcaacctgaaggagctgcacttctacgacaaccccatccagttcgtgggcagaagcgccttccagcacctgcccgagctgagaaccctgaccctgaacggcgccagccagatcaccgagttccccgacctgaccggcaccgccaacctggagagcctgaccctgaccggcgcccagatcagcagcctgccccagaccgtgtgcaaccagctgcccaacctgcaggtgctggacctgagctacaacctgctggaggacctgcccagcttcagcgtgtgccagaagctgcagaagatcgacctgagacacaacgagatctacgagatcaaggtggacaccttccagcagctgctgagcctgagaagcctgaacctggcctggaacaagatcgccatcatccaccccaacgccttcagcaccctgcccagcctgatcaagctggacctgagcagcaacctgctgagcagcttccccatcaccggcctgcacggcctgacccacctgaagctgaccggcaaccacgccctgcagagcctgatcagcagcgagaacttccccgagctgaaggtgatcgagatgccctacgcctaccagtgctgcgccttcggcgtgtgcgagaacgcctacaagatcagcaaccagtggaacaagggcgacaacagcagcatggacgacctgcacaagaaggacgccggcatgttccaggcccaggacgagagagacctggaggacttcctgctggacttcgaggaggacctgaaggccctgcacagcgtgcagtgcagccccagccccggccccttcaagccctgcgagcacctgctggacggctggctgatcagaatcggcgtgtggaccatcgccgtgctggccctgacctgcaacgccctggtgaccagcaccgtgttcagaagccccctgtacatcagccccatcaagctgctgatcggcgtgatcgccgccgtgaacatgctgaccggcgtgagcagcgccgtgctggccggcgtggacgccttcaccttcggcagcttcgccagacacggcgcctggtgggagaacggcgtgggctgccacgtgatcggcttcctgagcatcttcgccagcgagagcagcgtgttcctgctgaccctggccgccctggagagaggcttcagcgtgaagtacagcgccaagttcgagaccaaggcccccttcagcagcctgaaggtgatcatcctgctgtgcgccctgctggccctgaccatggccgccgtgcccctgctgggcggcagcaagtacggcgccagccccctgtgcctgcccctgcccttcggcgagcccagcaccatgggctacatggtggccctgatcctgctgaacagcctgtgcttcctgatgatgaccatcgcctacaccaagctgtactgcaacctggacaagggcgacctggagaacatctgggactgcagcatggtgaagcacatcgccctgctgctgttcaccaactgcatcctgaactgccccgtggccttcctgagcttcagcagcctgatcaacctgaccttcatcagccccgaggtgatcaagttcatcctgctggtggtggtgcccctgcccgcctgcctgaaccccctgctgtacatcctgttcaacccccacttcaaggaggacctggtgagcctgagaaagcagacctacgtgtggaccagaagcaagcaccccagcctgatgagcatcaacagcgacgacgtggagaagcagagctgcgacagcacccaggccctggtgaccttcaccagcagcagcatcacctacgacctgccccccagcagcgtgcccagccccgcctaccccgtgaccgagagctgccacctgagcagcgtggccttcgtgccctgcctgtag

SEQ ID NO: 86778 - DNA, 2748 bp, Artificial Sequence
  Description of Artificial Sequence: Synthetic coding sequence
atgggcagacccagactgaccctggtgtgccaggtgagcatcatcatcagcgccagagacctgagcatgaacaacctgaccgagctgcagcccggcctgttccaccacctgagattcctggaggagctgagactgagcggcaaccacctgagccacatccccggccaggccttcagcggcctgtacagcctgaagatcctgatgctgcagaacaaccagctgggcggcatccccgccgaggccctgtgggagctgcccagcctgcagagcctgagactggacgccaacctgatcagcctggtgcccgagagaagcttcgagggcctgagcagcctgagacacctgtggctggacgacaacgccctgaccgagatccccgtgagagccctgaacaacctgcccgccctgcaggccatgaccctggccctgaacagaatcagccacatccccgactacgccttccagaacctgaccagcctggtggtgctgcacctgcacaacaacagaatccagcacctgggcacccacagcttcgagggcctgcacaacctggagaccctggacctgaactacaacaagctgcaggagttccccgtggccatcagaaccctgggcagactgcaggagctgggcttccacaacaacaacatcaaggccatccccgagaaggccttcatgggcaaccccctgctgcagaccatccacttctacgacaaccccatccagttcgtgggcagaagcgccttccagtacctgcccaagctgcacaccctgagcctgaacggcgccatggacatccaggagttccccgacctgaagggcaccaccagcctggagatcctgaccctgaccagagccggcatcagactgctgcccagcggcatgtgccagcagctgcccagactgagagtgctggagctgagccacaaccagatcgaggagctgcccagcctgcacagatgccagaagctggaggagatcggcctgcagcacaacagaatctgggagatcggcgccgacaccttcagccagctgagcagcctgcaggccctggacctgagctggaacgccatcagaagcatccaccccgaggccttcagcaccctgcacagcctggtgaagctggacctgaccgacaaccagctgaccaccctgcccctggccggcctgggcggcctgatgcacctgaagctgaagggcaacctggccctgagccaggccttcagcaaggacagcttccccaagctgagaatcctggaggtgccctacgcctaccagtgctgcccctacggcatgtgcgccagcttcttcaaggccagcggccagtgggaggccgaggacctgcacctggacgacgaggagagcagcaagagacccctgggcctgctggccagacaggccgagaaccactacgaccaggacctggacgagctgcagctggagatggaggacagcaagccccaccccagcgtgcagtgcagccccacccccggccccttcaagccctgcgagtacctgttcgagagctggggcatcagactggccgtgtgggccatcgtgctgctgagcgtgctgtgcaacggcctggtgctgctgaccgtgttcgccggcggccccgtgcccctgccccccgtgaagttcgtggtgggcgccatcgccggcgccaacaccctgaccggcatcagctgcggcctgctggccagcgtggacgccctgaccttcggccagttcagcgagtacggcgccagatgggagaccggcctgggctgcagagccaccggcttcctggccgtgctgggcagcgaggccagcgtgctgctgctgaccctggccgccgtgcagtgcagcgtgagcgtgagctgcgtgagagcctacggcaagagccccagcctgggcagcgtgagagccggcgtgctgggctgcctggccctggccggcctggccgccgccctgcccctggccagcgtgggcgagtacggcgccagccccctgtgcctgccctacgccccccccgagggccagcccgccgccctgggcttcaccgtggccctggtgatgatgaacagcttctgcttcctggtggtggccggcgcctacatcaagctgtactgcgacctgcccagaggcgacttcgaggccgtgtgggactgcgccatggtgagacacgtggcctggctgatcttcgccgacggcctgctgtactgccccgtggccttcctgagcttcgccagcatgctgggcctgttccccgtgacccccgaggccgtgaagagcgtgctgctggtggtgctgcccctgcccgcctgcctgaaccccctgctgtacctgctgttcaacccccacttcagagacgacctgagaagactgagacccagagccggcgacagcggccccctggcctacgccgccgccggcgagctggagaagagcagctgcgacagcacccaggccctggtggccttcagcgacgtggacctgatcctggaggccagcgaggccggcagaccccccggcctggagacctacggcttccccagcgtgaccctgatcagctgccagcagcccggcgcccccagactggagggcagccactgcgtggagcccgagggcaaccacttcggcaacccccagcccagcatggacggcgagctgctgctgagagccgagggcagcacccccgccggcggcggcctgagcggcggcggcggcttccagcccagcggcctggccttcgccagccacgtgtag

SEQ ID NO: 86779 - DNA, 699 bp, Artificial Sequence
  Description of Artificial Sequence: Synthetic coding sequence
atgaacaacctgaccgagctgcagcccggcctgttccaccacctgagattcctggaggagctgagactgagcggcaaccacctgagccacatccccggccaggccttcagcggcctgtacagcctgaagatcctgatgctgcagaacaaccagctgggcggcatccccgccgaggccctgtgggagctgcccagcctgcagagcctgagactggacgccaacctgatcagcctggtgcccgagagaagcttcgagggcctgagcagcctgagacacctgtggctggacgacaacgccctgaccgagatccccgtgagagccctgaacaacctgcccgccctgcaggccatgaccctggccctgaacagaatcagccacatccccgactacgccttccagaacctgaccagcctggtggtgctggacctgaactacaacaagctgcaggagttccccgtggccatcagaaccctgggcagactgcaggagctgagcctgaacggcgccatggacatccaggagttccccgacctgaagggcaccaccagcctggagatcctgaccctgaccagagccggcatcagactgctgcccagcggcatgtgccagcagctgcccagactgagagtgctggagctgagccacaaccagatcgaggagctgcccagcctgcacagatgccagaagctggaggagtag

SEQ ID NO: 86780 - DNA, 2904 bp, Artificial Sequence
  Description of Artificial Sequence: Synthetic coding sequence
atgcccagcccccccggcctgagagccctgtggctgtgcgccgccctgtgcgccagcagaagagccggcggcgccccccagcccggccccggccccaccgcctgccccgccccctgccactgccaggaggacggcatcatgctgagcgccgactgcagcgagctgggcctgagcgccgtgcccggcgacctggaccccctgaccgcctacctggacctgagcatgaacaacctgaccgagctgcagcccggcctgttccaccacctgagattcctggaggagctgagactgagcggcaaccacctgagccacatccccggccaggccttcagcggcctgtacagcctgaagatcctgatgctgcagaacaaccagctgggcggcatccccgccgaggccctgtgggagctgcccagcctgcagagcctgagactggacgccaacctgatcagcctggtgcccgagagaagcttcgagggcctgagcagcctgagacacctgtggctggacgacaacgccctgaccgagatccccgtgagagccctgaacaacctgcccgccctgcaggccatgaccctggccctgaacagaatcagccacatccccgactacgccttccagaacctgaccagcctggtggtgctgcacctgcacaacaacagaatccagcacctgggcacccacagcttcgagggcctgcacaacctggagaccctggacctgaactacaacaagctgcaggagttccccgtggccatcagaaccctgggcagactgcaggagctgggcttccacaacaacaacatcaaggccatccccgagaaggccttcatgggcaaccccctgctgcagaccatccacttctacgacaaccccatccagttcgtgggcagaagcgccttccagtacctgcccaagctgcacaccctgagcctgaacggcgccatggacatccaggagttccccgacctgaagggcaccaccagcctggagatcctgaccctgaccagagccggcatcagactgctgcccagcggcatgtgccagcagctgcccagactgagagtgctggagctgagccacaaccagatcgaggagctgcccagcctgcacagatgccagaagctggaggagatcggcctgcagcacaacagaatctgggagatcggcgccgacaccttcagccagctgagcagcctgcaggccctggacctgagctggaacgccatcagaagcatccaccccgaggccttcagcaccctgcacagcctggtgaagctggacctgaccgacaaccagctgaccaccctgcccctggccggcctgggcggcctgatgcacctgaagctgaagggcaacctggccctgagccaggccttcagcaaggacagcttccccaagctgagaatcctggaggtgccctacgcctaccagtgctgcccctacggcatgtgcgccagcttcttcaaggccagcggccagtgggaggccgaggacctgcacctggacgacgaggagagcagcaagagacccctgggcctgctggccagacaggccgagaaccactacgaccaggacctggacgagctgcagctggagatggaggacagcaagccccaccccagcgtgcagtgcagccccacccccggccccttcaagccctgcgagtacctgttcgagagctggggcatcagactggccgtgtgggccatcgtgctgctgagcgtgctgtgcaacggcctggtgctgctgaccgtgttcgccggcggccccgtgcccctgccccccgtgaagttcgtggtgggcgccatcgccggcgccaacaccctgaccggcatcagctgcggcctgctggccagcgtggacgccctgaccttcggccagttcagcgagtacggcgccagatgggagaccggcctgggctgcagagccaccggcttcctggccgtgctgggcagcgaggccagcgtgctgctgctgaccctggccgccgtgcagtgcagcgtgagcgtgagctgcgtgagagcctacggcaagagccccagcctgggcagcgtgagagccggcgtgctgggctgcctggccctggccggcctggccgccgccctgcccctggccagcgtgggcgagtacggcgccagccccctgtgcctgccctacgccccccccgagggccagcccgccgccctgggcttcaccgtggccctggtgatgatgaacagcttctgcttcctggtggtggccggcgcctacatcaagctgtactgcgacctgcccagaggcgacttcgaggccgtgtgggactgcgccatggtgagacacgtggcctggctgatcttcgccgacggcctgctgtactgccccgtggccttcctgagcttcgccagcatgctgggcctgttccccgtgacccccgaggccgtgaagagcgtgctgctggtggtgctgcccctgcccgcctgcctgaaccccctgctgtacctgctgttcaacccccacttcagagacgacctgagaagactgagacccagagccggcgacagcggccccctggcctacgccgccgccggcgagctggagaagagcagctgcgacagcacccaggccctggtggccttcagcgacgtggacctgatcctggaggccagcgaggccggcagaccccccggcctggagacctacggcttccccagcgtgaccctgatcagctgccagcagcccggcgcccccagactggagggcagccactgcgtggagcccgagggcaaccacttcggcaacccccagcccagcatggacggcgagctgctgctgagagccgagggcagcacccccgccggcggcggcctgagcggcggcggcggcttccagcccagcggcctggccttcgccagccacgtgtag

SEQ ID NO: 86781 - DNA, 228 bp, Artificial Sequence
  Description of Artificial Sequence: Synthetic coding sequence
atgctgagcgccgactgcagcgagctgggcctgagcgccgtgcccggcgacctggaccccctgaccgcctacctggccgtgcccggcatggtggccgagggcaaggccgacagaaccggcggcggcggcagcagcagacccgagaagaccagaagaagcctggaggaggccatcgacagaaccatcggcggcgcccaggagctgtgggcccccgaggtgagcagctag

SEQ ID NO: 86782 - DNA, 2487 bp, Artificial Sequence
  Description of Artificial Sequence: Synthetic coding sequence
atgagactggagggcgagggcagaagcgccagagccggccagaacctgagcagagccggcagcgccagaagaggcgcccccagagacctgagcatgaacaacctgaccgagctgcagcccggcctgttccaccacctgagattcctggaggagctgagactgagcggcaaccacctgagccacatccccggccaggccttcagcggcctgtacagcctgaagatcctgatgctgcagaacaaccagctgggcggcatccccgccgaggccctgtgggagctgcccagcctgcagagcctggacctgaactacaacaagctgcaggagttccccgtggccatcagaaccctgggcagactgcaggagctgggcttccacaacaacaacatcaaggccatccccgagaaggccttcatgggcaaccccctgctgcagaccatccacttctacgacaaccccatccagttcgtgggcagaagcgccttccagtacctgcccaagctgcacaccctgagcctgaacggcgccatggacatccaggagttccccgacctgaagggcaccaccagcctggagatcctgaccctgaccagagccggcatcagactgctgcccagcggcatgtgccagcagctgcccagactgagagtgctggagctgagccacaaccagatcgaggagctgcccagcctgcacagatgccagaagctggaggagatcggcctgcagcacaacagaatctgggagatcggcgccgacaccttcagccagctgagcagcctgcaggccctggacctgagctggaacgccatcagaagcatccaccccgaggccttcagcaccctgcacagcctggtgaagctggacctgaccgacaaccagctgaccaccctgcccctggccggcctgggcggcctgatgcacctgaagctgaagggcaacctggccctgagccaggccttcagcaaggacagcttccccaagctgagaatcctggaggtgccctacgcctaccagtgctgcccctacggcatgtgcgccagcttcttcaaggccagcggccagtgggaggccgaggacctgcacctggacgacgaggagagcagcaagagacccctgggcctgctggccagacaggccgagaaccactacgaccaggacctggacgagctgcagctggagatggaggacagcaagccccaccccagcgtgcagtgcagccccacccccggccccttcaagccctgcgagtacctgttcgagagctggggcatcagactggccgtgtgggccatcgtgctgctgagcgtgctgtgcaacggcctggtgctgctgaccgtgttcgccggcggccccgtgcccctgccccccgtgaagttcgtggtgggcgccatcgccggcgccaacaccctgaccggcatcagctgcggcctgctggccagcgtggacgccctgaccttcggccagttcagcgagtacggcgccagatgggagaccggcctgggctgcagagccaccggcttcctggccgtgctgggcagcgaggccagcgtgctgctgctgaccctggccgccgtgcagtgcagcgtgagcgtgagctgcgtgagagcctacggcaagagccccagcctgggcagcgtgagagccggcgtgctgggctgcctggccctggccggcctggccgccgccctgcccctggccagcgtgggcgagtacggcgccagccccctgtgcctgccctacgccccccccgagggccagcccgccgccctgggcttcaccgtggccctggtgatgatgaacagcttctgcttcctggtggtggccggcgcctacatcaagctgtactgcgacctgcccagaggcgacttcgaggccgtgtgggactgcgccatggtgagacacgtggcctggctgatcttcgccgacggcctgctgtactgccccgtggccttcctgagcttcgccagcatgctgggcctgttccccgtgacccccgaggccgtgaagagcgtgctgctggtggtgctgcccctgcccgcctgcctgaaccccctgctgtacctgctgttcaacccccacttcagagacgacctgagaagactgagacccagagccggcgacagcggccccctggcctacgccgccgccggcgagctggagaagagcagctgcgacagcacccaggccctggtggccttcagcgacgtggacctgatcctggaggccagcgaggccggcagaccccccggcctggagacctacggcttccccagcgtgaccctgatcagctgccagcagcccggcgcccccagactggagggcagccactgcgtggagcccgagggcaaccacttcggcaacccccagcccagcatggacggcgagctgctgctgagagccgagggcagcacccccgccggcggcggcctgagcggcggcggcggcttccagcccagcggcctggccttcgccagccacgtgtag

SEQ ID NO: 86783 - DNA, 6039 bp, Artificial Sequence
  Description of Artificial Sequence: Synthetic coding sequence
atggagaccctgaacggcgccggcgacaccggcggcaagcccagcaccagaggcggcgaccccgccgccagaagcagaagaaccgagggcatcagagccgcctacagaagaggcgacagaggcggcgccagagacctgctggaggaggcctgcgaccagtgcgccagccagctggagaagggccagctgctgagcatccccgccgcctacggcgacctggagatggtgagatacctgctgagcaagagactggtggagctgcccaccgagcccaccgacgacaaccccgccgtggtggccgcctacttcggccacaccgccgtggtgcaggagctgctggagcccctgacccccaagcagaccgagtgggagcagaccgcccccttcagcggcaccttccccctgagctgccacctgctgcccggcccctgcagcccccagagactgctgaactggatgctggccctggcctgccagagaggccacctgggcgtggtgaagctgctggtgctgacccacggcgccgaccccgagagctacgccgtgagaaagaacgagttccccgtgatcgtgagactgcccctgtacgccgccatcaagagcggcaacgaggacatcgccatcttcctgctgagacacggcgcctacttctgcagctacatcctgctggacagccccgaccccagcaagcacctgctgagaaagtacttcatcgaggccagccccctgcccagcagctaccccggcaagaccgccctgagagtgaagtggagccacctgagactgccctgggtggacctggactggctgatcgacatcagctgccagatcaccgagctggacctgagcgccaactgcctggccaccctgcccagcgtgatcccctggggcctgatcaacctgagaaagctgaacctgagcgacaaccacctgggcgagctgcccggcgtgcagagcagcgacgagatcatctgcagcagactgctggagatcgacatcagcagcaacaagctgagccacctgccccccggcttcctgcacctgagcaagctgcagaagctgaccgccagcaagaactgcctggagaagctgttcgaggaggagaacgccaccaactggatcggcctgagaaagctgcaggagctggacatcagcgacaacaagctgaccgagctgcccgccctgttcctgcacagcttcaagagcctgaacagcctgaacgtgagcagaaacaacctgaaggtgttccccgacccctgggcctgccccctgaagtgctgcaaggccagcagaaacgccctggagtgcctgcccgacaagatggccgtgttctggaagaaccacctgaaggacgtggacttcagcgagaacgccctgaaggaggtgcccctgggcctgttccagctggacgccctgatgttcctgagactgcagggcaaccagctggccgccctgcccccccaggagaagtggacctgcagacagctgaagaccctggacctgagcagaaaccagctgggcaagaacgaggacggcctgaagaccaagagaatcgccttcttcaccaccagaggcagacagagaagcggcaccgaggccgccagcgtgctggagttccccgccttcctgagcgagagcctggaggtgctgtgcctgaacgacaaccacctggacaccgtgccccccagcgtgtgcctgctgaagagcctgagcgagctgtacctgggcaacaaccccggcctgagagagctgccccccgagctgggccagctgggcaacctgtggcagctggacaccgaggacctgaccatcagcaacgtgcccgccgagatccagaaggagggccccaaggccatgctgagctacctgagagcccagctgagaaaggccgagaagtgcaagctgatgaagatgatcatcgtgggcccccccagacagggcaagagcaccctgctggagatcctgcagaccggcagagccccccaggtggtgcacggcgaggccaccatcagaaccaccaagtgggagctgcagagacccgccggcagcagagccaaggtggagagcgtggagttcaacgtgtgggacatcggcggccccgccagcatggccaccgtgaaccagtgcttcttcaccgacaaggccctgtacgtggtggtgtggaacctggccctgggcgaggaggccgtggccaacctgcagttctggctgctgaacatcgaggccaaggcccccaacgccgtggtgctggtggtgggcacccacctggacctgatcgaggccaagttcagagtggagagaatcgccaccctgagagcctacgtgctggccctgtgcagaagccccagcggcagcagagccaccggcttccccgacatcaccttcaagcacctgcacgagatcagctgcaagagcctggagggccaggagggcctgagacagctgatcttccacgtgacctgcagcatgaaggacgtgggcagcaccatcggctgccagagactggccggcagactgatccccagaagctacctgagcctgcaggaggccgtgctggccgagcagcagagaagaagcagagacgacgacgtgcagtacctgaccgacagacagctggagcagctggtggagcagacccccgacaacgacatcaaggactacgaggacctgcagagcgccatcagcttcctgatcgagaccggcaccctgctgcacttccccgacaccagccacggcctgagaaacctgtacttcctggaccccatctggctgagcgagtgcctgcagagaatcttcaacatcaagggcagcagaagcgtggccaagaacggcgtgatcagagccgaggacctgagaatgctgctggtgggcaccggcttcacccagcagaccgaggagcagtacttccagttcctggccaagttcgagatcgccctgcccgtggccaacgacagctacctgctgccccacctgctgcccagcaagcccggcctggacacccacggcatgagacaccccaccgccaacaccatccagagagtgttcaagatgagcttcgtgcccgtgggcttctggcagagattcatcgccagaatgctgatcagcctggccgagatggacctgcagctgttcgagaacaagaagaacaccaagagcagaaacagaaaggtgaccatctacagcttcaccggcaaccagagaaacagatgcagcaccttcagagtgaagagaaaccagaccatctactggcaggagggcctgctggtgaccttcgacggcggctacctgagcgtggagagcagcgacgtgaactggaagaagaagaagagcggcggcatgaagatcgtgtgccagagcgaggtgagagacttcagcgccatggccttcatcaccgaccacgtgaacagcctgatcgaccagtggttccccgccctgaccgccaccgagagcgacggcacccccctgatggagcagtacgtgccctgccccgtgtgcgagaccgcctgggcccagcacaccgaccccagcgagaagagcgaggacgtgcagtacttcgacatggaggactgcgtgctgaccgccatcgagagagacttcatcagctgccccagacaccccgacctgcccgtgcccctgcaggagctggtgcccgagctgttcatgaccgacttccccgccagactgttcctggagaacagcaagctggagcacagcgaggacgagggcagcgtgctgggccagggcggcagcggcaccgtgatctacagagccagataccagggccagcccgtggccgtgaagagattccacatcaagaagttcaagaacttcgccaacgtgcccgccgacaccatgctgagacacctgagagccaccgacgccatgaagaacttcagcgagttcagacaggaggccagcatgctgcacgccctgcagcacccctgcatcgtggccctgatcggcatcagcatccaccccctgtgcttcgccctggagctggcccccctgagcagcctgaacaccgtgctgagcgagaacgccagagacagcagcttcatccccctgggccacatgctgacccagaagatcgcctaccagatcgccagcggcctggcctacctgcacaagaagaacatcatcttctgcgacctgaagagcgacaacatcctggtgtggagcctggacgtgaaggagcacatcaacatcaagctgagcgactacggcatcagcagacagagcttccacgagggcgccctgggcgtggagggcacccccggctaccaggcccccgagatcagacccagaatcgtgtacgacgagaaggtggacatgttcagctacggcatggtgctgtacgagctgctgagcggccagagacccgccctgggccaccaccagctgcagatcgccaagaagctgagcaagggcatcagacccgtgctgggccagcccgaggaggtgcagttcagaagactgcaggccctgatgatggagtgctgggacaccaagcccgagaagagacccctggccctgagcgtggtgagccagatgaaggaccccaccttcgccaccttcatgtacgagctgtgctgcggcaagcagaccgccttcttcagcagccagggccaggagtacaccgtggtgttctgggacggcaaggaggagagcagaaactacaccgtggtgaacaccgagaagggcctgatggaggtgcagagaatgtgctgccccggcatgaaggtgagctgccagctgcaggtgcagagaagcctgtggaccgccaccgaggaccagaagatctacatctacaccctgaagggcatgtgccccctgaacaccccccagcaggccctggacacccccgccgtggtgacctgcttcctggccgtgcccgtgatcaagaagaacagctacctggtgctggccggcctggccgacggcctggtggccgtgttccccgtggtgagaggcacccccaaggacagctgcagctacctgtgcagccacaccgccaacagaagcaagttcagcatcgccgacgaggacgccagacagaacccctaccccgtgaaggccatggaggtggtgaacagcggcagcgaggtgtggtacagcaacggccccggcctgctggtgatcgactgcgccagcctggagatctgcagaagactggagccctacatggcccccagcatggtgaccagcgtggtgtgcagcagcgagggcagaggcgaggaggtggtgtggtgcctggacgacaaggccaacagcctggtgatgtaccacagcaccacctaccagctgtgcgccagatacttctgcggcgtgcccagccccctgagagacatgttccccgtgagacccctggacaccgagccccccgccgccagccacaccgccaaccccaaggtgcccgagggcgacagcatcgccgacgtgagcatcatgtacagcgaggagctgggcacccagatcctgatccaccaggagagcctgaccgactactgcagcatgagcagctacagcagcagcccccccagacaggccgccagaagccccagcagcctgcccagcagccccgccagcagcagcagcgtgcccttcagcaccgactgcgaggacagcgacatgctgcacacccccggcgccgccagcgacagaagcgagcacgacctgacccccatggacggcgagaccttcagccagcacctgcaggccgtgaagatcctggccgtgagagacctgatctgggtgcccagaagaggcggcgacgtgatcgtgatcggcctggagaaggacagcggcgcccagagaggcagagtgatcgccgtgctgaaggccagagagctgaccccccacggcgtgctggtggacgccgccgtggtggccaaggacaccgtggtgtgcaccttcgagaacgagaacaccgagtggtgcctggccgtgtggagaggctggggcgccagagagttcgacatcttctaccagagctacgaggagctgggcagactggaggcctgcaccagaaagagaagatag

SEQ ID NO: 86784 - DNA, 6048 bp, Artificial Sequence
  Description of Artificial Sequence: Synthetic coding sequence
atggccggcatgagccagagaccccccagcatgtactggtgcgtgggccccgaggagagcgccgtgtgccccgagagagccatggagaccctgaacggcgccggcgacaccggcggcaagcccagcaccagaggcggcgaccccgccgccagaagcagaagaaccgagggcatcagagccgcctacagaagaggcgacagaggcggcgccagagacctgctggaggaggcctgcgaccagtgcgccagccagctggagaagggccagctgctgagcatccccgccgcctacggcgacctggagatggtgagatacctgctgagcaagagactggtggagctgcccaccgagcccaccgacgacaaccccgccgtggtggccgcctacttcggccacaccgccgtggtgcaggagctgctggagagcctgcccggcccctgcagcccccagagactgctgaactggatgctggccctggcctgccagagaggccacctgggcgtggtgaagctgctggtgctgacccacggcgccgaccccgagagctacgccgtgagaaagaacgagttccccgtgatcgtgagactgcccctgtacgccgccatcaagagcggcaacgaggacatcgccatcttcctgctgagacacggcgcctacttctgcagctacatcctgctggacagccccgaccccagcaagcacctgctgagaaagtacttcatcgaggccagccccctgcccagcagctaccccggcaagaccgccctgagagtgaagtggagccacctgagactgccctgggtggacctggactggctgatcgacatcagctgccagatcaccgagctggacctgagcgccaactgcctggccaccctgcccagcgtgatcccctggggcctgatcaacctgagaaagctgaacctgagcgacaaccacctgggcgagctgcccggcgtgcagagcagcgacgagatcatctgcagcagactgctggagatcgacatcagcagcaacaagctgagccacctgccccccggcttcctgcacctgagcaagctgcagaagctgaccgccagcaagaactgcctggagaagctgttcgaggaggagaacgccaccaactggatcggcctgagaaagctgcaggagctggacatcagcgacaacaagctgaccgagctgcccgccctgttcctgcacagcttcaagagcctgaacagcctgaacgtgagcagaaacaacctgaaggtgttccccgacccctgggcctgccccctgaagtgctgcaaggccagcagaaacgccctggagtgcctgcccgacaagatggccgtgttctggaagaaccacctgaaggacgtggacttcagcgagaacgccctgaaggaggtgcccctgggcctgttccagctggacgccctgatgttcctgagactgcagggcaaccagctggccgccctgcccccccaggagaagtggacctgcagacagctgaagaccctggacctgagcagaaaccagctgggcaagaacgaggacggcctgaagaccaagagaatcgccttcttcaccaccagaggcagacagagaagcggcaccgaggccgccagcgtgctggagttccccgccttcctgagcgagagcctggaggtgctgtgcctgaacgacaaccacctggacaccgtgccccccagcgtgtgcctgctgaagagcctgagcgagctgtacctgggcaacaaccccggcctgagagagctgccccccgagctgggccagctgggcaacctgtggcagctggacaccgaggacctgaccatcagcaacgtgcccgccgagatccagaaggagggccccaaggccatgctgagctacctgagagcccagctgagaaaggccgagaagtgcaagctgatgaagatgatcatcgtgggcccccccagacagggcaagagcaccctgctggagatcctgcagaccggcagagccccccaggtggtgcacggcgaggccaccatcagaaccaccaagtgggagctgcagagacccgccggcagcagagccaaggtggagagcgtggagttcaacgtgtgggacatcggcggccccgccagcatggccaccgtgaaccagtgcttcttcaccgacaaggccctgtacgtggtggtgtggaacctggccctgggcgaggaggccgtggccaacctgcagttctggctgctgaacatcgaggccaaggcccccaacgccgtggtgctggtggtgggcacccacctggacctgatcgaggccaagttcagagtggagagaatcgccaccctgagagcctacgtgctggccctgtgcagaagccccagcggcagcagagccaccggcttccccgacatcaccttcaagcacctgcacgagatcagctgcaagagcctggagggccaggagggcctgagacagctgatcttccacgtgacctgcagcatgaaggacgtgggcagcaccatcggctgccagagactggccggcagactgatccccagaagctacctgagcctgcaggaggccgtgctggccgagcagcagagaagaagcagagacgacgacgtgcagtacctgaccgacagacagctggagcagctggtggagcagacccccgacaacgacatcaaggactacgaggacctgcagagcgccatcagcttcctgatcgagaccggcaccctgctgcacttccccgacaccagccacggcctgagaaacctgtacttcctggaccccatctggctgagcgagtgcctgcagagaatcttcaacatcaagggcagcagaagcgtggccaagaacggcgtgatcagagccgaggacctgagaatgctgctggtgggcaccggcttcacccagcagaccgaggagcagtacttccagttcctggccaagttcgagatcgccctgcccgtggccaacgacagctacctgctgccccacctgctgcccagcaagcccggcctggacacccacggcatgagacaccccaccgccaacaccatccagagagtgttcaagatgagcttcgtgcccgtgggcttctggcagagattcatcgccagaatgctgatcagcctggccgagatggacctgcagctgttcgagaacaagaagaacaccaagagcagaaacagaaaggtgaccatctacagcttcaccggcaaccagagaaacagatgcagcaccttcagagtgaagagaaaccagaccatctactggcaggagggcctgctggtgaccttcgacggcggctacctgagcgtggagagcagcgacgtgaactggaagaagaagaagagcggcggcatgaagatcgtgtgccagagcgaggtgagagacttcagcgccatggccttcatcaccgaccacgtgaacagcctgatcgaccagtggttccccgccctgaccgccaccgagagcgacggcacccccctgatggagcagtacgtgccctgccccgtgtgcgagaccgcctgggcccagcacaccgaccccagcgagaagagcgaggacgtgcagtacttcgacatggaggactgcgtgctgaccgccatcgagagagacttcatcagctgccccagacaccccgacctgcccgtgcccctgcaggagctggtgcccgagctgttcatgaccgacttccccgccagactgttcctggagaacagcaagctggagcacagcgaggacgagggcagcgtgctgggccagggcggcagcggcaccgtgatctacagagccagataccagggccagcccgtggccgtgaagagattccacatcaagaagttcaagaacttcgccaacgtgcccgccgacaccatgctgagacacctgagagccaccgacgccatgaagaacttcagcgagttcagacaggaggccagcatgctgcacgccctgcagcacccctgcatcgtggccctgatcggcatcagcatccaccccctgtgcttcgccctggagctggcccccctgagcagcctgaacaccgtgctgagcgagaacgccagagacagcagcttcatccccctgggccacatgctgacccagaagatcgcctaccagatcgccagcggcctggcctacctgcacaagaagaacatcatcttctgcgacctgaagagcgacaacatcctggtgtggagcctggacgtgaaggagcacatcaacatcaagctgagcgactacggcatcagcagacagagcttccacgagggcgccctgggcgtggagggcacccccggctaccaggcccccgagatcagacccagaatcgtgtacgacgagaaggtggacatgttcagctacggcatggtgctgtacgagctgctgagcggccagagacccgccctgggccaccaccagctgcagatcgccaagaagctgagcaagggcatcagacccgtgctgggccagcccgaggaggtgcagttcagaagactgcaggccctgatgatggagtgctgggacaccaagcccgagaagagacccctggccctgagcgtggtgagccagatgaaggaccccaccttcgccaccttcatgtacgagctgtgctgcggcaagcagaccgccttcttcagcagccagggccaggagtacaccgtggtgttctgggacggcaaggaggagagcagaaactacaccgtggtgaacaccgagaagggcctgatggaggtgcagagaatgtgctgccccggcatgaaggtgagctgccagctgcaggtgcagagaagcctgtggaccgccaccgaggaccagaagatctacatctacaccctgaagggcatgtgccccctgaacaccccccagcaggccctggacacccccgccgtggtgacctgcttcctggccgtgcccgtgatcaagaagaacagctacctggtgctggccggcctggccgacggcctggtggccgtgttccccgtggtgagaggcacccccaaggacagctgcagctacctgtgcagccacaccgccaacagaagcaagttcagcatcgccgacgaggacgccagacagaacccctaccccgtgaaggccatggaggtggtgaacagcggcagcgaggtgtggtacagcaacggccccggcctgctggtgatcgactgcgccagcctggagatctgcagaagactggagccctacatggcccccagcatggtgaccagcgtggtgtgcagcagcgagggcagaggcgaggaggtggtgtggtgcctggacgacaaggccaacagcctggtgatgtaccacagcaccacctaccagctgtgcgccagatacttctgcggcgtgcccagccccctgagagacatgttccccgtgagacccctggacaccgagccccccgccgccagccacaccgccaaccccaaggtgcccgagggcgacagcatcgccgacgtgagcatcatgtacagcgaggagctgggcacccagatcctgatccaccaggagagcctgaccgactactgcagcatgagcagctacagcagcagcccccccagacaggccgccagaagccccagcagcctgcccagcagccccgccagcagcagcagcgtgcccttcagcaccgactgcgaggacagcgacatgctgcacacccccggcgccgccagcgacagaagcgagcacgacctgacccccatggacggcgagaccttcagccagcacctgcaggccgtgaagatcctggccgtgagagacctgatctgggtgcccagaagaggcggcgacgtgatcgtgatcggcctggagaaggacagcggcgcccagagaggcagagtgatcgccgtgctgaaggccagagagctgaccccccacggcgtgctggtggacgccgccgtggtggccaaggacaccgtggtgtgcaccttcgagaacgagaacaccgagtggtgcctggccgtgtggagaggctggggcgccagagagttcgacatcttctaccagagctacgaggagctgggcagactggaggcctgcaccagaaagagaagatag

SEQ ID NO: 86785 - DNA, 2025 bp, Artificial Sequence
  Description of Artificial Sequence: Synthetic coding sequence
atgctgcacgccctgcagcacccctgcatcgtggccctgatcggcatcagcatccaccccctgtgcttcgccctggagctggcccccctgagcagcctgaacaccgtgctgagcgagaacgccagagacagcagcttcatccccctgggccacatgctgacccagaagatcgcctaccagatcgccagcggcctggcctacctgcacaagaagaacatcatcttctgcgacctgaagagcgacaacatcctggtgtggagcctggacgtgaaggagcacatcaacatcaagctgagcgactacggcatcagcagacagagcttccacgagggcgccctgggcgtggagggcacccccggctaccaggcccccgagatcagacccagaatcgtgtacgacgagaaggtggacatgttcagctacggcatggtgctgtacgagctgctgagcggccagagacccgccctgggccaccaccagctgcagatcgccaagaagctgagcaagggcatcagacccgtgctgggccagcccgaggaggtgcagttcagaagactgcaggccctgatgatggagtgctgggacaccaagcccgagaagagacccctggccctgagcgtggtgagccagatgaaggaccccaccttcgccaccttcatgtacgagctgtgctgcggcaagcagaccgccttcttcagcagccagggccaggagtacaccgtggtgttctgggacggcaaggaggagagcagaaactacaccgtggtgaacaccgagaagggcctgatggaggtgcagagaatgtgctgccccggcatgaaggtgagctgccagctgcaggtgcagagaagcctgtggaccgccaccgaggaccagaagatctacatctacaccctgaagggcatgtgccccctgaacaccccccagcaggccctggacacccccgccgtggtgacctgcttcctggccgtgcccgtgatcaagaagaacagctacctggtgctggccggcctggccgacggcctggtggccgtgttccccgtggtgagaggcacccccaaggacagctgcagctacctgtgcagccacaccgccaacagaagcaagttcagcatcgccgacgaggacgccagacagaacccctaccccgtgaaggccatggaggtggtgaacagcggcagcgaggtgtggtacagcaacggccccggcctgctggtgatcgactgcgccagcctggagatctgcagaagactggagccctacatggcccccagcatggtgaccagcgtggtgtgcagcagcgagggcagaggcgaggaggtggtgtggtgcctggacgacaaggccaacagcctggtgatgtaccacagcaccacctaccagctgtgcgccagatacttctgcggcgtgcccagccccctgagagacatgttccccgtgagacccctggacaccgagccccccgccgccagccacaccgccaaccccaaggtgcccgagggcgacagcatcgccgacgtgagcatcatgtacagcgaggagctgggcacccagatcctgatccaccaggagagcctgaccgactactgcagcatgagcagctacagcagcagcccccccagacaggccgccagaagccccagcagcctgcccagcagccccgccagcagcagcagcgtgcccttcagcaccgactgcgaggacagcgacatgctgcacacccccggcgccgccagcgacagaagcgagcacgacctgacccccatggacggcgagaccttcagccagcacctgcaggccgtgaagatcctggccgtgagagacctgatctgggtgcccagaagaggcggcgacgtgatcgtgatcggcctggagaaggacagcggcgcccagagaggcagagtgatcgccgtgctgaaggccagagagctgaccccccacggcatcatgcccgtgagcagcgtgaaggtgtgctgggccggctggcccgtgagagacatggtgtacatggtggccgtgatgtag

SEQ ID NO: 86786 - DNA, 99 bp, Artificial Sequence
  Description of Artificial Sequence: Synthetic coding sequence
atggccggcatgagccagagaccccccagcatgtactggtgcgtgggccccgaggagagcgccgtgtgccccgagagagccatggagaccctgaactag

SEQ ID NO: 86787 - DNA, 1506 bp, Artificial Sequence
  Description of Artificial Sequence: Synthetic coding sequence
atgttcagctacggcatggtgctgtacgagctgctgagcggccagagacccgccctgggccaccaccagctgcagatcgccaagaagctgagcaagggcatcagacccgtgctgggccagcccgaggaggtgcagttcagaagactgcaggccctgatgatggagtgctgggacaccaagcccgagaagagacccctggccctgagcgtggtgagccagatgaaggaccccaccttcgccaccttcatgtacgagctgtgctgcggcaagcagaccgccttcttcagcagccagggccaggagtacaccgtggtgttctgggacggcaaggaggagagcagaaactacaccgtggtgaacaccgagaagggcctgatggaggtgcagagaatgtgctgccccggcatgaaggtgagctgccagctgcaggtgcagagaagcctgtggaccgccaccgaggaccagaagatctacatctacaccctgaagggcatgtgccccctgaacaccccccagcaggccctggacacccccgccgtggtgacctgcttcctggccgtgcccgtgatcaagaagaacagctacctggtgctggccggcctggccgacggcctggtggccgtgttccccgtggtgagaggcacccccaaggacagctgcagctacctgtgcagccacaccgccaacagaagcaagttcagcatcgccgacgaggacgccagacagaacccctaccccgtgaaggccatggaggtggtgaacagcggcagcgaggtgtggtacagcaacggccccggcctgctggtgatcgactgcgccagcctggagatctgcagaagactggagccctacatggcccccagcatggtgaccagcgtggtgtgcagcagcgagggcagaggcgaggaggtggtgtggtgcctggacgacaaggccaacagcctggtgatgtaccacagcaccacctaccagctgtgcgccagatacttctgcggcgtgcccagccccctgagagacatgttccccgtgagacccctggacaccgagccccccgccgccagccacaccgccaaccccaaggtgcccgagggcgacagcatcgccgacgtgagcatcatgtacagcgaggagctgggcacccagatcctgatccaccaggagagcctgaccgactactgcagcatgagcagctacagcagcagcccccccagacaggccgccagaagccccagcagcctgcccagcagccccgccagcagcagcagcgtgcccttcagcaccgactgcgaggacagcgacatgctgcacacccccggcgccgccagcgacagaagcgagcacgacctgacccccatggacggcgagaccttcagccagcacctgcaggccgtgaagatcctggccgtgagagacctgatctgggtgcccagaagagtggagatgctgagcagcctggcctggagaagaatcctggcccccagcggcgccgagagcctgcccagctag

SEQ ID NO: 86788 - DNA, 7584 bp, Artificial Sequence
  Description of Artificial Sequence: Synthetic coding sequence
atggccagcggcagctgccagggctgcgaggaggacgaggagaccctgaagaagctgatcgtgagactgaacaacgtgcaggagggcaagcagatcgagaccctggtgcagatcctggaggacctgctggtgttcacctacagcgagagagccagcaagctgttccagggcaagaacatccacgtgcccctgctgatcgtgctggacagctacatgagagtggccagcgtgcagcaggtgggctggagcctgctgtgcaagctgatcgaggtgtgccccggcaccatgcagagcctgatgggcccccaggacgtgggcaacgactgggaggtgctgggcgtgcaccagctgatcctgaagatgctgaccgtgcacaacgccagcgtgaacctgagcgtgatcggcctgaagaccctggacctgctgctgaccagcggcaagatcaccctgctgatcctggacgaggagagcgacatcttcatgctgatcttcgacgccatgcacagcttccccgccaacgacgaggtgcagaagctgggctgcaaggccctgcacgtgctgttcgagagagtgagcgaggagcagctgaccgagttcgtggagaacaaggactacatgatcctgctgagcgccctgaccaacttcaaggacgaggaggagatcgtgctgcacgtgctgcactgcctgcacagcctggccatcccctgcaacaacgtggaggtgctgatgagcggcaacgtgagatgctacaacatcgtggtggaggccatgaaggccttccccatgagcgagagaatccaggaggtgagctgctgcctgctgcacagactgaccctgggcaacttcttcaacatcctggtgctgaacgaggtgcacgagttcgtggtgaaggccgtgcagcagtaccccgagaacgccgccctgcagatcagcgccctgagctgcctggccctgctgaccgagaccatcttcctgaaccaggacctggaggagaagaacgagaaccaggagaacgacgacgagggcgaggaggacaagctgttctggctggaggcctgctacaaggccctgacctggcacagaaagaacaagcacgtgcaggaggccgcctgctgggccctgaacaacctgctgatgtaccagaacagcctgcacgagaagatcggcgacgaggacggccacttccccgcccacagagaggtgatgctgagcatgctgatgcacagcagcagcaaggaggtgttccaggccagcgccaacgccctgagcaccctgctggagcagaacgtgaacttcagaaagatcctgctgagcaagggcatccacctgaacgtgctggagctgatgcagaagcacatccacagccccgaggtggccgagagcggctgcaagatgctgaaccacctgttcgagggcagcaacaccagcctggacatcatggccgccgtggtgcccaagatcctgaccgtgatgaagagacacgagaccagcctgcccgtgcagctggaggccctgagagccatcctgcacttcatcgtgcccggcatgcccgaggagagcagagaggacaccgagttccaccacaagctgaacatggtgaagaagcagtgcttcaagaacgacatccacaagctggtgctggccgccctgaacagattcatcggcaaccccggcatccagaagtgcggcctgaaggtgatcagcagcatcgtgcacttccccgacgccctggagatgctgagcctggagggcgccatggacagcgtgctgcacaccctgcagatgtaccccgacgaccaggagatccagtgcctgggcctgagcctgatcggctacctgatcaccaagaagaacgtgttcatcggcaccggccacctgctggccaagatcctggtgagcagcctgtacagattcaaggacgtggccgagatccagaccaagggcttccagaccatcctggccatcctgaagctgagcgccagcttcagcaagctgctggtgcaccacagcttcgacctggtgatcttccaccagatgagcagcaacatcatggagcagaaggaccagcagttcctgaacctgtgctgcaagtgcttcgccaaggtggccatggacgactacctgaagaacgtgatgctggagagagcctgcgaccagaacaacagcatcatggtggagtgcctgctgctgctgggcgccgacgccaaccaggccaaggagggcagcagcctgatctgccaggtgtgcgagaaggagagcagccccaagctggtggagctgctgctgaacagcggcagcagagagcaggacgtgagaaaggccctgaccatcagcatcggcaagggcgacagccagatcatcagcctgctgctgagaagactggccctggacgtggccaacaacagcatctgcctgggcggcttctgcatcggcaaggtggagcccagctggctgggccccctgttccccgacaagaccagcaacctgagaaagcagaccaacatcgccagcaccctggccagaatggtgatcagataccagatgaagagcgccgtggaggagggcaccgccagcggcagcgacggcaacttcagcgaggacgtgctgagcaagttcgacgagtggaccttcatccccgacagcagcatggacagcgtgttcgcccagagcgacgacctggacagcgagggcagcgagggcagcttcctggtgaagaagaagagcaacagcatcagcgtgggcgagttctacagagacgccgtgctgcagagatgcagccccaacctgcagagacacagcaacagcctgggccccatcttcgaccacgaggacctgctgaagagaaagagaaagatcctgagcagcgacgacagcctgagaagcagcaagctgcagagccacatgagacacagcgacagcatcagcagcctggccagcgagagagagtacatcaccagcctggacctgagcgccaacgagctgagagacatcgacgccctgagccagaagtgctgcatcagcgtgcacctggagcacctggagaagctggagctgcaccagaacgccctgaccagcttcccccagcagctgtgcgagaccctgaagagcctgacccacctggacctgcacagcaacaagttcaccagcttccccagctacctgctgaagatgagctgcatcgccaacctggacgtgagcagaaacgacatcggccccagcgtggtgctggaccccaccgtgaagtgccccaccctgaagcagttcaacctgagctacaaccagctgagcttcgtgcccgagaacctgaccgacgtggtggagaagctggagcagctgatcctggagggcaacaagatcagcggcatctgcagccccctgagactgaaggagctgaagatcctgaacctgagcaagaaccacatcagcagcctgagcgagaacttcctggaggcctgccccaaggtggagagcttcagcgccagaatgaacttcctggccgccatgcccttcctgccccccagcatgaccatcctgaagctgagccagaacaagttcagctgcatccccgaggccatcctgaacctgccccacctgagaagcctggacatgagcagcaacgacatccagtacctgcccggccccgcccactggaagagcctgaacctgagagagctgctgttcagccacaaccagatcagcatcctggacctgagcgagaaggcctacctgtggagcagagtggagaagctgcacctgagccacaacaagctgaaggagatcccccccgagatcggctgcctggagaacctgaccagcctggacgtgagctacaacctggagctgagaagcttccccaacgagatgggcaagctgagcaagatctgggacctgcccctggacgagctgcacctgaacttcgacttcaagcacatcggctgcaaggccaaggacatcatcagattcctgcagcagagactgaagaaggccgtgccctacaacagaatgaagctgatgatcgtgggcaacaccggcagcggcaagaccaccctgctgcagcagctgatgaagaccaagaagagcgacctgggcatgcagagcgccaccgtgggcatcgacgtgaaggactggcccatccagatcagagacaagagaaagagagacctggtgctgaacgtgtgggacttcgccggcagagaggagttctacagcacccacccccacttcatgacccagagagccctgtacctggccgtgtacgacctgagcaagggccaggccgaggtggacgccatgaagccctggctgttcaacatcaaggccagagccagcagcagccccgtgatcctggtgggcacccacctggacgtgagcgacgagaagcagagaaaggcctgcatgagcaagatcaccaaggagctgctgaacaagagaggcttccccgccatcagagactaccacttcgtgaacgccaccgaggagagcgacgccctggccaagctgagaaagaccatcatcaacgagagcctgaacttcaagatcagagaccagctggtggtgggccagctgatccccgactgctacgtggagctggagaagatcatcctgagcgagagaaagaacgtgcccatcgagttccccgtgatcgacagaaagagactgctgcagctggtgagagagaaccagctgcagctggacgagaacgagctgccccacgccgtgcacttcctgaacgagagcggcgtgctgctgcacttccaggaccccgccctgcagctgagcgacctgtacttcgtggagcccaagtggctgtgcaagatcatggcccagatcctgaccgtgaaggtggagggctgccccaagcaccccaagggcatcatcagcagaagagacgtggagaagttcctgagcaagaagagaaagttccccaagaactacatgagccagtacttcaagctgctggagaagttccagatcgccctgcccatcggcgaggagtacctgctggtgcccagcagcctgagcgaccacagacccgtgatcgagctgccccactgcgagaacagcgagatcatcatcagactgtacgagatgccctacttccccatgggcttctggagcagactgatcaacagactgctggagatcagcccctacatgctgagcggcagagagagagccctgagacccaacagaatgtactggagacagggcatctacctgaactggagccccgaggcctactgcctggtgggcagcgaggtgctggacaaccaccccgagagcttcctgaagatcaccgtgcccagctgcagaaagggctgcatcctgctgggccaggtggtggaccacatcgacagcctgatggaggagtggttccccggcctgctggagatcgacatctgcggcgagggcgagaccctgctgaagaagtgggccctgtacagcttcaacgacggcgaggagcaccagaagatcctgctggacgacctgatgaagaaggccgaggagggcgacctgctggtgaaccccgaccagcccagactgaccatccccatcagccagatcgcccccgacctgatcctggccgacctgcccagaaacatcatgctgaacaacgacgagctggagttcgagcaggcccccgagttcctgctgggcgacggcagcttcggcagcgtgtacagagccgcctacgagggcgaggaggtggccgtgaagatcttcaacaagcacaccagcctgagactgctgagacaggagctggtggtgctgtgccacctgcaccaccccagcctgatcagcctgctggccgccggcatcagacccagaatgctggtgatggagctggccagcaagggcagcctggacagactgctgcagcaggacaaggccagcctgaccagaaccctgcagcacagaatcgccctgcacgtggccgacggcctgagatacctgcacagcgccatgatcatctacagagacctgaagccccacaacgtgctgctgttcaccctgtaccccaacgccgccatcatcgccaagatcgccgactacggcatcgcccagtactgctgcagaatgggcatcaagaccagcgagggcacccccggcttcagagcccccgaggtggccagaggcaacgtgatctacaaccagcaggccgacgtgtacagcttcggcctgctgctgtacgacatcctgaccaccggcggcagaatcgtggagggcctgaagttccccaacgagttcgacgagctggagatccagggcaagctgcccgaccccgtgaaggagtacggctgcgccccctggcccatggtggagaagctgatcaagcagtgcctgaaggagaacccccaggagagacccaccagcgcccaggtgttcgacatcctgaacagcgccgagctggtgtgcctgaccagaagaatcctgctgcccaagaacgtgatcgtggagtgcatggtggccacccaccacaacagcagaaacgccagcatctggctgggctgcggccacaccgacagaggccagctgagcttcctggacctgaacaccgagggctacaccagcgaggaggtggccgacagcagaatcctgtgcctggccctggtgcacctgcccgtggagaaggagagctggatcgtgagcggcacccagagcggcaccctgctggtgatcaacaccgaggacggcaagaagagacacaccctggagaagatgaccgacagcgtgacctgcctgtactgcaacagcttcagcaagcagagcaagcagaagaacttcctgctggtgggcaccgccgacggcaagctggccatcttcgaggacaagaccgtgaagctgaagggcgccgcccccctgaagatcctgaacatcggcaacgtgagcacccccctgatgtgcctgagcgagagcaccaacagcaccgagagaaacgtgatgtggggcggctgcggcaccaagatcttcagcttcagcaacgacttcaccatccagaagctgatcgagaccagaaccagccagctgttcagctacgccgccttcagcgacagcaacatcatcaccgtggtggtggacaccgccctgtacatcgccaagcagaacagccccgtggtggaggtgtgggacaagaagaccgagaagctgtgcggcctgatcgactgcgtgcacttcctgagagaggtgatggtgaaggagaacaaggagagcaagcacaagatgagctacagcggcagagtgaagaccctgtgcctgcagaagaacaccgccctgtggatcggcaccggcggcggccacatcctgctgctggacctgagcaccagaagactgatcagagtgatctacaacttctgcaacagcgtgagagtgatgatgaccgcccagctgggcagcctgaagaacgtgatgctggtgctgggctacaacagaaagaacaccgagggcacccagaagcagaaggagatccagagctgcctgaccgtgtgggacatcaacctgccccacgaggtgcagaacctggagaagcacatcgaggtgagaaaggagctggccgagaagatgagaagaaccagcgtggagtag

SEQ ID NO: 86789 - DNA, 582 bp, Artificial Sequence
  Description of Artificial Sequence: Synthetic coding sequence
atgaccagcagctgcttcagaagcaccaccagaagaagcctgagcagccagaccgcccagagactggtgtgcccccagttcatcaacggcaccgccaaggacagcatcctgaccagcagaagccaggtgcccatcatcctgcagtggaacaagagcagcaagaagttcgtgccccacggcgacatccccaacatggaggacgtgctggccgtgaagagcttcagaatgcagaacaccctgtacctgagcctgaccagattcatcggcgacagcagagtgatgagatggaacagcaagcagttcgtggagatccaggccctgcccagcagaggcgccatgaccctgcagcccttcagcttcaaggacaaccactacctggccctgggcagcgactacaccttcagccagatctaccagtgggacaaggagaagcagctgttcaagaagttcaaggagatctacgtgcaggcccccagaagcttcaccgccgtgagcaccgacagaagagacttcttcttcgccagcagcttcaagggcaagaccaagatcttcgagcacatcatcgtggacctgagcctgtag

SEQ ID NO: 86790 - DNA, 1638 bp, Artificial Sequence
  Description of Artificial Sequence: Synthetic coding sequence
atggccctgagaagaggcggctgcggcgccctgggcctgctgctgctgctgctgggcgccgcctgcctgatccccagaagcgcccaggtgagaagactggccagatgccccgccacctgcagctgcaccaaggagagcatcatctgcgtgggcagcagctgggtgcccagaatcgtgcccggcgacatcagcagcctgagcctggtgaacggcaccttcagcgagatcaaggacagaatgttcagccacctgcccagcctgcagctgctgctgctgaacagcaacagcttcaccatcatcagagacgacgccttcgccggcctgttccacctggagtacctgttcatcgagggcaacaagatcgagaccatcagcagaaacgccttcagaggcctgagagacctgacccacctgagcctggccaacaaccacatcaaggccctgcccagagacgtgttcagcgacctggacagcctgatcgagctggacctgagaggcaacaagttcgagtgcgactgcaaggccaagtggctgtacctgtggctgaagatgaccaacagcaccgtgagcgacgtgctgtgcatcggcccccccgagtaccaggagaagaagctgaacgacgtgaccagcttcgactacgagtgcaccaccaccgacttcgtggtgcaccagaccctgccctaccagagcgtgagcgtggacaccttcaacagcaagaacgacgtgtacgtggccatcgcccagcccagcatggagaactgcatggtgctggagtgggaccacatcgagatgaacttcagaagctacgacaacatcaccggccagagcatcgtgggctgcaaggccatcctgatcgacgaccaggtgttcgtggtggtggcccagctgttcggcggcagccacatctacaagtacgacgagagctggaccaagttcgtgaagttccaggacatcgaggtgagcagaatcagcaagcccaacgacatcgagctgttccagatcgacgacgagaccttcttcgtgatcgccgacagcagcaaggccggcctgagcaccgtgtacaagtggaacagcaagggcttctacagctaccagagcctgcacgagtggttcagagacaccgacgccgagttcgtggacatcgacggcaagagccacctgatcctgagcagcagaagccaggtgcccatcatcctgcagtggaacaagagcagcaagaagttcgtgccccacggcgacatccccaacatggaggacgtgctggccgtgaagagcttcagaatgcagaacaccctgtacctgagcctgaccagattcatcggcgacagcagagtgatgagatggaacagcaagcagttcgtggagatccaggccctgcccagcagaggcgccatgaccctgcagcccttcagcttcaaggacaaccactacctggccctgggcagcgactacaccttcagccagatctaccagtgggacaaggagaagcagctgttcaagaagttcaaggagatctacgtgcaggcccccagaagcttcaccgccgtgagcaccgacagaagagacttcttcttcgccagcagcttcaagggcaagaccaagatcttcgagcacatcatcgtggacctgagcctgtag

SEQ ID NO: 86791 - DNA, 1647 bp, Artificial Sequence
  Description of Artificial Sequence: Synthetic coding sequence
atggccggcctgagagccagaggcggccccggccccggcctgctggccctgagcgccctgggcttctgcctgatgctgcaggtgagcgccaagagaccccccaagacccccccctgcccccccagctgcagctgcaccagagacaccgccttctgcgtggacagcaaggccgtgcccagaaacctgcccagcgaggtgatcagcctgaccctggtgaacgccgccttcagcgagatccaggacggcgccttcagccacctgcccctgctgcagttcctgctgctgaacagcaacaagttcaccctgatcggcgacaacgccttcaccggcctgagccacctgcagtacctgttcatcgagaacaacgacatctgggccctgagcaagttcaccttcagaggcctgaagagcctgacccacctgagcctggccaacaacaacctgcagaccctgcccagagacatcttcagacccctggacatcctgaacgacctggacctgagaggcaacagcctgaactgcgactgcaaggtgaagtggctggtggagtggctggcccacaccaacaccaccgtggcccccatctactgcgccagcccccccagattccaggagcacaaggtgcaggacctgcccctgagagagttcgactgcatcaccaccgacttcgtgctgtaccagaccctggccttccccgccgtgagcgccgagcccttcctgtacagcagcgacctgtacctggccctggcccagcccggcgtgagcgcctgcaccatcctgaagtgggactacgtggagagacagctgagagactacgacagaatccccgcccccagcgccgtgcactgcaagcccatggtggtggacagccagctgtacgtggtggtggcccagctgttcggcggcagctacatctaccactgggaccccaacaccaccagattcaccagactgcaggacatcgacccccagagagtgagaaagcccaacgacctggaggccttcagaatcgacggcgactggtacttcgccgtggccgacagcagcaaggccggcgccaccagcctgtacagatggcaccagaacggcttctacagccaccaggccctgcacccctggcacagagacaccgacctggagttcgtggacggcgagggcaagcccagactgatcgtgagcagcagcagccaggcccccgtgatctaccagtggagcagaacccagaagcagttcgtggcccagggcgaggtgacccaggtgcccgacgcccaggccgtgaagcacttcagagccggcagagacagctacctgtgcctgagcagatacatcggcgacagcaagatcctgagatgggagggcaccagattcagcgaggtgcaggccctgcccagcagaggcagcctggccctgcagcccttcctggtgggcggcagaagatacctggccctgggcagcgacttcagcttcacccagatctaccagtgggacgagggcagacagaagttcgtgagattccaggagctggccgtgcaggcccccagagccttctgctacatgcccgccggcgacgcccagctgctgctggcccccagcttcaagggccagaccctggtgtacagacacatcgtggtggacctgagcgcctag

SEQ ID NO: 86792 - DNA, 1614 bp, Artificial Sequence
  Description of Artificial Sequence: Synthetic coding sequence
atgggcggcgccggcatcctgctgctgctgctggccggcgccggcgtggtggtggcctggagaccccccaagggcaagtgccccctgagatgcagctgcagcaaggacagcgccctgtgcgagggcagccccgacctgcccgtgagcttcagccccaccctgctgagcctgagcctggtgagaaccggcgtgacccagctgaaggccggcagcttcctgagaatccccagcctgcacctgctgctgttcaccagcaacagcttcagcgtgatcgaggacgacgccttcgccggcctgagccacctgcagtacctgttcatcgaggacaacgagatcggcagcatcagcaagaacgccctgagaggcctgagaagcctgacccacctgagcctggccaacaaccacctggagaccctgcccagattcctgttcagaggcctggacaccctgacccacgtggacctgagaggcaaccccttccagtgcgactgcagagtgctgtggctgctgcagtggatgcccaccgtgaacgccagcgtgggcaccggcgcctgcgccggccccgccagcctgagccacatgcagctgcaccacctggaccccaagaccttcaagtgcagagccatcgagctgagctggttccagaccgtgggcgagagcgccctgagcgtggagcccttcagctaccagggcgagccccacatcgtgctggcccagcccttcgccggcagatgcctgatcctgagctgggactacagcctgcagagattcagacccgaggaggagctgcccgccgccagcgtggtgagctgcaagcccctggtgctgggccccagcctgttcgtgctggccgccagactgtggggcggcagccagctgtgggccagacccagccccggcctgagactggcccccacccagaccctggcccccagaagactgctgagacccaacgacgccgagctgctgtggctggagggccagccctgcttcgtggtggccgacgccagcaaggccggcagcaccaccctgctgtgcagagacggccccggcttctacccccaccagagcctgcacgcctggcacagagacaccgacgccgaggccctggagctggacggcagaccccacctgctgctggccagcgccagccagagacccgtgctgttccactggaccggcggcagattcgagagaagaaccgacatccccgaggccgaggacgtgtacgccaccagacacttccaggccggcggcgacgtgttcctgtgcctgaccagatacatcggcgacagcatggtgatgagatgggacggcagcatgttcagactgctgcagcagctgcccagcagaggcgcccacgtgttccagcccctgctgatcgccagagaccagctggccatcctgggcagcgacttcgccttcagccaggtgctgagactggagcccgacaagggcctgctggagcccctgcaggagctgggcccccccgccctggtggcccccagagccttcgcccacatcaccatggccggcagaagattcctgttcgccgcctgcttcaagggccccacccagatctaccagcaccacgagatcgacctgagcgcctag

SEQ ID NO: 86793 - DNA, 1485 bp, Artificial Sequence
  Description of Artificial Sequence: Synthetic coding sequence
atgggcggcgccggcatcctgctgctgctgctggccggcgccggcgtggtggtggcctggagaccccccaagggcaagtgccccctgagatgcagctgcagcaaggacagcgccctgtgcgagggcagccccgacctgcccgtgagcttcagccccaccctgctgagcctgagcctggtgagaaccggcgtgacccagctgaaggccggcagcttcctgagaatccccagcctgcacctgctgctgttcaccagcaacagcttcagcgtgatcgaggacgacgccttcgccggcctgagccacctgcagtacctgttcatcgaggacaacgagatcggcagcatcagcaagaacgccctgagaggcctgagaagcctgacccacctgagcctggccaacaaccacctggagaccctgcccagattcctgttcagaggcctggacaccctgacccacgtggacctgagaggcaaccccttccagtgcgactgcagagtgctgtggctgctgcagtggatgcccaccgtgaacgccagcgtgggcaccggcgcctgcgccggccccgccagcctgagccacatgcagctgcaccacctggaccccaagaccttcaagtgcagagccatcgagctgagctggttccagaccgtgggcgagagcgccctgagcgtggagcccttcagctaccagggcgagccccacatcgtgctggcccagcccttcgccggcagatgcctgatcctgagctgggactacagcctgcagagattcagacccgaggaggagctgcccggcgagcccccccccagacccagcgcctgccccgccgcctgcctggccggcctgacctgcctgcccaccagcccccagagacccccctggtgccccgccagccactggtgctgggccagagccagcagctgctggctgcccgcctgcggcggcgcccacagctgcggccccggccccgtgcccgcctgcgcctggccccagagaagaccctggcccagaggcggctgctgcggccccatgacccccagcagctgcggctggaagggcaaccccgccagctggtggcccatgccccccagaagagccgcccccagatgctgcgccgccaccggccccgccttcaccagaaccagagcctgcacccccggcaccggcaccagaaccctgagaccctggagctggaccgccggccccacctgctgctggcccagactgcccagcggcccctgcagcagcaccggccccgtggccgccagcagagacgcccagaccagccccagacccagaatgagcatgccccacgccaccagcagactggtgggcacctgcagctgcgccagccacgccaccctgggcaccccctggagctgcgccggcaccgccccctgcttcgtgtgctgcagcaacttccccagagccgtgcccaccagcagcagccactgcagcagccccggcaccagctggcccagctag

SEQ ID NO: 86794 - DNA, 1617 bp, Artificial Sequence
  Description of Artificial Sequence: Synthetic coding sequence
atgggcggcgccggcatcctgctgctgctgctggccggcgccggcgtggtggtggcctggagaccccccaagggcaagtgccccctgagatgcagctgcagcaaggacagcgccctgtgcgagggcagccccgacctgcccgtgagcttcagccccaccctgctgagcctgagcctggtgagaaccggcgtgacccagctgaaggccggcagcttcctgagaatccccagcctgcacctgctgctgttcaccagcaacagcttcagcgtgatcgaggacgacgccttcgccggcctgagccacctgcagtacctgttcatcgaggacaacgagatcggcagcatcagcaagaacgccctgagaggcctgagaagcctgacccacctgagcctggccaacaaccacctggagaccctgcccagattcctgttcagaggcctggacaccctgacccacgtggacctgagaggcaaccccttccagtgcgactgcagagtgctgtggctgctgcagtggatgcccaccgtgaacgccagcgtgggcaccggcgcctgcgccggccccgccagcctgagccacatgcagctgcaccacctggaccccaagaccttcaagtgcagagccatcgagctgagctggttccagaccgtgggcgagagcgccctgagcgtggagcccttcagctaccagggcgagccccacatcgtgctggcccagcccttcgccggcagatgcctgatcctgagctgggactacagcctgcagagattcagacccgaggaggagctgcccgccgccagcgtggtgagctgcaagcccctggtgctgggccccagcctgttcgtgctggccgccagactgtggggcggcagccagctgtgggccagacccagccccggcctgagactggcccccacccagaccctggcccccagaagactgctgagacccaacgacgccgagctgctgtggctggagggccagccctgcttcgtggtggccgacgccagcaaggccggcagcaccaccctgctgtgcagagacggccccggcttctacccccaccagagcctgcacgcctggcacagagacaccgacgccgaggccctggagctggacggcagaccccacctgctgctggccagcgccagccagagacccgtgctgttccactggaccggcggcagattcgagagaagaaccgacatccccgaggccgaggacgtgtacgccaccagacacttccaggccggcggcgacgtgttcctgtgcctgaccagatacatcggcgacagcatggtggtgatgagatgggacggcagcatgttcagactgctgcagcagctgcccagcagaggcgcccacgtgttccagcccctgctgatcgccagagaccagctggccatcctgggcagcgacttcgccttcagccaggtgctgagactggagcccgacaagggcctgctggagcccctgcaggagctgggcccccccgccctggtggcccccagagccttcgcccacatcaccatggccggcagaagattcctgttcgccgcctgcttcaagggccccacccagatctaccagcaccacgagatcgacctgagcgcctag

SEQ ID NO: 86795 - DNA, 2091 bp, Artificial Sequence
  Description of Artificial Sequence: Synthetic coding sequence
atggccacccccggcagcgagccccagcccttcgtgcccgccctgagcgtggccaccctgcaccccctgcaccacccccaccaccaccaccaccaccaccagcaccacggcggcaccggcgcccccggcggcgccggcggcggcggcggcggcagcggcggcttcaacctgcccctgaacagaggcctggagagagccctggaggaggccgccaacagcggcggcctgaacctgagcgccagaaagctgaaggagttccccagaaccgccgcccccggccacgacctgagcgacaccgtgcaggccgacctgagcaagaacagactggtggaggtgcccatggagctgtgccacttcgtgagcctggagatcctgaacctgtaccacaactgcatcagagtgatccccgaggccatcgtgaacctgcagatgctgacctacctgaacctgagcagaaaccagctgagcgccctgcccgcctgcctgtgcggcctgcccctgaaggtgctgatcgccagcaacaacaagctgggcagcctgcccgaggagatcggccagctgaagcagctgatggagctggacgtgagctgcaacgagatcaccgccctgccccagcagatcggccagctgaagagcctgagagagctgaacgtgagaagaaactacctgaaggtgctgccccaggagctggtggacctgagcctggtgaagttcgacttcagctgcaacaaggtgctggtgatccccatctgcttcagagagatgaagcagctgcaggtgctgctgctggagaacaaccccctgcagagcccccccgcccagatctgcaccaagggcaaggtgcacatcttcaagtacctgagcatccaggcctgccagatcaagaccgccgacagcctgtacctgcacaccatggagagaccccacctgcaccagcacgtggaggacggcaagaaggacagcgacagcggcgtgggcagcgacaacggcgacaagagactgagcgccaccgagcccagcgacgaggacaccgtgagcctgaacgtgcccatgagcaacatcatggaggaggagcagatcatcaaggaggacagctgccacagactgagccccgtgaagggcgagttccaccaggagttccagcccgagcccagcctgctgggcgacagcaccaacagcggcgaggagagagaccagttcaccgacagagccgacggcctgcacagcgagttcatgaactacaaggccagagccgaggactgcgaggagctgctgagaatcgaggaggacgtgcactggcagaccgagggcatcatcagcagcagcaaggaccaggacatggacatcgccatgatcgagcagctgagagaggccgtggacctgctgcaggaccccaacggcctgagcaccgacatcaccgagagaagcgtgctgaacctgtaccccatgggcagcgccgaggccctggagctgcaggacagcgccctgaacggccagatccagctggagaccagccccgtgtgcgaggtgcagagcgacctgaccctgcagagcaacggcagccagtacagccccaacgagatcagagagaacagccccgccgtgagccccaccaccaacagcaccgcccccttcggcctgaagcccagaagcgtgttcctgagaccccagagaaacctggagagcatcgacccccagttcaccatcagaagaaagatggagcagatgagagaggagaaggagctggtggagcagctgagagagagcatcgagatgagactgaaggtgagcctgcacgaggacctgggcgccgccctgatggacggcgtggtgctgtgccacctggtgaaccacatcagacccagaagcgtggccagcatccacgtgcccagccccgccgtgcccaagctgagcatggccaagtgcagaagaaacgtggagaacttcctggaggcctgcagaaagctgggcgtgcccgaggagaagctgtgcctgccccaccacatcctggaggagaagggcctggtgaaggtgggcatcaccatccaggccctgctggacatcaccgtgaccaaggccctgttcacctag

SEQ ID NO: 86796 - DNA, 2187 bp, Artificial Sequence
  Description of Artificial Sequence: Synthetic coding sequence
atggccacccccggcagcgagccccagcccttcgtgcccgccctgagcgtggccaccctgcaccccctgcaccacccccaccaccaccaccaccaccaccagcaccacggcggcaccggcgcccccggcggcgccggcggcggcggcggcggcagcggcggcttcaacctgcccctgaacagaggcctggagagagccctggaggaggccgccaacagcggcggcctgaacctgagcgccagaaagctgaaggagttccccagaaccgccgcccccggccacgacctgagcgacaccgtgcaggccgacctgagcaagaacagactggtggaggtgcccatggagctgtgccacttcgtgagcctggagatcctgaacctgtaccacaactgcatcagagtgatccccgaggccatcgtgaacctgcagatgctgacctacctgaacctgagcagaaaccagctgagcgccctgcccgcctgcctgtgcggcctgcccctgaaggtgctgatcgccagcaacaacaagctgggcagcctgcccgaggagatcggccagctgaagcagctgatggagctggacgtgagctgcaacgagatcaccgccctgccccagcagatcggccagctgaagagcctgagagagctgaacgtgagaagaaactacctgaaggtgctgccccaggagctggtggacctgagcctggtgaagttcgacttcagctgcaacaaggtgctggtgatccccatctgcttcagagagatgaagcagctgcaggtgctgctgctggagaacaaccccctgcagagcccccccgcccagatctgcaccaagggcaaggtgcacatcttcaagtacctgagcatccaggcctgccagatcaagaccgccgacagcctgtacctgcacaccatggagagaccccacctgcaccagcacgtggaggacggcaagaaggacagcgacagcggcgtgggcagcgacaacggcgacaagagactgagcgccaccgagcccagcgacgaggacaccgtgagcctgaacgtgcccatgagcaacatcatggaggaggagcagatcatcaaggaggacagctgccacagactgagccccgtgaagggcgagttccaccaggagttccagcccgagcccagcctgctgggcgacagcaccaacagcggcgaggagagagaccagttcaccgacagagccgacggcctgcacagcgagttcatgaactacaaggccagagccgaggactgcgaggagctgctgagaatcgaggaggacgtgcactggcagaccgagggcatcatcagcagcagcaaggaccaggacatggacatcgccatgatcgagcagctgagagaggccgtggacctgctgcaggaccccaacggcctgagcaccgacatcaccgagagaagcgtgctgaacctgtaccccatgggcagcgccgaggccctggagctgcaggacagcgccctgaacggccagatccagctggagaccagccccgtgtgcgaggtgcagagcgacctgaccctgcagagcaacggcagccagtacagccccaacgagatcagagagaacagccccgccgtgagccccaccaccaacagcaccgcccccttcggcctgaagcccagaagcgtgttcctgagaccccagagaaacctggagagcatcgacccccagttcaccatcagaagaaagatggagcagatgagagaggagaaggagctggtggagcagctgagagagagcatcgagatgagactgaaggtgagcctgcacgaggacctgggcgccgccctgatggacggcgtggtgctgtgccacctggtgaaccacatcagacccagaagcgtggccagcatccacgtgcccagccccgccgtgcccaagctgagcatggccaagtgcagaagaaacgtggagaacttcctggaggcctgcagaaagctgggcgtgcccgaggccgacctgtgcagcccctgcgacatcctgcagctggacttcagacacatcagaaagaccgtggacaccctgctggccctgggcgagaaggcccccccccccaccagcgccctgagaagcagagacctgatcggcttctgcctggtgcacatcctgttcatcgtgctggtgtacatcacctaccactggaacgccctgagcgcctag

SEQ ID NO: 86797 - DNA, 2292 bp, Artificial Sequence
  Description of Artificial Sequence: Synthetic coding sequence
atggccacccccggcagcgagccccagcccttcgtgcccgccctgagcgtggccaccctgcaccccctgcaccacccccaccaccaccaccaccaccaccagcaccacggcggcaccggcgcccccggcggcgccggcggcggcggcggcggcagcggcggcttcaacctgcccctgaacagaggcctggagagagccctggaggaggccgccaacagcggcggcctgaacctgagcgccagaaagctgaaggagttccccagaaccgccgcccccggccacgacctgagcgacaccgtgcaggccgacctgagcaagaacagactggtggaggtgcccatggagctgtgccacttcgtgagcctggagatcctgaacctgtaccacaactgcatcagagtgatccccgaggccatcgtgaacctgcagatgctgacctacctgaacctgagcagaaaccagctgagcgccctgcccgcctgcctgtgcggcctgcccctgaaggtgctgatcgccagcaacaacaagctgggcagcctgcccgaggagatcggccagctgaagcagctgatggagctggacgtgagctgcaacgagatcaccgccctgccccagcagatcggccagctgaagagcctgagagagctgaacgtgagaagaaactacctgaaggtgctgccccaggagctggtggacctgagcctggtgaagttcgacttcagctgcaacaaggtgctggtgatccccatctgcttcagagagatgaagcagctgcaggtgctgctgctggagaacaaccccctgcagagcccccccgcccagatctgcaccaagggcaaggtgcacatcttcaagtacctgagcatccaggcctgccagatcaagaccgccgacagcctgtacctgcacaccatggagagaccccacctgcaccagcacgtggaggacggcaagaaggacagcgacagcggcgtgggcagcgacaacggcgacaagagactgagcgccaccgagcccagcgacgaggacaccgtgagcctgaacgtgcccatgagcaacatcatggaggaggagcagatcatcaaggaggacagctgccacagactgagccccgtgaagggcgagttccaccaggagttccagcccgagcccagcctgctgggcgacagcaccaacagcggcgaggagagagaccagttcaccgacagagccgacggcctgcacagcgagttcatgaactacaaggccagagccgaggactgcgaggagctgctgagaatcgaggaggacgtgcactggcagaccgagggcatcatcagcagcagcaaggaccaggacatggacatcgccatgatcgagcagctgagagaggccgtggacctgctgcaggaccccaacggcctgagcaccgacatcaccgagagaagcgtgctgaacctgtaccccatgggcagcgccgaggccctggagctgcaggacagcgccctgaacggccagatccagctggagaccagccccgtgtgcgaggtgcagagcgacctgaccctgcagagcaacggcagccagtacagccccaacgagatcagagagaacagccccgccgtgagccccaccaccaacagcaccgcccccttcggcctgaagcccagaagcgaccccgccctgatcctgccccccatcagcttcaacaccctgacccaggcccagacctgggacagcagcagctacagcgtgcccagcgagggcgacagcgacaacgtgttcctgagaccccagagaaacctggagagcatcgacccccagttcaccatcagaagaaagatggagcagatgagagaggagaaggagctggtggagcagctgagagagagcatcgagatgagactgaaggtgagcctgcacgaggacctgggcgccgccctgatggacggcgtggtgctgtgccacctggtgaaccacatcagacccagaagcgtggccagcatccacgtgcccagccccgccgtgcccaagctgagcatggccaagtgcagaagaaacgtggagaacttcctggaggcctgcagaaagctgggcgtgcccgaggccgacctgtgcagcccctgcgacatcctgcagctggacttcagacacatcagaaagaccgtggacaccctgctggccctgggcgagaaggcccccccccccaccagcgccctgagaagcagagacctgatcggcttctgcctggtgcacatcctgttcatcgtgctggtgtacatcacctaccactggaacgccctgagcgcctag

SEQ ID NO: 86798 - DNA, 3282 bp, Artificial Sequence
  Description of Artificial Sequence: Synthetic coding sequence
atggccagacccgtgagaggcggcctgggcgcccccagaagaagcccctgcctgctgctgctgtggctgctgctgctgagactggagcccgtgaccgccgccgccggccccagagccccctgcgccgccgcctgcacctgcgccggcgacagcctggactgcggcggcagaggcctggccgccctgcccggcgacctgcccagctggaccagaagcctgaacctgagctacaacaagctgagcgagatcgaccccgccggcttcgaggacctgcccaacctgcaggaggtgtacctgaacaacaacgagctgaccgccgtgcccagcctgggcgccgccagcagccacgtggtgagcctgttcctgcagcacaacaagatcagaagcgtggagggcagccagctgaaggcctacctgagcctggaggtgctggacctgagcctgaacaacatcaccgaggtgagaaacacctgcttcccccacggcccccccatcaaggagctgaacctggccggcaacagaatcggcaccctggagctgggcgccttcgacggcctgagcagaagcctgctgaccctgagactgagcaagaacagaatcacccagctgcccgtgagagccttcaagctgcccagactgacccagctggacctgaacagaaacagaatcagactgatcgagggcctgaccttccagggcctgaacagcctggaggtgctgaagctgcagagaaacaacatcagcaagctgaccgacggcgccttctggggcctgagcaagatgcacgtgctgcacctggagtacaacagcctggtggaggtgaacagcggcagcctgtacggcctgaccgccctgcaccagctgcacctgagcaacaacagcatcgccagaatccacagaaagggctggagcttctgccagaagctgcacgagctggtgctgagcttcaacaacctgaccagactggacgaggagagcctggccgagctgagcagcctgagcgtgctgagactgagccacaacagcatcagccacatcgccgagggcgccttcaagggcctgagaagcctgagagtgctggacctggaccacaacgagatcagcggcaccatcgaggacaccagcggcgccttcagcggcctggacagcctgagcaagctgaccctgttcggcaacaagatcaagagcgtggccaagagagccttcagcggcctggagggcctggagcacctgaacctgggcggcaacgccatcagaagcgtgcagttcgacgccttcgtgaagatgaagaacctgaaggagctgcacatcagcagcgacagcttcctgtgcgactgccagctgaagtggctgcccccctggctgatcggcagaatgctgcaggccttcgtgaccgccacctgcgcccaccccgagagcctgaagggccagagcatcttcagcgtgccccccgagagcttcgtgtgcgacgacttcctgaagccccagatcatcacccagcccgagaccaccatggccatggtgggcaaggacatcagattcacctgcagcgccgccagcagcagcagcagccccatgaccttcgcctggaagaaggacaacgaggtgctgaccaacgccgacatggagaacttcgtgcacgtgcacgcccaggacggcgaggtgatggagtacaccaccatcctgcacctgagacaggtgaccttcggccacgagggcagataccagtgcgtgatcaccaaccacttcggcagcacctacagccacaaggccagactgaccgtgaacgtgctgcccagcttcaccaagaccccccacgacatcaccatcagaaccaccaccatggccagactggagtgcgccgccaccggccaccccaacccccagatcgcctggcagaaggacggcggcaccgacttccccgccgccagagagagaagaatgcacgtgatgcccgacgacgacgtgttcttcatcaccgacgtgaagatcgacgacgccggcgtgtacagctgcaccgcccagaacagcgccggcagcatcagcgccaacgccaccctgaccgtgctggagacccccagcctggtggtgcccctggaggacagagtggtgagcgtgggcgagaccgtggccctgcagtgcaaggccaccggcaaccccccccccagaatcacctggttcaagggcgacagacccctgagcctgaccgagagacaccacctgacccccgacaaccagctgctggtggtgcagaacgtggtggccgaggacgccggcagatacacctgcgagatgagcaacaccctgggcaccgagagagcccacagccagctgagcgtgctgcccgccgccggctgcagaaaggacggcaccaccgtgggcatcttcaccatcgccgtggtgagcagcatcgtgctgaccagcctggtgtgggtgtgcatcatctaccagaccagaaagaagagcgaggagtacagcgtgaccaacaccgacgagaccgtggtgccccccgacgtgcccagctacctgagcagccagggcaccctgagcgacagacaggagaccgtggtgagaaccgagggcggcccccaggccaacggccacatcgagagcaacggcgtgtgccccagagacgccagccacttccccgagcccgacacccacagcgtggcctgcagacagcccaagctgtgcgccggcagcgcctaccacaaggagccctggaaggccatggagaaggccgagggcacccccggcccccacaagatggagcacggcggcagagtggtgtgcagcgactgcaacaccgaggtggactgctacagcagaggccaggccttccacccccagcccgtgagcagagacagcgcccagcccagcgcccccaacggccccgagcccggcggcagcgaccaggagcacagcccccaccaccagtgcagcagaaccgccgccggcagctgccccgagtgccagggcagcctgtaccccagcaaccacgacagaatgctgaccgccgtgaagaagaagcccatggccagcctggacggcaagggcgacagcagctggaccctggccagactgtaccaccccgacagcaccgagctgcagcccgccagcagcctgaccagcggcagccccgagagagccgaggcccagtacctgctggtgagcaacggccacctgcccaaggcctgcgacgccagccccgagagcacccccctgaccggccagctgcccggcaagcagagagtgcccctgctgctggcccccaagagctag

SEQ ID NO: 86799 - DNA, 2991 bp, Artificial Sequence
  Description of Artificial Sequence: Synthetic coding sequence
aacctgagctacaacaagctgagcgagatcgaccccgccggcttcgaggacctgcccaacctgcaggaggtgtacctgaacaacaacgagctgaccgccgtgcccagcctgggcgccgccagcagccacgtggtgagcctgttcctgcagcacaacaagatcagaagcgtggagggcagccagctgaaggcctacctgagcctggaggtgctggacctgagcctgaacaacatcaccgaggtgagaaacacctgcttcccccacggcccccccatcaaggagctgaacctggccggcaacagaatcggcaccctggagctgggcgccttcgacggcctgagcagaagcctgctgaccctgagactgagcaagaacagaatcacccagctgcccgtgagagccttcaagctgcccagactgacccagctggacctgaacagaaacagaatcagactgatcgagggcctgaccttccagggcctgaacagcctggaggtgctgaagctgcagagaaacaacatcagcaagctgaccgacggcgccttctggggcctgagcaagatgcacgtgctgcacctggagtacaacagcctggtggaggtgaacagcggcagcctgtacggcctgaccgccctgcaccagctgcacctgagcaacaacagcatcgccagaatccacagaaagggctggagcttctgccagaagctgcacgagctggtgctgagcttcaacaacctgaccagactggacgaggagagcctggccgagctgagcagcctgagcgtgctgagactgagccacaacagcatcagccacatcgccgagggcgccttcaagggcctgagaagcctgagagtgctggacctggaccacaacgagatcagcggcaccatcgaggacaccagcggcgccttcagcggcctggacagcctgagcaagctgaacctgggcggcaacgccatcagaagcgtgcagttcgacgccttcgtgaagatgaagaacctgaaggagctgcacatcagcagcgacagcttcctgtgcgactgccagctgaagtggctgcccccctggctgatcggcagaatgctgcaggccttcgtgaccgccacctgcgcccaccccgagagcctgaagggccagagcatcttcagcgtgccccccgagagcttcgtgtgcgacgacttcctgaagccccagatcatcacccagcccgagaccaccatggccatggtgggcaaggacatcagattcacctgcagcgccgccagcagcagcagcagccccatgaccttcgcctggaagaaggacaacgaggtgctgaccaacgccgacatggagaacttcgtgcacgtgcacgcccaggacggcgaggtgatggagtacaccaccatcctgcacctgagacaggtgaccttcggccacgagggcagataccagtgcgtgatcaccaaccacttcggcagcacctacagccacaaggccagactgaccgtgaacgtgctgcccagcttcaccaagaccccccacgacatcaccatcagaaccaccaccatggccagactggagtgcgccgccaccggccaccccaacccccagatcgcctggcagaaggacggcggcaccgacttccccgccgccagagagagaagaatgcacgtgatgcccgacgacgacgtgttcttcatcaccgacgtgaagatcgacgacgccggcgtgtacagctgcaccgcccagaacagcgccggcagcatcagcgccaacgccaccctgaccgtgctggagacccccagcctggtggtgcccctggaggacagagtggtgagcgtgggcgagaccgtggccctgcagtgcaaggccaccggcaaccccccccccagaatcacctggttcaagggcgacagacccctgagcctgaccgagagacaccacctgacccccgacaaccagctgctggtggtgcagaacgtggtggccgaggacgccggcagatacacctgcgagatgagcaacaccctgggcaccgagagagcccacagccagctgagcgtgctgcccgccgccggctgcagaaaggacggcaccaccgtgggcatcttcaccatcgccgtggtgagcagcatcgtgctgaccagcctggtgtgggtgtgcatcatctaccagaccagaaagaagagcgaggagtacagcgtgaccaacaccgacgagaccgtggtgccccccgacgtgcccagctacctgagcagccagggcaccctgagcgacagacaggagaccgtggtgagaaccgagggcggcccccaggccaacggccacatcgagagcaacggcgtgtgccccagagacgccagccacttccccgagcccgacacccacagcgtggcctgcagacagcccaagctgtgcgccggcagcgcctaccacaaggagccctggaaggccatggagaaggccgagggcacccccggcccccacaagatggagcacggcggcagagtggtgtgcagcgactgcaacaccgaggtggactgctacagcagaggccaggccttccacccccagcccgtgagcagagacagcgcccagcccagcgcccccaacggccccgagcccggcggcagcgaccaggagcacagcccccaccaccagtgcagcagaaccgccgccggcagctgccccgagtgccagggcagcctgtaccccagcaaccacgacagaatgctgaccgccgtgaagaagaagcccatggccagcctggacggcaagggcgacagcagctggaccctggccagactgtaccaccccgacagcaccgagctgcagcccgccagcagcctgaccagcggcagccccgagagagccgaggcccagtacctgctggtgagcaacggccacctgcccaaggcctgcgacgccagccccgagagcacccccctgaccggccagctgcccggcaagcagagagtgcccctgctgctggcccccaagagctag

SEQ ID NO: 86800 - DNA, 3213 bp, Artificial Sequence
  Description of Artificial Sequence: Synthetic coding sequence
atggccagacccgtgagaggcggcctgggcgcccccagaagaagcccctgcctgctgctgctgtggctgctgctgctgagactggagcccgtgaccgccgccgccggccccagagccccctgcgccgccgcctgcacctgcgccggcgacagcctggactgcggcggcagaggcctggccgccctgcccggcgacctgcccagctggaccagaagcctgaacctgagctacaacaagctgagcgagatcgaccccgccggcttcgaggacctgcccaacctgcaggaggtgtacctgaacaacaacgagctgaccgccgtgcccagcctgggcgccgccagcagccacgtggtgagcctgttcctgcagcacaacaagatcagaagcgtggagggcagccagctgaaggcctacctgagcctggaggtgctggacctgagcctgaacaacatcaccgaggtgagaaacacctgcttcccccacggcccccccatcaaggagctgaacctggccggcaacagaatcggcaccctggagctgggcgccttcgacggcctgagcagaagcctgctgaccctgagactgagcaagaacagaatcacccagctgcccgtgagagccttcaagctgcccagactgacccagctggacctgaacagaaacagaatcagactgatcgagggcctgaccttccagggcctgaacagcctggaggtgctgaagctgcagagaaacaacatcagcaagctgaccgacggcgccttctggggcctgagcaagatgcacgtgctgcacctggagtacaacagcctggtggaggtgaacagcggcagcctgtacggcctgaccgccctgcaccagctgcacctgagcaacaacagcatcgccagaatccacagaaagggctggagcttctgccagaagctgcacgagctggtgctgagcttcaacaacctgaccagactggacgaggagagcctggccgagctgagcagcctgagcgtgctgagactgagccacaacagcatcagccacatcgccgagggcgccttcaagggcctgagaagcctgagagtgctggacctggaccacaacgagatcagcggcaccatcgaggacaccagcggcgccttcagcggcctggacagcctgagcaagctgctgctgctggagcccagccagagcgccggctgcagcagccccagccagccccacatgagcgccggcggcagaaccctgttcggcaacaagatcaagagcgtggccaagagagccttcagcggcctggagggcctggagcacctgaacctgggcggcaacgccatcagaagcgtgcagttcgacgccttcgtgaagatgaagaacctgaaggagctgcacatcagcagcgacagcttcctgtgcgactgccagctgaagtggctgcccccctggctgatcggcagaatgctgcaggccttcgtgaccgccacctgcgcccaccccgagagcctgaagggccagagcatcttcagcgtgccccccgagagcttcgtgtgcgacgacttcctgaagccccagatcatcacccagcccgagaccaccatggccatggtgggcaaggacatcagattcacctgcagcgccgccagcagcagcagcagccccatgaccttcgcctggaagaaggacaacgaggtgctgaccaacgccgacatggagaacttcgtgcacgtgcacgcccaggacggcgaggtgatggagtacaccaccatcctgcacctgagacaggtgaccttcggccacgagggcagataccagtgcgtgatcaccaaccacttcggcagcacctacagccacaaggccagactgaccgtgaacgtgctgcccagcttcaccaagaccccccacgacatcaccatcagaaccaccaccatggccagactggagtgcgccgccaccggccaccccaacccccagatcgcctggcagaaggacggcggcaccgacttccccgccgcccagacccccagcctggtggtgcccctggaggacagagtggtgagcgtgggcgagaccgtggccctgcagtgcaaggccaccggcaaccccccccccagaatcacctggttcaagggcgacagacccctgagcctgaccgagagacaccacctgacccccgacaaccagctgctggtggtgcagaacgtggtggccgaggacgccggcagatacacctgcgagatgagcaacaccctgggcaccgagagagcccacagccagctgagcgtgctgcccgccgccggctgcagaaaggacggcaccaccgtgggcatcttcaccatcgccgtggtgagcagcatcgtgctgaccagcctggtgtgggtgtgcatcatctaccagaccagaaagaagagcgaggagtacagcgtgaccaacaccgacgagaccgtggtgccccccgacgtgcccagctacctgagcagccagggcaccctgagcgacagacaggagaccgtggtgagaaccgagggcggcccccaggccaacggccacatcgagagcaacggcgtgtgccccagagacgccagccacttccccgagcccgacacccacagcgtggcctgcagacagcccaagctgtgcgccggcagcgcctaccacaaggagccctggaaggccatggagaaggccgagggcacccccggcccccacaagatggagcacggcggcagagtggtgtgcagcgactgcaacaccgaggtggactgctacagcagaggccaggccttccacccccagcccgtgagcagagacagcgcccagcccagcgcccccaacggccccgagcccggcggcagcgaccaggagcacagcccccaccaccagtgcagcagaaccgccgccggcagctgccccgagtgccagggcagcctgtaccccagcaaccacgacagaatgctgaccgccgtgaagaagaagcccatggccagcctggacggcaagggcgacagcagctggaccctggccagactgtaccaccccgacagcaccgagctgcagcccgccagcagcctgaccagcggcagccccgagagagccgaggcccagtacctgctggtgagcaacggccacctgcccaaggcctgcgacgccagccccgagagcacccccctgaccggccagctgcccggcaagcagagagtgcccctgctgctggcccccaagagctag

SEQ ID NO: 86801 - DNA, 3198 bp, Artificial Sequence
  Description of Artificial Sequence: Synthetic coding sequence
atggcccccgcccccctgggcgtgcccgaggagcagctgctgggctgcagaagcagagtgctgagcagactgctgttcatcgcccagaccgccctgctgctgctgcccgccgccggcgccggcctgtgccccgccccctgcagctgcagaatccccctgctggactgcagcagaagaaagctgcccgcccccagctggagagccctgagcggcctgctgccccccgacaccgccatcctggacttcagccacaacagactgagcaactggaacatcagcctggagagccagaccctgcaggaggtgaagatgaactacaacgagctgaccgagatcccctacttcggcgagcccaccagcaacatcaccctgctgagcctggtgcacaacatcatccccgagatcaacgcccaggccctgcagttctaccccgccctggagagcctggacctgagcagcaacatcatcagcgagatcaagaccagcagcttccccagaatgcagctgaagtacctgaacctgagcaacaacagaatcaccaccctggaggccggctgcttcgacaacctgagcagcagcctgctggtggtgaagctgaacagaaacagaatgagcatgatcccccccaagatcttcaagctgccccacctgcagttcctggagctgaagagaaacagaatcaagatcgtggagggcctgaccttccagggcctggacagcctgagaagcctgaagatgcagagaaacggcatcagcaagctgaaggacggcgccttcttcggcctgaacaacatggaggagctggagctggagcacaacaacctgaccagagtgaacaagggctggctgtacggcctgagaatgctgcagcagctgtacgtgagccagaacgccatcgagagaatcagccccgacgcctgggagttctgccagagactgagcgagctggacctgagctacaaccagctgaccagactggacgagagcgccttcgtgggcctgagcctgctggagagactgaacctgggcgacaacagagtgacccacatcgccgacggcgtgttcagattcctgagcaacctgcagaccctggacctgagaaacaacgagatcagctgggccatcgaggacgccagcgaggccttcgccggcctgaccagcctgaccaagctgatcctgcagggcaaccagatcaagagcatcaccaagaaggccttcatcggcctggagagcctggagcacctggacctgaacaacaacgccatcatgagcatccaggagaacgccttcagccagacccacctgaaggagctgatcctgaacaccagcagcctgctgtgcgactgccacctgaagtggctgctgcagtggctggtggacaacaacttccagcacagcgtgaacgtgagctgcgcccaccccgagtggctggccggccagagcatcctgaacgtggacctgaaggacttcgtgtgcgacgacttcctgaagccccagatcagaacccaccccgagaccatcatcgccctgagaggcatgaacgtgaccctgacctgcaccgccgtgagcagcagcgacagccccatgagcaccgtgtggagaaaggacagcgagatcctgtacgacgtggacaccgagaacttcgtgagatactggcagcaggccggcgaggccctggagtacaccagcatcctgcacctgttcaacgtgaacttcaccgacgagggcaagtaccagtgcatcgtgaccaaccacttcggcagcaactacagccagaaggccaagctgaccgtgaacgagatgcccagcttcctgaagacccccatggacctgaccatcagaaccggcgccatggccagactggagtgcgccgccgagggccaccccgccccccagatcagctggcagaaggacggcggcaccgacttccccgccgccagagagagaagaatgcacgtgatgcccgaggacgacgtgttcttcatcgccaacgtgaagatcgaggacatgggcatctacagctgcatggcccagaacaccgccggcggcctgagcgccaacgccagcctgaccgtgctggagacccccagcttcatcagacccctggaggacaagaccgtgaccagaggcgagaccgccgtgctgcagtgcatcgccggcggcagccccgcccccagactgaactggaccaaggacgacggccccctgctggtgaccgagagacacttcttcgccgccgccaaccagctgctgatcatcgtggacgccggcctggaggacgccggcaagtacacctgcatcatgagcaacaccctgggcaccgagagaggccacatctacctgaacgtgatcagcagccccaactgcgacagcagccagagcagcatcggccacgaggacgacggctggaccaccgtgggcatcgtgatcatcgtggtggtgtgctgcgtggtgggcaccagcctgatctgggtgatcgtgatctaccacatgagaagaaagaacgaggactacagcatcaccaacaccgaggagctgaacctgcccgccgacatccccagctacctgagcagccagggcaccctgagcgagccccaggagggctacagcaacagcgaggccggcagccaccagcagctgatgccccccgccaacggctacatccacaagggcaccgacggcggcaccggcaccagagtgatctgcagcgactgctacgacaacgccaacatctacagcagaaccagagagtactgcccctacacctacatcgccgaggaggacgtgctggaccagaccctgagcagcctgatggtgcagatgcccaaggagacctacctggtgcaccccccccaggacaccaccgccctggagagcctgatccccagcgccaacagagagcccagcgccttccccaccaaccacgagagaatcagcgagaagaagctgcccagcacccagatgagcggcgagaccctgcagagacccgtgtggaacatcaacagagagctgggcctgccccacccccccttcagccagcagcccgtgcacgagagcccccagctgcaccagaacgagggcctggccggcagagagcccgactgcagcgccagcagcatgagctgccacagactgcaggaccacgccttcgacttcagcagaaccagaaacatccaggacggcagcgagggcacctag

SEQ ID NO: 86802 - DNA, 876 bp, Artificial Sequence
  Description of Artificial Sequence: Synthetic coding sequence
atggagagcgagagaagcaagagaatgggcaacgcctgcatccccctgaagagaatcgcctacttcctgtgcctgctgagcgccctgctgctgaccgagggcaagaagcccgccaagcccaagtgccccgccgtgtgcacctgcaccaaggacaacgccctgtgcgagaacgccagaagcatccccagaaccgtgccccccgacgtgatcagcctgagcttcgtgagaagcggcttcaccgagatcagcgagggcagcttcctgttcacccccagcctgcagctgctgctgttcaccagcaacagcttcgacgtgatcagcgacgacgccttcatcggcctgccccacctggagtacctgttcatcgagaacaacaacatcaagagcatcagcagacacaccttcagaggcctgaagagcctgatccacctgagcctggccaacaacaacctgcagaccctgcccaaggacatcttcaagggcctggacagcctgaccaacgtggacctgagaggcaacagcttcaactgcgactgcaagctgaagtggctggtggagtggctgggccacaccaacgccaccgtggaggacatctactgcgagggcccccccgagtacaagaagagaaagatcaacagcctgagcagcaaggacttcgactgcatcatcaccgagttcgccaagagccaggacctgccctaccagagcctgagcatcgacaccttcagctacctgaacgacgagtacgtggtgatcgcccagcccttcaccggcaagtgcatcttcctggagtgggaccacgtggagaagaccttcagaaactacgacaacatcaccgtgctgagagagatccacagattcaccaacatgagctag

SEQ ID NO: 86803 - DNA, 1674 bp, Artificial Sequence
  Description of Artificial Sequence: Synthetic coding sequence
atggagagcgagagaagcaagagaatgggcaacgcctgcatccccctgaagagaatcgcctacttcctgtgcctgctgagcgccctgctgctgaccgagggcaagaagcccgccaagcccaagtgccccgccgtgtgcacctgcaccaaggacaacgccctgtgcgagaacgccagaagcatccccagaaccgtgccccccgacgtgatcagcctgagcttcgtgagaagcggcttcaccgagatcagcgagggcagcttcctgttcacccccagcctgcagctgctgctgttcaccagcaacagcttcgacgtgatcagcgacgacgccttcatcggcctgccccacctggagtacctgttcatcgagaacaacaacatcaagagcatcagcagacacaccttcagaggcctgaagagcctgatccacctgagcctggccaacaacaacctgcagaccctgcccaaggacatcttcaagggcctggacagcctgaccaacgtggacctgagaggcaacagcttcaactgcgactgcaagctgaagtggctggtggagtggctgggccacaccaacgccaccgtggaggacatctactgcgagggcccccccgagtacaagaagagaaagatcaacagcctgagcagcaaggacttcgactgcatcatcaccgagttcgccaagagccaggacctgccctaccagagcctgagcatcgacaccttcagctacctgaacgacgagtacgtggtgatcgcccagcccttcaccggcaagtgcatcttcctggagtgggaccacgtggagaagaccttcagaaactacgacaacatcaccggcaccagcaccgtggtgtgcaagcccatcgtgatcgagacccagctgtacgtgatcgtggcccagctgttcggcggcagccacatctacaagagagacagcttcgccaacaagttcatcaagatccaggacatcgagatcctgaagatcagaaagcccaacgacatcgagaccttcaagatcgagaacaactggtacttcgtggtggccgacagcagcaaggccggcttcaccaccatctacaagtggaacggcaacggcttctacagccaccagagcctgcacgcctggtacagagacaccgacgtggagtacctggagatcgtgagaaccccccagaccctgagaaccccccacctgatcctgagcagcagcagccagagacccgtgatctaccagtggaacaaggccacccagctgttcaccaaccagaccgacatccccaacatggaggacgtgtacgccgtgaagcacttcagcgtgaagggcgacgtgtacatctgcctgaccagattcatcggcgacagcaaggtgatgaagtggggcggcagcagcttccaggacatccagagaatgcccagcagaggcagcatggtgttccagcccctgcagatcaacaactaccagtacgccatcctgggcagcgactacagcttcacccaggtgtacaactgggacgccgagaaggccaagttcgtgaagttccaggagctgaacgtgcaggcccccagaagcttcacccacgtgagcatcaacaagagaaacttcctgttcgccagcagcttcaagggcaacacccagatctacaagcacgtgatcgtggacctgagcgcctag

SEQ ID NO: 86804 - DNA, 1530 bp, Artificial Sequence
  Description of Artificial Sequence: Synthetic coding sequence
atggagagcgagagaagcaagagaatgggcaacgcctgcatccccctgaagagaatcgcctacttcctgtgcctgctgagcgccctgctgctgaccgagggcaagaagcccgccaagcccaagtgccccgccgtgtgcacctgcaccaaggacaacgccctgtgcgagaacgccagaagcatccccagaaccgtgccccccgacgtgatcagcctgagcttcgtgagaagcggcttcaccgagatcagcgagggcagcttcctgttcacccccagcctgcagctgctgagcctggccaacaacaacctgcagaccctgcccaaggacatcttcaagggcctggacagcctgaccaacgtggacctgagaggcaacagcttcaactgcgactgcaagctgaagtggctggtggagtggctgggccacaccaacgccaccgtggaggacatctactgcgagggcccccccgagtacaagaagagaaagatcaacagcctgagcagcaaggacttcgactgcatcatcaccgagttcgccaagagccaggacctgccctaccagagcctgagcatcgacaccttcagctacctgaacgacgagtacgtggtgatcgcccagcccttcaccggcaagtgcatcttcctggagtgggaccacgtggagaagaccttcagaaactacgacaacatcaccggcaccagcaccgtggtgtgcaagcccatcgtgatcgagacccagctgtacgtgatcgtggcccagctgttcggcggcagccacatctacaagagagacagcttcgccaacaagttcatcaagatccaggacatcgagatcctgaagatcagaaagcccaacgacatcgagaccttcaagatcgagaacaactggtacttcgtggtggccgacagcagcaaggccggcttcaccaccatctacaagtggaacggcaacggcttctacagccaccagagcctgcacgcctggtacagagacaccgacgtggagtacctggagatcgtgagaaccccccagaccctgagaaccccccacctgatcctgagcagcagcagccagagacccgtgatctaccagtggaacaaggccacccagctgttcaccaaccagaccgacatccccaacatggaggacgtgtacgccgtgaagcacttcagcgtgaagggcgacgtgtacatctgcctgaccagattcatcggcgacagcaaggtgatgaagtggggcggcagcagcttccaggacatccagagaatgcccagcagaggcagcatggtgttccagcccctgcagatcaacaactaccagtacgccatcctgggcagcgactacagcttcacccaggtgtacaactgggacgccgagaaggccaagttcgtgaagttccaggagctgaacgtgcaggcccccagaagcttcacccacgtgagcatcaacaagagaaacttcctgttcgccagcagcttcaagggcaacacccagatctacaagcacgtgatcgtggacctgagcgcctag

SEQ ID NO: 86805 - DNA, 777 bp, Artificial Sequence
  Description of Artificial Sequence: Synthetic coding sequence
atgagcgcctaccccaagagctacaaccccttcgacgacgacggcgaggacgagggcgccagacccgccccctggagagacgccagagacctgcccgacggccccgacgcccccgccgacagacagcagtacctgagacaggaggtgctgagaagagccgaggccaccgccgccagcaccagcagaagcctggccctgatgtacgagagcgagaaggtgggcgtggccagcagcgaggagctggccagacagagaggcgtgctggagagaaccgagaagatggtggacaagatggaccaggacctgaagatcagccagaagcacatcaacagcatcaagagcgtgttcggcggcctggtgaactacttcaagagcaagcccgtggagaccccccccgagcagaacggcaccctgaccagccagcccaacaacagactgaaggaggccatcagcaccagcaaggagcaggaggccaagtaccaggccagccaccccaacctgagaaagctggacgacaccgaccccgtgcccagaggcgccggcagcgccatgagcaccgacgcctaccccaagaacccccacctgagagcctaccaccagaagatcgacagcaacctggacgagctgagcatgggcctgggcagactgaaggacatcgccctgggcatgcagaccgagatcgaggagcaggacgacatcctggacagactgaccaccaaggtggacaagctggacgtgaacatcaagagcaccgagagaaaggtgagacagctgtag

SEQ ID NO: 86806 - DNA, 2466 bp, Artificial Sequence
  Description of Artificial Sequence: Synthetic coding sequence
atggccggccccggcagcaccggcggccagatcggcgccgccgccctggccggcggcgccagaagcaaggtggcccccagcgtggacttcgaccacagctgcagcgacagcgtggagtacctgaccctgaacttcggccccttcgagaccgtgcacagatggagaagactgcccccctgcgacgagttcgtgggcgccagaagaagcaagcacaccgtggtggcctacaaggacgccatctacgtgttcggcggcgacaacggcgccttcaccaccggcaccccccccgcccccagataccaccacagcgccgtggtgtacggcagcagcatgttcgtgttcggcggctacaccggcgacatctacagcaacagcaacctgaagaacaagaacgacctgttcgagtacaagttcgccaccggccagtggaccgagtggaagatcgagggcagactgcccgtggccagaagcgcccacggcgccaccgtgtacagcgacaagctgtggatcttcgccggctacgacggcaacgccagactgaacgacatgtggaccatcggcctgcaggacagagagctgacctgctgggaggaggtggcccagagcggcgagatcccccccagctgctgcaacttccccgtggccgtgtgcagagacaagatgttcgtgttcagcggccagagcggcgccaagatcaccaacaacctgttccagttcgagttcaaggacaagacctggaccagaatccccaccgagcacctgctgagaggcagccccccccccccccagagaagatacggccacaccatggtggccttcgacagacacctgtacgtgttcggcggcgccgccgacaacaccctgcccaacgagctgcactgctacgacgtggacttccagacctgggaggtggtgcagcccagcagcgacagcgaggtgggcggcgccgaggtgcccgagagagcctgcgccagcgaggaggtgcccaccctgacctacgaggagagagtgggcttcaagaagagcagagacgtgttcggcctggacttcggcaccaccagcgccaagcagcccacccagcccgccagcgagctgcccagcggcagactgttccacgccgccgccgtgatcagcgacgccatgtacatcttcggcggcaccgtggacaacaacatcagaagcggcgagatgtacagattccagttcagctgctaccccaagtgcaccctgcacgaggactacggcagactgtgggagagcagacagttctgcgacgtggagttcgtgctgggcgagaaggaggagtgcgtgcagggccacgtggccatcgtgaccgccagaagcagatggctgagaagaaagatcacccaggccagagagagactggcccagaagctggagcaggaggccgcccccgtgcccagagaggcccccggcgtggccgccggcggcgccagaccccccctgctgcacgtggccatcagagaggccgaggccagacccttcgaggtgctgatgcagttcctgtacaccgacaagatcaagtaccccagaaagggccacgtggaggacgtgctgctgatcatggacgtgtacaagctggccctgagcttccagctgtgcagactggagcagctgtgcagacagtacatcgaggccagcgtggacctgcagaacgtgctggtggtgtgcgagagcgccgccagactgcagctgagccagctgaaggagcactgcctgaacttcgtggtgaaggagagccacttcaaccaggtgatcatgatgaaggagttcgagagactgagcagccccctgatcgtggagatcgtgagaagaaagcagcagcccccccccagaacccccctggaccagcccgtggacatcggcaccagcctgatccaggacatgaaggcctacctggagggcgccggcgccgagttctgcgacatcaccctgctgctggacggccaccccagacccgcccacaaggccatcctggccgccagaagcagctacttcgaggccatgttcagaagcttcatgcccgaggacggccaggtgaacatcagcatcggcgagatggtgcccagcagacaggccttcgagagcatgctgagatacatctactacggcgaggtgaacatgccccccgaggacagcctgtacctgttcgccgccccctactactacggcttctacaacaacagactgcaggcctactgcaagcagaacctggagatgaacgtgaccgtgcagaacgtgctgcagatcctggaggccgccgacaagacccaggccctggacatgaagagacactgcctgcacatcatcgtgcaccagttcaccaaggtgagcaagctgcccaccctgagaagcctgagccagcagctgctgctggacatcatcgacagcctggccagccacatcagcgacaagcagtgcgccgagctgggcgccgacatctag

SEQ ID NO: 86807 - DNA, 2400 bp, Artificial Sequence
  Description of Artificial Sequence: Synthetic coding sequence
atgaactacgaccccatcgtgagcaaggtggccgaggtgctggccagcggcagagccatcagaaagagagaggtggagagaagcaagcacaccgtggtggcctacaaggacgccatctacgtgttcggcggcgacaacggcaagaccatgctgaacgacctgctgagattcgacgtgaaggactgcagctggtgcagagccttcaccaccggcaccccccccgcccccagataccaccacagcgccgtggtgtacggcagcagcatgttcgtgttcggcggctacaccggcgacatctacagcaacagcaacctgaagaacaagaacgacctgttcgagtacaagttcgccaccggccagtggaccgagtggaagatcgagggcagactgcccgtggccagaagcgcccacggcgccaccgtgtacagcgacaagctgtggatcttcgccggctacgacggcaacgccagactgaacgacatgtggaccatcggcctgcaggacagagagctgacctgctgggaggaggtggcccagagcggcgagatcccccccagctgctgcaacttccccgtggccgtgtgcagagacaagatgttcgtgttcagcggccagagcggcgccaagatcaccaacaacctgttccagttcgagttcaaggacaagacctggaccagaatccccaccgagcacctgctgagaggcagccccccccccccccagagaagatacggccacaccatggtggccttcgacagacacctgtacgtgttcggcggcgccgccgacaacaccctgcccaacgagctgcactgctacgacgtggacttccagacctgggaggtggtgcagcccagcagcgacagcgaggtgggcggcgccgaggtgcccgagagagcctgcgccagcgaggaggtgcccaccctgacctacgaggagagagtgggcttcaagaagagcagagacgtgttcggcctggacttcggcaccaccagcgccaagcagcccacccagcccgccagcgagctgcccagcggcagactgttccacgccgccgccgtgatcagcgacgccatgtacatcttcggcggcaccgtggacaacaacatcagaagcggcgagatgtacagattccagttcagctgctaccccaagtgcaccctgcacgaggactacggcagactgtgggagagcagacagttctgcgacgtggagttcgtgctgggcgagaaggaggagtgcgtgcagggccacgtggccatcgtgaccgccagaagcagatggctgagaagaaagatcacccaggccagagagagactggcccagaagctggagcaggaggccgcccccgtgcccagagaggcccccggcgtggccgccggcggcgccagaccccccctgctgcacgtggccatcagagaggccgaggccagacccttcgaggtgctgatgcagttcctgtacaccgacaagatcaagtaccccagaaagggccacgtggaggacgtgctgctgatcatggacgtgtacaagctggccctgagcttccagctgtgcagactggagcagctgtgcagacagtacatcgaggccagcgtggacctgcagaacgtgctggtggtgtgcgagagcgccgccagactgcagctgagccagctgaaggagcactgcctgaacttcgtggtgaaggagagccacttcaaccaggtgatcatgatgaaggagttcgagagactgagcagccccctgatcgtggagatcgtgagaagaaagcagcagcccccccccagaacccccctggaccagcccgtggacatcggcaccagcctgatccaggacatgaaggcctacctggagggcgccggcgccgagttctgcgacatcaccctgctgctggacggccaccccagacccgcccacaaggccatcctggccgccagaagcagctacttcgaggccatgttcagaagcttcatgcccgaggacggccaggtgaacatcagcatcggcgagatggtgcccagcagacaggccttcgagagcatgctgagatacatctactacggcgaggtgaacatgccccccgaggacagcctgtacctgttcgccgccccctactactacggcttctacaacaacagactgcaggcctactgcaagcagaacctggagatgaacgtgaccgtgcagaacgtgctgcagatcctggaggccgccgacaagacccaggccctggacatgaagagacactgcctgcacatcatcgtgcaccagttcaccaaggtgagcaagctgcccaccctgagaagcctgagccagcagctgctgctggacatcatcgacagcctggccagccacatcagcgacaagcagtgcgccgagctgggcgccgacatctag

SEQ ID NO: 86808 - DNA, 1560 bp, Artificial Sequence; identical to SEQ ID NO: 85808
  Description of Artificial Sequence: Synthetic coding sequence

SEQ ID NO: 86809 - DNA, 3036 bp, Artificial Sequence
  Description of Artificial Sequence: Synthetic coding sequence
atgatcgagaacagcatgttcgaggaggagcccgacgtggtggacctggccaaggagccctgcctgcaccccctggagcccgacgaggtggagtacgagcccagaggcagcagactgctggtgagaggcctgggcgagcacgagatggaggaggacgaggaggactacgagagcagcgccaagctgctgggcatgagcttcatgaacagaagcagcggcctgagaaacagcgccaccggctacagacagagccccgacggcgcctgcagcgtgcccagcgccagaaccatggtggtgtgcgccttcgtgatcgtggtggccgtgagcgtgatcatggtgatctacctgctgcccagatgcaccttcaccaaggagggctgccacaagaagaaccagagcatcggcctgatccagcccttcgccaccaacggcaagctgttcccctgggcccagatcagactgcccaccgccgtggtgcccctgagatacgagctgagcctgcaccccaacctgaccagcatgaccttcagaggcagcgtgaccatcagcgtgcaggccctgcaggtgacctggaacatcatcctgcacagcaccggccacaacatcagcagagtgaccttcatgagcgccgtgagcagccaggagaagcaggccgagatcctggagtacgcctaccacggccagatcgccatcgtggcccccgaggccctgctggccggccacaactacaccctgaagatcgagtacagcgccaacatcagcagcagctactacggcttctacggcttcagctacaccgacgagagcaacgagaagaagtacttcgccgccacccagttcgagcccctggccgccagaagcgccttcccctgcttcgacgagcccgccttcaaggccaccttcatcatcaagatcatcagagacgagcagtacaccgccctgagcaacatgcccaagaagagcagcgtggtgctggacgacggcctggtgcaggacgagttcagcgagagcgtgaagatgagcacctacctggtggccttcatcgtgggcgagatgaagaacctgagccaggacgtgaacggcaccctggtgagcatctacgccgtgcccgagaagatcggccaggtgcactacgccctggagaccaccgtgaagctgctggagttcttccagaactacttcgagatccagtaccccctgaagaagctggacctggtggccatccccgacttcgaggccggcgccatggagaactggggcctgctgaccttcagagaggagaccctgctgtacgacagcaacaccagcagcatggccgacagaaagctggtgaccaagatcatcgcccacgagctggcccaccagtggttcggcaacctggtgaccatgaagtggtggaacgacctgtggctgaacgagggcttcgccaccttcatggagtacttcagcctggagaagatcttcaaggagctgagcagctacgaggacttcctggacgccagattcaagaccatgaagaaggacagcctgaacagcagccaccccatcagcagcagcgtgcagagcagcgagcagatcgaggagatgttcgacagcctgagctacttcaagggcagcagcctgctgctgatgctgaagacctacctgagcgaggacgtgttccagcacgccgtggtgctgtacctgcacaaccacagctacgccagcatccagagcgacgacctgtgggacagcttcaacgaggtgaccaaccagaccctggacgtgaagagaatgatgaagacctggaccctgcagaagggcttccccctggtgaccgtgcagaagaagggcaaggagctgttcatccagcaggagagattcttcctgaacatgaagcccgagatccagcccagcgacaccagctacctgtggcacatccccctgagctacgtgaccgagggcagaaactacagcaagtaccagagcgtgagcctgctggacaagaagagcggcgtgatcaacctgaccgaggaggtgctgtgggtgaaggtgaacatcaacatgaacggctactacatcgtgcactacgccgacgacgactgggaggccctgatccaccagctgaagatcaacccctacgtgctgagcgacaaggacagagccaacctgatcaacaacatcttcgagctggccggcctgggcaaggtgcccctgaagagagccttcgacctgatcaactacctgggcaacgagaaccacaccgcccccatcaccgaggccctgttccagaccgacctgatctacaacctgctggagaagctgggctacatggacctggccagcagactggtgaccagagtgttcaagctgctgcagaaccagatccagcagcagacctggaccgacgagggcacccccagcatgagagagctgagaagcgccctgctggagttcgcctgcacccacaacctgggcaactgcagcaccaccgccatgaagctgttcgacgactggatggccagcaacggcacccagagcctgcccaccgacgtgatgaccaccgtgttcaaggtgggcgccaagaccgacaagggctggagcttcctgctgggcaagtacatcagcatcggcagcgaggccgagaagaacaagatcctggaggccctggccagcagcgaggacgtgagaaagctgtactggctgatgaagagcagcctgaacggcgacaacttcagaacccagaagctgagcttcatcatcagaaccgtgggcagacacttccccggccacctgctggcctgggacttcgtgaaggagaactggaacaagctggtgcagaagttccccctgggcagctacaccatccagaacatcgtggccggcagcacctacctgttcagcaccaagacccacctgagcgaggtgcaggccttcttcgagaaccagagcgaggccaccttcagactgagatgcgtgcaggaggccctggaggtgatccagctgaacatccagtggatggagaagaacctgaagagcctgacctggtggctgtag

SEQ ID NO: 86810 - DNA, 3450 bp, Artificial Sequence
  Description of Artificial Sequence: Synthetic coding sequence
atggccgagagaaagggcaccgccaaggtggacttcctgaagaagatcgagaaggagatccagcagaagtgggacaccgagagagtgttcgaggtgaacgccagcaacctggagaagcagaccagcaagggcaagtacttcgtgaccttcccctacccctacatgaacggcagactgcacctgggccacaccttcagcctgagcaagtgcgaggcctgcgccgacaagctgaagagagagatcgagctgtacggctgcccccccgacttccccgacgaggaggaggaggaggaggagaccagcgtgaagaccgaggacatcatcatcaaggacaaggccaagggcaagaagagcaaggccgccgccaaggccggcagcagcaagtaccagtggggcatcatgaagagcctgggcctgagcgacgaggagatcgtgaagttcagcgaggccgagcactggctggactacttcccccccctggccatccaggacctgaagagaatgggcctgaaggtggactggagaagaagcttcatcaccaccgacgtgaacccctactacgacagcttcgtgagatggcagttcctgaccctgagagagagaaacaagatcaagttcggcaagagatacaccatctacagccccaaggacggccagccctgcatggaccacgacagacagaccggcgagggcgtgggcccccaggagtacaccctgctgaagctgaaggtgctggagccctaccccagcaagctgagcggcctgaagggcaagaacatcttcctggtggccgccaccctgagacccgagaccatgttcggccagaccaactgctgggtgagacccgacatgaagtacatcggcttcgagaccgtgaacggcgacatcttcatctgcacccagaaggccgccagaaacatgagctaccagggcttcaccaaggacaacggcgtggtgcccgtggtgaaggagctgatgggcgaggagatcctgggcgccagcctgagcgcccccctgaccagctacaaggtgatctacgtgctgcccatgctgaccatcaaggaggacaagggcaccggcgtggtgaccagcgtgcccagcgacagccccgacgacatcgccgccctgagagacctgaagaagaagcaggccctgagagccaagtacggcatcagagacgacatggtgctgcccttcgagcccgtgcccgtgatcgagatccccggcttcggcaacctgagcgccgtgaccatctgcgacgagctgaagatccagagccagaacgacagagagaagctggccgaggccaaggagaagatctacctgaagggcttctacgagggcatcatgctggtggacggcttcaagggccagaaggtgcaggacgtgaagaagaccatccagaagaagatgatcgacgccggcgacgccctgatctacatggagcccgagaagcaggtgatgagcagaagcagcgacgagtgcgtggtggccctgtgcgaccagtggtacctggactacggcgaggagaactggaagaagcagaccagccagtgcctgaagaacctggagaccttctgcgaggagaccagaagaaacttcgaggccaccctgggctggctgcaggagcacgcctgcagcagaacctacggcctgggcacccacctgccctgggacgagcagtggctgatcgagagcctgagcgacagcaccatctacatggccttctacaccgtggcccacctgctgcagggcggcaacctgcacggccaggccgagagccccctgggcatcagaccccagcagatgaccaaggaggtgtgggactacgtgttcttcaaggaggcccccttccccaagacccagatcgccaaggagaagctggaccagctgaagcaggagttcgagttctggtaccccgtggacctgagagtgagcggcaaggacctggtgcccaaccacctgagctactacctgtacaaccacgtggccatgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaactacgagaagatgatgttcaaggaggccctgaagaccggcttcttcgagttccaggccgccaaggacaagtacagagagctggccgtggagggcatgcacagagagctggtgttcagattcatcgaggtgcagaccctgctgctggcccccttctgcccccacctgtgcgagcacatctggaccctgctgggcaagcccgacagcatcatgaacgccagctggcccgtggccggccccgtgaacgaggtgctgatccacagcagccagtacctgatggaggtgacccacgacctgagactgagactgaagaactacatgatgcccgccaagggcaagaagaccgacaagcagcccctgcagaagcccagccactgcaccatctacgtggccaagaactaccccccctggcagcacaccaccctgagcgtgctgagaaagcacttcgaggccaacaacggcaagctgcccgacaacaaggtgatcgccagcgagctgggcagcatgcccgagctgaagaagtacatgaagaaggtgatgcccttcgtggccatgatcaaggagaacctggagaagatgggccccagaatcctggacctgcagctggagttcgacgagaaggccgtgctgatggagaacatcgtgtacctgaccaacagcctggagctggagcacatcgaggtgaagttcgccagcgaggccgaggacaagatcagagaggactgctgccccggcaagcccctgaacgtgttcagaatcgagcccggcgtgagcgtgagcctggtgaacccccagcccagcaacggccacttcagcaccaagatcgagatcagacagggcgacaactgcgacagcatcatcagaagactgatgaagatgaacagaggcatcaaggacctgagcaaggtgaagctgatgagattcgacgaccccctgctgggccccagaagagtgcccgtgctgggcaaggagtacaccgagaagacccccatcagcgagcacgccgtgttcaacgtggacctgatgagcaagaagatccacctgaccgagaacggcatcagagtggacatcggcgacaccatcatctacctggtgcactag

SEQ ID NO: 86811 - DNA, 480 bp, Artificial Sequence
  Description of Artificial Sequence: Synthetic coding sequence
atggccgagagaaagggcaccgccaaggtggacttcctgaagaagatcgagaaggagatccagcagaagtgggacaccgagagagtgttcgaggtgaacgccagcaacctggagaagcagaccagcaagggcaagtacttcgtgaccttcccctacccctacatgaacggcagactgcacctgggccacaccttcagcctgagcaagtgcgagttcgccgtgggctaccagagactgaagggcaagtgctgcctgttccccttcggcctgcactgcaccggcatgcccatcaaggcctgcgccgacaagctgaagagagagatcgagctgtacggctgcccccccgacttccccgacgaggaggaggaggaggaggagaccagcgtgaagaccgaggacatcatcatcaaggacaaggccaagggcaagaagagcaaggccgccaagctggacctgctgaacaccagcggcgccctgtag

SEQ ID NO: 86812 - DNA, 3531 bp, Artificial Sequence
  Description of Artificial Sequence: Synthetic coding sequence
atggccgagagaaagggcaccgccaaggtggacttcctgaagaagatcgagaaggagatccagcagaagtgggacaccgagagagtgttcgaggtgaacgccagcaacctggagaagcagaccagcaagggcaagtacttcgtgaccttcccctacccctacatgaacggcagactgcacctgggccacaccttcagcctgagcaagtgcgagttcgccgtgggctaccagagactgaagggcaagtgctgcctgttccccttcggcctgcactgcaccggcatgcccatcaaggcctgcgccgacaagctgaagagagagatcgagctgtacggctgcccccccgacttccccgacgaggaggaggaggaggaggagaccagcgtgaagaccgaggacatcatcatcaaggacaaggccaagggcaagaagagcaaggccgccgccaaggccggcagcagcaagtaccagtggggcatcatgaagagcctgggcctgagcgacgaggagatcgtgaagttcagcgaggccgagcactggctggactacttcccccccctggccatccaggacctgaagagaatgggcctgaaggtggactggagaagaagcttcatcaccaccgacgtgaacccctactacgacagcttcgtgagatggcagttcctgaccctgagagagagaaacaagatcaagttcggcaagagatacaccatctacagccccaaggacggccagccctgcatggaccacgacagacagaccggcgagggcgtgggcccccaggagtacaccctgctgaagctgaaggtgctggagccctaccccagcaagctgagcggcctgaagggcaagaacatcttcctggtggccgccaccctgagacccgagaccatgttcggccagaccaactgctgggtgagacccgacatgaagtacatcggcttcgagaccgtgaacggcgacatcttcatctgcacccagaaggccgccagaaacatgagctaccagggcttcaccaaggacaacggcgtggtgcccgtggtgaaggagctgatgggcgaggagatcctgggcgccagcctgagcgcccccctgaccagctacaaggtgatctacgtgctgcccatgctgaccatcaaggaggacaagggcaccggcgtggtgaccagcgtgcccagcgacagccccgacgacatcgccgccctgagagacctgaagaagaagcaggccctgagagccaagtacggcatcagagacgacatggtgctgcccttcgagcccgtgcccgtgatcgagatccccggcttcggcaacctgagcgccgtgaccatctgcgacgagctgaagatccagagccagaacgacagagagaagctggccgaggccaaggagaagatctacctgaagggcttctacgagggcatcatgctggtggacggcttcaagggccagaaggtgcaggacgtgaagaagaccatccagaagaagatgatcgacgccggcgacgccctgatctacatggagcccgagaagcaggtgatgagcagaagcagcgacgagtgcgtggtggccctgtgcgaccagtggtacctggactacggcgaggagaactggaagaagcagaccagccagtgcctgaagaacctggagaccttctgcgaggagaccagaagaaacttcgaggccaccctgggctggctgcaggagcacgcctgcagcagaacctacggcctgggcacccacctgccctgggacgagcagtggctgatcgagagcctgagcgacagcaccatctacatggccttctacaccgtggcccacctgctgcagggcggcaacctgcacggccaggccgagagccccctgggcatcagaccccagcagatgaccaaggaggtgtgggactacgtgttcttcaaggaggcccccttccccaagacccagatcgccaaggagaagctggaccagctgaagcaggagttcgagttctggtaccccgtggacctgagagtgagcggcaaggacctggtgcccaaccacctgagctactacctgtacaaccacgtggccatgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaactacgagaagatgatgttcaaggaggccctgaagaccggcttcttcgagttccaggccgccaaggacaagtacagagagctggccgtggagggcatgcacagagagctggtgttcagattcatcgaggtgcagaccctgctgctggcccccttctgcccccacctgtgcgagcacatctggaccctgctgggcaagcccgacagcatcatgaacgccagctggcccgtggccggccccgtgaacgaggtgctgatccacagcagccagtacctgatggaggtgacccacgacctgagactgagactgaagaactacatgatgcccgccaagggcaagaagaccgacaagcagcccctgcagaagcccagccactgcaccatctacgtggccaagaactaccccccctggcagcacaccaccctgagcgtgctgagaaagcacttcgaggccaacaacggcaagctgcccgacaacaaggtgatcgccagcgagctgggcagcatgcccgagctgaagaagtacatgaagaaggtgatgcccttcgtggccatgatcaaggagaacctggagaagatgggccccagaatcctggacctgcagctggagttcgacgagaaggccgtgctgatggagaacatcgtgtacctgaccaacagcctggagctggagcacatcgaggtgaagttcgccagcgaggccgaggacaagatcagagaggactgctgccccggcaagcccctgaacgtgttcagaatcgagcccggcgtgagcgtgagcctggtgaacccccagcccagcaacggccacttcagcaccaagatcgagatcagacagggcgacaactgcgacagcatcatcagaagactgatgaagatgaacagaggcatcaaggacctgagcaaggtgaagctgatgagattcgacgaccccctgctgggccccagaagagtgcccgtgctgggcaaggagtacaccgagaagacccccatcagcgagcacgccgtgttcaacgtggacctgatgagcaagaagatccacctgaccgagaacggcatcagagtggacatcggcgacaccatcatctacctggtgcactag

SEQ ID NO: 86813 - DNA, 3369 bp, Artificial Sequence
  Description of Artificial Sequence: Synthetic coding sequence
atgaacggcagactgcacctgggccacaccttcagcctgagcaagtgcgagttcgccgtgggctaccagagactgaagggcaagtgctgcctgttccccttcggcctgcactgcaccggcatgcccatcaaggcctgcgccgacaagctgaagagagagatcgagctgtacggctgcccccccgacttccccgacgaggaggaggaggaggaggagaccagcgtgaagaccgaggacatcatcatcaaggacaaggccaagggcaagaagagcaaggccgccgccaaggccggcagcagcaagtaccagtggggcatcatgaagagcctgggcctgagcgacgaggagatcgtgaagttcagcgaggccgagcactggctggactacttcccccccctggccatccaggacctgaagagaatgggcctgaaggtggactggagaagaagcttcatcaccaccgacgtgaacccctactacgacagcttcgtgagatggcagttcctgaccctgagagagagaaacaagatcaagttcggcaagagatacaccatctacagccccaaggacggccagccctgcatggaccacgacagacagaccggcgagggcgtgggcccccaggagtacaccctgctgaagctgaaggtgctggagccctaccccagcaagctgagcggcctgaagggcaagaacatcttcctggtggccgccaccctgagacccgagaccatgttcggccagaccaactgctgggtgagacccgacatgaagtacatcggcttcgagaccgtgaacggcgacatcttcatctgcacccagaaggccgccagaaacatgagctaccagggcttcaccaaggacaacggcgtggtgcccgtggtgaaggagctgatgggcgaggagatcctgggcgccagcctgagcgcccccctgaccagctacaaggtgatctacgtgctgcccatgctgaccatcaaggaggacaagggcaccggcgtggtgaccagcgtgcccagcgacagccccgacgacatcgccgccctgagagacctgaagaagaagcaggccctgagagccaagtacggcatcagagacgacatggtgctgcccttcgagcccgtgcccgtgatcgagatccccggcttcggcaacctgagcgccgtgaccatctgcgacgagctgaagatccagagccagaacgacagagagaagctggccgaggccaaggagaagatctacctgaagggcttctacgagggcatcatgctggtggacggcttcaagggccagaaggtgcaggacgtgaagaagaccatccagaagaagatgatcgacgccggcgacgccctgatctacatggagcccgagaagcaggtgatgagcagaagcagcgacgagtgcgtggtggccctgtgcgaccagtggtacctggactacggcgaggagaactggaagaagcagaccagccagtgcctgaagaacctggagaccttctgcgaggagaccagaagaaacttcgaggccaccctgggctggctgcaggagcacgcctgcagcagaacctacggcctgggcacccacctgccctgggacgagcagtggctgatcgagagcctgagcgacagcaccatctacatggccttctacaccgtggcccacctgctgcagggcggcaacctgcacggccaggccgagagccccctgggcatcagaccccagcagatgaccaaggaggtgtgggactacgtgttcttcaaggaggcccccttccccaagacccagatcgccaaggagaagctggaccagctgaagcaggagttcgagttctggtaccccgtggacctgagagtgagcggcaaggacctggtgcccaaccacctgagctactacctgtacaaccacgtggccatgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaactacgagaagatgatgttcaaggaggccctgaagaccggcttcttcgagttccaggccgccaaggacaagtacagagagctggccgtggagggcatgcacagagagctggtgttcagattcatcgaggtgcagaccctgctgctggcccccttctgcccccacctgtgcgagcacatctggaccctgctgggcaagcccgacagcatcatgaacgccagctggcccgtggccggccccgtgaacgaggtgctgatccacagcagccagtacctgatggaggtgacccacgacctgagactgagactgaagaactacatgatgcccgccaagggcaagaagaccgacaagcagcccctgcagaagcccagccactgcaccatctacgtggccaagaactaccccccctggcagcacaccaccctgagcgtgctgagaaagcacttcgaggccaacaacggcaagctgcccgacaacaaggtgatcgccagcgagctgggcagcatgcccgagctgaagaagtacatgaagaaggtgatgcccttcgtggccatgatcaaggagaacctggagaagatgggccccagaatcctggacctgcagctggagttcgacgagaaggccgtgctgatggagaacatcgtgtacctgaccaacagcctggagctggagcacatcgaggtgaagttcgccagcgaggccgaggacaagatcagagaggactgctgccccggcaagcccctgaacgtgttcagaatcgagcccggcgtgagcgtgagcctggtgaacccccagcccagcaacggccacttcagcaccaagatcgagatcagacagggcgacaactgcgacagcatcatcagaagactgatgaagatgaacagaggcatcaaggacctgagcaaggtgaagctgatgagattcgacgaccccctgctgggccccagaagagtgcccgtgctgggcaaggagtacaccgagaagacccccatcagcgagcacgccgtgttcaacgtggacctgatgagcaagaagatccacctgaccgagaacggcatcagagtggacatcggcgacaccatcatctacctggtgcactag

SEQ ID NO: 86814 - DNA, 372 bp, Artificial Sequence
  Description of Artificial Sequence: Synthetic coding sequence
atgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaccatgaagagatag

SEQ ID NO: 86815 - DNA, 1458 bp, Artificial Sequence
  Description of Artificial Sequence: Synthetic coding sequence
atgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaactacgagaagatgatgttcaaggaggccctgaagaccggcttcttcgagttccaggccgccaaggacaagtacagagagctggccgtggagggcatgcacagagagctggtgttcagattcatcgaggtgcagaccctgctgctggcccccttctgcccccacctgtgcgagcacatctggaccctgctgggcaagcccgacagcatcatgaacgccagctggcccgtggccggccccgtgaacgaggtgctgatccacagcagccagtacctgatggaggtgacccacgacctgagactgagactgaagaactacatgatgcccgccaagggcaagaagaccgacaagcagcccctgcagaagcccagccactgcaccatctacgtggccaagaactaccccccctggcagcacaccaccctgagcgtgctgagaaagcacttcgaggccaacaacggcaagctgcccgacaacaaggtgatcgccagcgagctgggcagcatgcccgagctgaagaagtacatgaagaaggtgatgcccttcgtggccatgatcaaggagaacctggagaagatgggccccagaatcctggacctgcagctggagttcgacgagaaggccgtgctgatggagaacatcgtgtacctgaccaacagcctggagctggagcacatcgaggtgaagttcgccagcgaggccgaggacaagatcagagaggactgctgccccggcaagcccctgaacgtgttcagaatcgagcccggcgtgagcgtgagcctggtgaacccccagcccagcaacggccacttcagcaccaagatcgagatcagacagggcgacaactgcgacagcatcatcagaagactgatgaagatgaacagaggcatcaaggacctgagcaaggtgaagctgatgagattcgacgaccccctgctgggccccagaagagtgcccgtgctgggcaaggagtacaccgagaagacccccatcagcgagcacgccgtgttcaacgtggacctgatgagcaagaagatccacctgaccgagaacggcatcagagtggacatcggcgacaccatcatctacctggtgcactag

SEQ ID NO: 86816 - DNA, 3393 bp, Artificial Sequence
  Description of Artificial Sequence: Synthetic coding sequence
atggccgagagaaagggcaccgccaaggtggacttcctgaagaagatcgagaaggagatccagcagaagtgggacaccgagagagtgttcgaggtgaacgccagcaacctggagaagcagaccagcaagggcaagtacttcgtgaccttcccctacccctacatgaacggcagactgcacctgggccacaccttcagcctgagcaagtgcgagttcgccgtgggctaccagagactgaagggcaagtgctgcctgttccccttcggcctgcactgcaccggcatgcccatcaagagcaaggccgccgccaaggccggcagcagcaagtaccagtggggcatcatgaagagcctgggcctgagcgacgaggagatcgtgaagttcagcgaggccgagcactggctggactacttcccccccctggccatccaggacctgaagagaatgggcctgaaggtggactggagaagaagcttcatcaccaccgacgtgaacccctactacgacagcttcgtgagatggcagttcctgaccctgagagagagaaacaagatcaagttcggcaagagatacaccatctacagccccaaggacggccagccctgcatggaccacgacagacagaccggcgagggcgtgggcccccaggagtacaccctgctgaagctgaaggtgctggagccctaccccagcaagctgagcggcctgaagggcaagaacatcttcctggtggccgccaccctgagacccgagaccatgttcggccagaccaactgctgggtgagacccgacatgaagtacatcggcttcgagaccgtgaacggcgacatcttcatctgcacccagaaggccgccagaaacatgagctaccagggcttcaccaaggacaacggcgtggtgcccgtggtgaaggagctgatgggcgaggagatcctgggcgccagcctgagcgcccccctgaccagctacaaggtgatctacgtgctgcccatgctgaccatcaaggaggacaagggcaccggcgtggtgaccagcgtgcccagcgacagccccgacgacatcgccgccctgagagacctgaagaagaagcaggccctgagagccaagtacggcatcagagacgacatggtgctgcccttcgagcccgtgcccgtgatcgagatccccggcttcggcaacctgagcgccgtgaccatctgcgacgagctgaagatccagagccagaacgacagagagaagctggccgaggccaaggagaagatctacctgaagggcttctacgagggcatcatgctggtggacggcttcaagggccagaaggtgcaggacgtgaagaagaccatccagaagaagatgatcgacgccggcgacgccctgatctacatggagcccgagaagcaggtgatgagcagaagcagcgacgagtgcgtggtggccctgtgcgaccagtggtacctggactacggcgaggagaactggaagaagcagaccagccagtgcctgaagaacctggagaccttctgcgaggagaccagaagaaacttcgaggccaccctgggctggctgcaggagcacgcctgcagcagaacctacggcctgggcacccacctgccctgggacgagcagtggctgatcgagagcctgagcgacagcaccatctacatggccttctacaccgtggcccacctgctgcagggcggcaacctgcacggccaggccgagagccccctgggcatcagaccccagcagatgaccaaggaggtgtgggactacgtgttcttcaaggaggcccccttccccaagacccagatcgccaaggagaagctggaccagctgaagcaggagttcgagttctggtaccccgtggacctgagagtgagcggcaaggacctggtgcccaaccacctgagctactacctgtacaaccacgtggccatgtggcccgagcagagcgacaagtggcccaccgccgtgagagccaacggccacctgctgctgaacagcgagaagatgagcaagagcaccggcaacttcctgaccctgacccaggccatcgacaagttcagcgccgacggcatgagactggccctggccgacgccggcgacaccgtggaggacgccaacttcgtggaggccatggccgacgccggcatcctgagactgtacacctgggtggagtgggtgaaggagatggtggccaactgggacagcctgagaagcggccccgccagcaccttcaacgacagagtgttcgccagcgagctgaacgccggcatcatcaagaccgaccagaactacgagaagatgatgttcaaggaggccctgaagaccggcttcttcgagttccaggccgccaaggacaagtacagagagctggccgtggagggcatgcacagagagctggtgttcagattcatcgaggtgcagaccctgctgctggcccccttctgcccccacctgtgcgagcacatctggaccctgctgggcaagcccgacagcatcatgaacgccagctggcccgtggccggccccgtgaacgaggtgctgatccacagcagccagtacctgatggaggtgacccacgacctgagactgagactgaagaactacatgatgcccgccaagggcaagaagaccgacaagcagcccctgcagaagcccagccactgcaccatctacgtggccaagaactaccccccctggcagcacaccaccctgagcgtgctgagaaagcacttcgaggccaacaacggcaagctgcccgacaacaaggtgatcgccagcgagctgggcagcatgcccgagctgaagaagtacatgaagaaggtgatgcccttcgtggccatgatcaaggagaacctggagaagatgggccccagaatcctggacctgcagctggagttcgacgagaaggccgtgctgatggagaacatcgtgtacctgaccaacagcctggagctggagcacatcgaggtgaagttcgccagcgaggccgaggacaagatcagagaggactgctgccccggcaagcccctgaacgtgttcagaatcgagcccggcgtgagcgtgagcctggtgaacccccagcccagcaacggccacttcagcaccaagatcgagatcagacagggcgacaactgcgacagcatcatcagaagactgatgaagatgaacagaggcatcaaggacctgagcaaggtgaagctgatgagattcgacgaccccctgctgggccccagaagagtgcccgtgctgggcaaggagtacaccgagaagacccccatcagcgagcacgccgtgttcaacgtggacctgatgagcaagaagatccacctgaccgagaacggcatcagagtggacatcggcgacaccatcatctacctggtgcactag

SEQ ID NO: 86817 - DNA, 2712 bp, Artificial Sequence
  Description of Artificial Sequence: Synthetic coding sequence
atggccagcgtgtggcagagactgggcttctacgccagcctgctgaagagacagctgaacggcggccccgacgtgatcaagtgggagagaagagtgatccccggctgcaccagaagcatctacagcgccaccggcaagtggaccaaggagtacaccctgcagaccagaaaggacgtggagaagtggtggcaccagagaatcaaggagcaggccagcaagatcagcgaggccgacaagagcaagcccaagttctacgtgctgagcatgttcccctaccccagcggcaagctgcacatgggccacgtgagagtgtacaccatcagcgacaccatcgccagattccagaagatgagaggcatgcaggtgatcaaccccatgggctgggacgccttcggcctgcccgccgagaacgccgccgtggagagaaacctgcacccccagagctggacccagagcaacatcaagcacatgagaaagcagctggacagactgggcctgtgcttcagctgggacagagagatcaccacctgcctgcccgactactacaagtggacccagtacctgttcatcaagctgtacgaggccggcctggcctaccagaaggaggccctggtgaactgggaccccgtggaccagaccgtgctggccaacgagcaggtggacgagcacggctgcagctggagaagcggcgccaaggtggagcagaagtacctgagacagtggttcatcaagaccaccgcctacgccaaggccatgcaggacgccctggccgacctgcccgagtggtacggcatcaagggcatgcaggcccactggatcggcgactgcgtgggctgccacctggacttcaccctgaaggtgcacggccaggccaccggcgagaagctgaccgcctacaccgccacccccgaggccatctacggcaccagccacgtggccatcagccccagccacagactgctgcacggccacagcagcctgaaggaggccctgagaatggccctggtgcccggcaaggactgcctgacccccgtgatggccgtgaacatgctgacccagcaggaggtgcccgtggtgatcctggccaaggccgacctggagggcagcctggacagcaagatcggcatccccagcaccagcagcgaggacaccatcctggcccagaccctgggcctggcctacagcgaggtgatcgagaccctgcccgacggcaccgagagactgagcagcagcgccgagttcaccggcatgaccagacaggacgccttcctggccctgacccagaaggccagaggcaagagagtgggcggcgacgtgaccagcgacaagctgaaggactggctgatcagcagacagagatactggggcacccccatccccatcgtgcactgccccgtgtgcggccccacccccgtgcccctggaggacctgcccgtgaccctgcccaacatcgccagcttcaccggcaagggcggcccccccctggccatggccagcgagtgggtgaactgcagctgccccagatgcaagggcgccgccaagagagagaccgacaccatggacaccttcgtggacagcgcctggtactacttcagatacaccgacccccacaacccccacagccccttcaacaccgccgtggccgactactggatgcccgtggacctgtacatcggcggcaaggagcacgccgtgatgcacctgttctacgccagattcttcagccacttctgccacgaccagaagatggtgaagcacagagagcccttccacaagctgctggcccagggcctgatcaagggccagaccttcagactgcccagcggccagtacctgcagagagaggaggtggacctgaccggcagcgtgcccgtgcacgccaagaccaaggagaagctggaggtgacctgggagaagatgagcaagagcaagcacaacggcgtggaccccgaggaggtggtggagcagtacggcatcgacaccatcagactgtacatcctgttcgccgccccccccgagaaggacatcctgtgggacgtgaagaccgacgccctgcccggcgtgctgagatggcagcagagactgtggaccctgaccaccagattcatcgaggccagagccagcggcaagagcccccagccccagctgctgagcaacaaggagaaggccgaggccagaaagctgtgggagtacaagaacagcgtgatcagccaggtgaccacccacttcaccgaggacttcagcctgaacagcgccatcagccagctgatgggcctgagcaacgccctgagccaggccagccagagcgtgatcctgcacagccccgagttcgaggacgccctgtgcgccctgatggtgatggccgcccccctggccccccacgtgaccagcgagatctgggccggcctggccctggtgcccagaaagctgtgcgcccactacacctgggacgccagcgtgctgctgcaggcctggcccgccgtggaccccgagttcctgcagcagcccgaggtggtgcagatggccgtgctgatcaacaacaaggcctgcggcaagatccccgtgccccagcaggtggccagagaccaggacaaggtgcacgagttcgtgctgcagagcgagctgggcgtgagactgctgcagggcagaagcatcaagaagagcttcctgagccccagaaccgccctgatcaacttcctggtgcaggactag

SEQ ID NO: 86818 - DNA, 2583 bp, Artificial Sequence
  Description of Artificial Sequence: Synthetic coding sequence
atggccagcgtgtggcagagactgggcttctacgccagcctgctgaagagacagctgaacggcggccccgacgtgatcaagtgggagagaagagtgatccccggctgcaccagaagcatctacagcgccaccggcaagtggaccaaggagtacaccctgcagaccagaaaggacgtggagaagtggtggcaccagagaatcaaggagcaggccagcaagatcagcgaggccgacgtgatcaaccccatgggctgggacgccttcggcctgcccgccgagaacgccgccgtggagagaaacctgcacccccagagctggacccagagcaacatcaagcacatgagaaagcagctggacagactgggcctgtgcttcagctgggacagagagatcaccacctgcctgcccgactactacaagtggacccagtacctgttcatcaagctgtacgaggccggcctggcctaccagaaggaggccctggtgaactgggaccccgtggaccagaccgtgctggccaacgagcaggtggacgagcacggctgcagctggagaagcggcgccaaggtggagcagaagtacctgagacagtggttcatcaagaccaccgcctacgccaaggccatgcaggacgccctggccgacctgcccgagtggtacggcatcaagggcatgcaggcccactggatcggcgactgcgtgggctgccacctggacttcaccctgaaggtgcacggccaggccaccggcgagaagctgaccgcctacaccgccacccccgaggccatctacggcaccagccacgtggccatcagccccagccacagactgctgcacggccacagcagcctgaaggaggccctgagaatggccctggtgcccggcaaggactgcctgacccccgtgatggccgtgaacatgctgacccagcaggaggtgcccgtggtgatcctggccaaggccgacctggagggcagcctggacagcaagatcggcatccccagcaccagcagcgaggacaccatcctggcccagaccctgggcctggcctacagcgaggtgatcgagaccctgcccgacggcaccgagagactgagcagcagcgccgagttcaccggcatgaccagacaggacgccttcctggccctgacccagaaggccagaggcaagagagtgggcggcgacgtgaccagcgacaagctgaaggactggctgatcagcagacagagatactggggcacccccatccccatcgtgcactgccccgtgtgcggccccacccccgtgcccctggaggacctgcccgtgaccctgcccaacatcgccagcttcaccggcaagggcggcccccccctggccatggccagcgagtgggtgaactgcagctgccccagatgcaagggcgccgccaagagagagaccgacaccatggacaccttcgtggacagcgcctggtactacttcagatacaccgacccccacaacccccacagccccttcaacaccgccgtggccgactactggatgcccgtggacctgtacatcggcggcaaggagcacgccgtgatgcacctgttctacgccagattcttcagccacttctgccacgaccagaagatggtgaagcacagagagcccttccacaagctgctggcccagggcctgatcaagggccagaccttcagactgcccagcggccagtacctgcagagagaggaggtggacctgaccggcagcgtgcccgtgcacgccaagaccaaggagaagctggaggtgacctgggagaagatgagcaagagcaagcacaacggcgtggaccccgaggaggtggtggagcagtacggcatcgacaccatcagactgtacatcctgttcgccgccccccccgagaaggacatcctgtgggacgtgaagaccgacgccctgcccggcgtgctgagatggcagcagagactgtggaccctgaccaccagattcatcgaggccagagccagcggcaagagcccccagccccagctgctgagcaacaaggagaaggccgaggccagaaagctgtgggagtacaagaacagcgtgatcagccaggtgaccacccacttcaccgaggacttcagcctgaacagcgccatcagccagctgatgggcctgagcaacgccctgagccaggccagccagagcgtgatcctgcacagccccgagttcgaggacgccctgtgcgccctgatggtgatggccgcccccctggccccccacgtgaccagcgagatctgggccggcctggccctggtgcccagaaagctgtgcgcccactacacctgggacgccagcgtgctgctgcaggcctggcccgccgtggaccccgagttcctgcagcagcccgaggtggtgcagatggccgtgctgatcaacaacaaggcctgcggcaagatccccgtgccccagcaggtggccagagaccaggacaaggtgcacgagttcgtgctgcagagcgagctgggcgtgagactgctgcagggcagaagcatcaagaagagcttcctgagccccagaaccgccctgatcaacttcctggtgcaggactag

SEQ ID NO: 86819 - DNA, 2712 bp, Artificial Sequence; identical to SEQ ID NO: 86817
  Description of Artificial Sequence: Synthetic coding sequence

SEQ ID NO: 86820 - DNA, 345 bp, Artificial Sequence
  Description of Artificial Sequence: Synthetic coding sequence
atggccagcgtgtggcagagactgggcttctacgccagcctgctgaagagacagctgaacggcggccccgacgtgatcaagtgggagagaagagtgatccccggctgcaccagaagcatctacagcgccaccggcaagtggaccaaggagtacaccctgcagaccagaaaggacgtggagaagtggtggcaccagagaatcaaggagcaggccagcaagatcagcgaggccgacaagagcaagcccaagttctacgtgctgagcatgttcccctaccccagcggcaagctgcacatgggccacgtgagagtgtacaccatcagcgacaccatcgccagattctag

SEQ ID NO: 86821 - DNA, 609 bp, Artificial Sequence
  Description of Artificial Sequence: Synthetic coding sequence
atgaaggtgctggccgccggcgtggtgcccctgctgctggtgctgcactggaagcacggcgccggcagccccctgcccatcacccccgtgaacgccacctgcgccatcagacacccctgccacaacaacctgatgaaccagatcagaagccagctggcccagctgaacggcagcgccaacgccctgttcatcctgtactacaccgcccagggcgagcccttccccaacaacctggacaagctgtgcggccccaacgtgaccgacttcccccccttccacgccaacggcaccgagaaggccaagctggtggagctgtacagaatcgtggtgtacctgggcaccagcctgggcaacatcaccagagaccagaagatcctgaaccccagcgccctgagcctgcacagcaagctgaacgccaccgccgacatcctgagaggcctgctgagcaacgtgctgtgcagactgtgcagcaagtaccacgtgggccacgtggacgtgacctacggccccgacaccagcggcaaggacgtgttccagaagaagaagctgggctgccagctgctgggcaagtacaagcagatcatcgccgtgctggcccaggccttctag

SEQ ID NO: 86822 - DNA, 3294 bp, Artificial Sequence
  Description of Artificial Sequence: Synthetic coding sequence
atgatggacatctacgtgtgcctgaagagacccagctggatggtggacaacaagagaatgagaaccgccagcaacttccagtggctgctgagcaccttcatcctgctgtacctgatgaaccaggtgaacagccagaagaagggcgccccccacgacctgaagtgcgtgaccaacaacctgcaggtgtggaactgcagctggaaggcccccagcggcaccggcagaggcaccgactacgaggtgtgcatcgagaacagaagcagaagctgctaccagctggagaagaccagcatcaagatccccgccctgagccacggcgactacgagatcaccatcaacagcctgcacgacttcggcagcagcaccagcaagttcaccctgaacgagcagaacgtgagcctgatccccgacacccccgagatcctgaacctgagcgccgacttcagcaccagcaccctgtacctgaagtggaacgacagaggcagcgtgttcccccacagaagcaacgtgatctgggagatcaaggtgctgagaaaggagagcatggagctggtgaagctggtgacccacaacaccaccctgaacggcaaggacaccctgcaccactggagctgggccagcgacatgcccctggagtgcgccatccacttcgtggagatcagatgctacatcgacaacctgcacttcagcggcctggaggagtggagcgactggagccccgtgaagaacatcagctggatccccgacagccagaccaaggtgttcccccaggacaaggtgatcctggtgggcagcgacatcaccttctgctgcgtgagccaggagaaggtgctgagcgccctgatcggccacaccaactgccccctgatccacctggacggcgagaacgtggccatcaagatcagaaacatcagcgtgagcgccagcagcggcaccaacgtggtgttcaccaccgaggacaacatcttcggcaccgtgatcttcgccggctacccccccgacaccccccagcagctgaactgcgagacccacgacctgaaggagatcatctgcagctggaaccccggcagagtgaccgccctggtgggccccagagccaccagctacaccctggtggagagcttcagcggcaagtacgtgagactgaagagagccgaggcccccaccaacgagagctaccagctgctgttccagatgctgcccaaccaggagatctacaacttcaccctgaacgcccacaaccccctgggcagaagccagagcaccatcctggtgaacatcaccgagaaggtgtacccccacacccccaccagcttcaaggtgaaggacatcaacagcaccgccgtgaagctgagctggcacctgcccggcaacttcgccaagatcaacttcctgtgcgagatcgagatcaagaagagcaacagcgtgcaggagcagagaaacgtgaccatcaagggcgtggagaacagcagctacctggtggccctggacaagctgaacccctacaccctgtacaccttcagaatcagatgcagcaccgagaccttctggaagtggagcaagtggagcaacaagaagcagcacctgaccaccgaggccagccccagcaagggccccgacacctggagagagtggagcagcgacggcaagaacctgatcatctactggaagcccctgcccatcaacgaggccaacggcaagatcctgagctacaacgtgagctgcagcagcgacgaggagacccagagcctgagcgagatccccgacccccagcacaaggccgagatcagactggacaagaacgactacatcatcagcgtggtggccaagaacagcgtgggcagcagcccccccagcaagatcgccagcatggagatccccaacgacgacctgaagatcgagcaggtggtgggcatgggcaagggcatcctgctgacctggcactacgaccccaacatgacctgcgactacgtgatcaagtggtgcaacagcagcagaagcgagccctgcctgatggactggagaaaggtgcccagcaacagcaccgagaccgtgatcgagagcgacgagttcagacccggcatcagatacaacttcttcctgtacggctgcagaaaccagggctaccagctgctgagaagcatgatcggctacatcgaggagctggcccccatcgtggcccccaacttcaccgtggaggacaccagcgccgacagcatcctggtgaagtgggaggacatccccgtggaggagctgagaggcttcctgagaggctacctgttctacttcggcaagggcgagagagacaccagcaagatgagagtgctggagagcggcagaagcgacatcaaggtgaagaacatcaccgacatcagccagaagaccctgagaatcgccgacctgcagggcaagaccagctaccacctggtgctgagagcctacaccgacggcggcgtgggccccgagaagagcatgtacgtggtgaccaaggagaacagcgtgggcctgatcatcgccatcctgatccccgtggccgtggccgtgatcgtgggcgtggtgaccagcatcctgtgctacagaaagagagagtggatcaaggagaccttctaccccgacatccccaaccccgagaactgcaaggccctgcagttccagaagagcgtgtgcgagggcagcagcgccctgaagaccctggagatgaacccctgcacccccaacaacgtggaggtgctggagaccagaagcgccttccccaagatcgaggacaccgagatcatcagccccgtggccgagagacccgaggacagaagcgacgccgagcccgagaaccacgtggtggtgagctactgcccccccatcatcgaggaggagatccccaaccccgccgccgacgaggccggcggcaccgcccaggtgatctacatcgacgtgcagagcatgtaccagccccaggccaagcccgaggaggagcaggagaacgaccccgtgggcggcgccggctacaagccccagatgcacctgcccatcaacagcaccgtggaggacatcgccgccgaggaggacctggacaagaccgccggctacagaccccaggccaacgtgaacacctggaacctggtgagccccgacagccccagaagcatcgacagcaacagcgagatcgtgagcttcggcagcccctgcagcatcaacagcagacagttcctgatcccccccaaggacgaggacagccccaagagcaacggcggcggctggagcttcaccaacttcttccagaacaagcccaacgactag

SEQ ID NO: 86823 - DNA, 3294 bp, Artificial Sequence; identical to SEQ ID NO: 86822
  Description of Artificial Sequence: Synthetic coding sequence

SEQ ID NO: 86824 - DNA, 381 bp, Artificial Sequence
  Description of Artificial Sequence: Synthetic coding sequence
atgatggacatctacgtgtgcctgaagagacccagctggatggtggacaacaagagaatgagaaccgccagcaacttccagtggctgctgagcaccttcatcctgctgtacctgatgaaccaggtgaacagccagaagaagggcgccccccacgacctgaagtgcgtgaccaacaacctgcaggtgtggaactgcagctggaaggcccccagcggcaccggcagaggcaccgactacgaggtgtgcatcgagaacagaagcagaagctgctaccagctggagaagaccagcatcaagatccccgccctgagccacggcgactacgagatcaccatcaacagcctgcacgacttcggcagcagcaccagcaagttcacctag

SEQ ID NO: 86825 - DNA, 228 bp, Artificial Sequence
  Description of Artificial Sequence: Synthetic coding sequence
atgatggacatctacgtgtgcctgaagagacccagctggatggtggacaacaagagaatgagaaccgccagcaacttccagtggctgctgagcaccttcatcctgctgtacctgatgaaccaggtgaacagccagaagaagggcgccccccacgacctgaagtgcgtgaccaacaacctgcaggtgtggaactgcagctggaaggcccccagcggcaccggcagatag

SEQ ID NO: 86826 - DNA, 456 bp, Artificial Sequence
  Description of Artificial Sequence: Synthetic coding sequence
atgttcagcaccaaggccctgctgctggccggcctgatcagcaccgccctggccggcccctgggccaacatctgcgccggcaagagcagcaacgagatcagaacctgcgacagacacggctgcggccagtacagcgcccagagaagccagagaccccaccagggcgtggacatcctgtgcagcgccggcagcaccgtgtacgcccccttcaccggcatgatcgtgggccaggagaagccctaccagaacaagaacgccatcaacaacggcgtgagaatcagcggcagaggcttctgcgtgaagatgttctacatcaagcccatcaagtacaagggccccatcaagaagggcgagaagctgggcaccctgctgcccctgcagaaggtgtaccccggcatccagagccacgtgcacatcgagaactgcgacagcagcgaccccaccgcctacctgtag

SEQ ID NO: 86827 - DNA, 1128 bp, Artificial Sequence
  Description of Artificial Sequence: Synthetic coding sequence
atgacccccatcctgaccgtgctgatctgcctgggcctgagcctggaccccagaacccacgtgcaggccggccccctgcccaagcccaccctgtgggccgagcccggcagcgtgatcacccagggcagccccgtgaccctgagatgccagggcagcctggagacccaggagtaccacctgtacagagagaagaagaccgccctgtggatcaccagaatcccccaggagctggtgaagaagggccagttccccatcctgagcatcacctgggagcacgccggcagatactgctgcatctacggcagccacaccgccggcctgagcgagagcagcgaccccctggagctggtggtgaccggcgcctacagcaagcccaccctgagcgccctgcccagccccgtggtgaccagcggcggcaacgtgaccatccagtgcgacagccaggtggccttcgacggcttcatcctgtgcgtgagcaagaagcccagcctgagcgtgcagcccggccccgtggtggcccccggcgagaagctgaccttccagtgcggcagcgacgccggctacgacagattcgtgctgtacaaggagtggggcagagacttcctgcagagacccggcagacagccccaggccggcctgagccaggccaacttcaccctgggccccgtgagcagaagctacggcggccagtacacctgcagcggcgcctacaacctgagcagcgagtggagcgcccccagcgaccccctggacatcctgatcaccggccagatcagagccagacccttcctgagcgtgagacccggccccaccgtggccagcggcgagaacgtgaccctgctgtgccagagccagggcggcatgcacaccttcctgctgaccaaggagggcgccgccgacagccccctgagactgaagagcaagagacagagccacaagtaccaggccgagttccccatgagccccgtgaccagcgcccacgccggcacctacagatgctacggcagcctgagcagcaacccctacctgctgacccaccccagcgaccccctggagctggtggtgagcggcgccgccgagaccctgagccccccccagaacaagagcgacagcaaggccggcgagtag

SEQ ID NO: 86828 - DNA, 1956 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcggccccagcggcggccccagcagccccaccaccggccccaccagcaccagcgccggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaagcacacccagcccgaggacggcgtggagatggacaccagaagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcctgaccctgagaagagaggccaccgagcccccccccagccaggagggccccagccccgccgtgcccagcatctacgccaccctggccatccactag

SEQ ID NO: 86829 - DNA, 1956 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcggccccagcggcggccccagcagccccaccaccggccccaccagcaccagcggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaagcacacccagcccgaggacggcgtggagatggacaccagacagagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcctgaccctgagaagagaggccaccgagcccccccccagccaggagggccccagccccgccgtgcccagcatctacgccaccctggccatccactag

SEQ ID NO: 86830 - DNA, 1794 bp, Artificial Sequence
  Description of Artificial Sequence: Synthetic coding sequence
atgacccccatcgtgaccgtgctgatctgcctgggcctgagcctgggccccagaacccacgtgcagaccggcaccatccccaagcccaccctgtgggccgagcccgacagcgtgatcacccagggcagccccgtgaccctgagctgccagggcagcctggaggcccaggagtacagactgtacagagagaagaagagcgccagctggatcaccagaatcagacccgagctggtgaagaacggccagttccacatccccagcatcacctgggagcacaccggcagatacggctgccagtactacagcagagccagatggagcgagctgagcgaccccctggtgctggtgatgaccggcgcctaccccaagcccaccctgagcgcccagcccagccccgtggtgaccagcggcggcagagtgaccctgcagtgcgagagccaggtggccttcggcggcttcatcctgtgcaaggagggcgaggaggagcacccccagtgcctgaacagccagccccacgccagaggcagcagcagagccatcttcagcgtgggccccgtgagccccaacagaagatggagccacagatgctacggctacgacctgaacagcccctacgtgtggagcagccccagcgacctgctggagctgctggtgcccggcgtgagcaagaagcccagcctgagcgtgcagcccggccccgtggtggcccccggcgagagcctgaccctgcagtgcgtgagcgacgtgggctacgacagattcgtgctgtacaaggagggcgagagagacctgagacagctgcccggcagacagccccaggccggcctgagccaggccaacttcaccctgggccccgtgagcagaagctacggcggccagtacagatgctacggcgcccacaacctgagcagcgagtgcagcgcccccagcgaccccctggacatcctgatcaccggccagatcagaggcacccccttcatcagcgtgcagcccggccccaccgtggccagcggcgagaacgtgaccctgctgtgccagagctggagacagttccacaccttcctgctgaccaaggccggcgccgccgacgcccccctgagactgagaagcatccacgagtaccccaagtaccaggccgagttccccatgagccccgtgaccagcgcccacgccggcacctacagatgctacggcagcctgaacagcgacccctacctgctgagccaccccagcgagcccctggagctggtggtgagcggccccagcatgggcagcagccccccccccaccggccccatcagcacccccggccccgaggaccagcccctgacccccaccggcagcgacccccagagcggcctgggcagacacctgggcgtggtgatcggcatcctggtggccgtggtgctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaaggacacccagcccgaggacggcgtggagatggacaccagagccgccgccagcgaggccccccaggacgtgacctacgcccagctgcacagcctgaccctgagaagaaaggccaccgagcccccccccagccaggagagagagccccccgccgagcccagcatctacgccaccctggccatccactag

SEQ ID NO: 86831 - DNA, 1899 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagccaggaggcccaggagtacagactgcacaaggagggcagccccgagcccctggacagaaacaaccccctggagcccaagaacaaggccagattcagcatccccagcatgaccgagcaccacgccggcagatacagatgccactactacagcagcgccggctggagcgagcccagcgaccccctggagatggtgatgaccggcgcctacagcaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcagaggcttccaggccctgttccccgtgggccccgtgacccccagccacagatggagattcacctgctactactactacaccaacaccccctgggtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacaacagattcgtgctgtacaaggagggcgagagagacttcctgcagagacccggccagcagccccaggccggcctgagccaggccaacttcaccctgggccccgtgagccccagcaacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccacagcggcggcagcagcctgccccccaccggcccccccagcacccccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagcagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 86832 - DNA, 1344 bp, Artificial Sequence
  Description of Artificial Sequence: Synthetic coding sequence
atgatccccaccttcaccgccctgctgtgcctgggcctgagcctgggccccagaacccacatgcaggccggccccctgcccaagcccaccctgtgggccgagcccggcagcgtgatcagctggggcaacagcgtgaccatctggtgccagggcaccctggaggccagagagtacagactggacaaggaggagagccccgccccctgggacagacagaaccccctggagcccaagaacaaggccagattcagcatccccagcatgaccgaggactacgccggcagatacagatgctactacagaagccccgtgggctggagccagcccagcgaccccctggagctggtgatgaccggcgcctacagcaagcccaccctgagcgccctgcccagccccctggtgaccagcggcaagagcgtgaccctgctgtgccagagcagaagccccatggacaccttcctgctgatcaaggagagagccgcccaccccctgctgcacctgagaagcgagcacggcgcccagcagcaccaggccgagttccccatgagccccgtgaccagcgtgcacggcggcacctacagatgcttcagcagccacggcttcagccactacctgctgagccaccccagcgaccccctggagctgatcgtgagcggcagcctggaggaccccagacccagccccaccagaagcgtgagcaccgccgccggccccgaggaccagcccctgatgcccaccggcagcgtgccccacagcggcctgagaagacactgggaggtgctgatcggcgtgctggtggtgagcatcctgctgctgagcctgctgctgttcctgctgctgcagcactggagacagggcaagcacagaaccctggcccagagacaggccgacttccagagaccccccggcgccgccgagcccgagcccaaggacggcggcctgcagagaagaagcagccccgccgccgacgtgcagggcgagaacttctgcgccgccgtgaagaacacccagcccgaggacggcgtggagatggacaccagaagcccccacgacgaggacccccaggccgtgacctacgccaaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcttcaccctgagacagaaggccaccgagcccccccccagccaggagggcgccagccccgccgagcccagcgtgtacgccaccctggccatccactag

SEQ ID NO: 86833 - DNA, 1476 bp, Artificial Sequence
  Description of Artificial Sequence: Synthetic coding sequence
atgaccctgaccctgagcgtgctgatctgcctgggcctgagcgtgggccccagaacctgcgtgcaggccggcaccctgcccaagcccaccctgtgggccgagcccgccagcgtgatcgccagaggcaagcccgtgaccctgtggtgccagggccccctggagaccgaggagtacagactggacaaggagggcctgccctgggccagaaagagacagaaccccctggagcccggcgccaaggccaagttccacatccccagcaccgtgtacgacagcgccggcagatacagatgctactacgagacccccgccggctggagcgagcccagcgaccccctggagctggtggccaccggcgtgagcagaaagcccagcctgctgatcccccagggcagcgtggtggccagaggcggcagcctgaccctgcagtgcagaagcgacgtgggctacgacatcttcgtgctgtacaaggagggcgagcacgacctggtgcagggcagcggccagcagccccaggccggcctgagccaggccaacttcaccctgggccccgtgagcagaagccacggcggccagtacagatgctacggcgcccacaacctgagccccagatggagcgcccccagcgaccccctggacatcctgatcgccggcctgatccccgacatccccgccctgagcgtgcagcccggccccaaggtggccagcggcgagaacgtgaccctgctgtgccagagctggcaccagatcgacaccttcttcctgaccaaggagggcgccgcccacccccccctgtgcctgaagagcaagtaccagagctacagacaccaggccgagttcagcatgagccccgtgaccagcgcccagggcggcacctacagatgctacagcgccatcagaagctacccctacctgctgagcagccccagctacccccaggagctggtggtgagcggccccagcggcgaccccagcctgagccccaccggcagcacccccacccccgccggccccgaggaccagcccctgacccccaccggcctggacccccagagcggcctgggcagacacctgggcgtggtgaccggcgtgagcgtggccttcgtgctgctgctgttcctgctgctgttcctgctgctgagacacagacaccagagcaagcacagaaccagcgcccacttctacagacccgccggcgccgccggccccgagcccaaggaccagggcctgcagaagagagccagccccgtggccgacatccaggaggagatcctgaacgccgccgtgaaggacacccagcccaaggacggcgtggagatggacgccagagccgccgccagcgaggccccccaggacgtgacctacgcccagctgcacagcctgaccctgagaagagaggccaccgagcccccccccagccaggagagagagccccccgccgagcccagcatctacgcccccctggccatccactag

SEQ ID NO: 86834 - DNA, 1470 bp, Artificial Sequence
  Description of Artificial Sequence: Synthetic coding sequence
atgacccccatcgtgaccgtgctgatctgcctgagactgagcctgggccccagaacccacgtgcaggccggcaccctgcccaagcccaccctgtgggccgagcccggcagcgtgatcacccagggcagccccgtgaccctgtggtgccagggcatcctggagacccaggagtacagactgtacagagagaagaagaccgccccctggatcaccagaatcccccaggagatcgtgaagaagggccagttccccatccccagcatcacctgggagcacaccggcagatacagatgcttctacggcagccacaccgccggctggagcgagcccagcgaccccctggagctggtggtgaccggcgcctacatcaagcccaccctgagcgccctgcccagccccgtggtgaccagcggcggcaacgtgaccctgcactgcgtgagccaggtggccttcggcagcttcatcctgtgcaaggagggcgaggacgagcacccccagtgcctgaacagccagcccagaacccacggctggagcagagccatcttcagcgtgggccccgtgagccccagcagaagatggagctacagatgctacgcctacgacagcaacagcccccacgtgtggagcctgcccagcgacctgctggagctgctggtgctgggcgtgagcaagaagcccagcctgagcgtgcagcccggccccatcgtggcccccggcgagagcctgaccctgcagtgcgtgagcgacgtgagctacgacagattcgtgctgtacaaggagggcgagagagacttcctgcagctgcccggcccccagccccaggccggcctgagccaggccaacttcaccctgggccccgtgagcagaagctacggcggccagtacagatgcagcggcgcctacaacctgagcagcgagtggagcgcccccagcgaccccctggacatcctgatcgccggccagttcagaggcagacccttcatcagcgtgcaccccggccccaccgtggccagcggcgagaacgtgaccctgctgtgccagagctggggccccttccacaccttcctgctgaccaaggccggcgccgccgacgcccccctgagactgagaagcatccacgagtaccccaagtaccaggccgagttccccatgagccccgtgaccagcgcccacagcggcacctacagatgctacggcagcctgagcagcaacccctacctgctgagccaccccagcgacagcctggagctgatggtgagcggcgccgccgagaccctgagccccccccagaacaagagcgacagcaaggccggcgccgccaacaccctgagccccagccagaacaagaccgccagccacccccaggactacaccgtggagaacctgatcagaatgggcatcgccggcctggtgctggtggtgctgggcatcctgctgttcgaggcccagcacagccagagaagcctgtag

SEQ ID NO: 86835 - DNA, 1401 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcatccagggcagccccgtgaccctgagatgccagggcagcctgcaggccgaggagtaccacctgtacagagagaacaagagcgccagctgggtgagaagaatccaggagcccggcaagaacggccagttccccatccccagcatcacctgggagcacgccggcagataccactgccagtactacagccacaaccacagcagcgagtacagcgaccccctggagctggtggtgaccggcgcctacagcaagcccaccctgagcgccctgcccagccccgtggtgaccctgggcggcaacgtgaccctgcagtgcgtgagccaggtggccttcgacggcttcatcctgtgcaaggagggcgaggacgagcacccccagagactgaacagccacagccacgccagaggctggagctgggccatcttcagcgtgggccccgtgagccccagcagaagatggagctacagatgctacgcctacgacagcaacagcccctacgtgtggagcctgcccagcgacctgctggagctgctggtgcccggcgtgagcaagaagcccagcctgagcgtgcagcccggccccatggtggcccccggcgagagcctgaccctgcagtgcgtgagcgacgtgggctacgacagattcgtgctgtacaaggagggcgagagagacttcctgcagagacccggctggcagccccaggccggcctgagccaggccaacttcaccctgggccccgtgagccccagccacggcggccagtacagatgctacagcgcccacaacctgagcagcgagtggagcgcccccagcgaccccctggacatcctgatcaccggccagttctacgacagacccagcctgagcgtgcagcccgtgcccaccgtggcccccggcaagaacgtgaccctgctgtgccagagcagaggccagttccacaccttcctgctgaccaaggagggcgccggccacccccccctgcacctgagaagcgagcaccaggcccagcagaaccaggccgagttcagaatgggccccgtgaccagcgcccacgtgggcacctacagatgctacagcagcctgagcagcaacccctacctgctgagcctgcccagcgaccccctggagctggtggtgagcgccagcctgggccagcacccccaggactacaccgtggagaacctgatcagaatgggcgtggccggcctggtgctggtggtgctgggcatcctgctgttcgaggcccagcacagccagagaagcctgcaggacgccgccggcagatag

SEQ ID NO: 86836 - DNA, 1452 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcatccagggcagccccgtgaccctgagatgccagggcagcctgcaggccgaggagtaccacctgtacagagagaacaagagcgccagctgggtgagaagaatccaggagcccggcaagaacggccagttccccatccccagcatcacctgggagcacgccggcagataccactgccagtactacagccacaaccacagcagcgagtacagcgaccccctggagctggtggtgaccggcgcctacagcaagcccaccctgagcgccctgcccagccccgtggtgaccctgggcggcaacgtgaccctgcagtgcgtgagccaggtggccttcgacggcttcatcctgtgcaaggagggcgaggacgagcacccccagagactgaacagccacagccacgccagaggctggagctgggccatcttcagcgtgggccccgtgagccccagcagaagatggagctacagatgctacgcctacgacagcaacagcccctacgtgtggagcctgcccagcgacctgctggagctgctggtgcccggcgtgagcaagaagcccagcctgagcgtgcagcccggccccatggtggcccccggcgagagcctgaccctgcagtgcgtgagcgacgtgggctacgacagattcgtgctgtacaaggagggcgagagagacttcctgcagagacccggctggcagccccaggccggcctgagccaggccaacttcaccctgggccccgtgagccccagccacggcggccagtacagatgctacagcgcccacaacctgagcagcgagtggagcgcccccagcgaccccctggacatcctgatcaccggccagttctacgacagacccagcctgagcgtgcagcccgtgcccaccgtggcccccggcaagaacgtgaccctgctgtgccagagcagaggccagttccacaccttcctgctgaccaaggagggcgccggccacccccccctgcacctgagaagcgagcaccaggcccagcagaaccaggccgagttcagaatgggccccgtgaccagcgcccacgtgggcacctacagatgctacagcagcctgagcagcaacccctacctgctgagcctgcccagcgaccccctggagctggtggtgagcgaggccgccgagaccctgagccccagccagaacaagaccgacagcaccaccaccagcctgggccagcacccccaggactacaccgtggagaacctgatcagaatgggcgtggccggcctggtgctggtggtgctgggcatcctgctgttcgaggcccagcacagccagagaagcctgcaggacgccgccggcagatag

SEQ ID NO: 86837 - DNA, 1452 bp, Artificial Sequence; identical to SEQ ID NO: 86836
  Description of Artificial Sequence: Synthetic coding sequence

SEQ ID NO: 86838 - DNA, 984 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcatccagggcagccccgtgaccctgagatgccagggcagcctgcaggccgaggagtaccacctgtacagagagaacaagagcgccagctgggtgagaagaatccaggagcccggcaagaacggccagttccccatccccagcatcacctgggagcacgccggcagataccactgccagtactacagccacaaccacagcagcgagtacagcgaccccctggagctggtggtgaccggcgcctacagcaagcccaccctgagcgccctgcccagccccgtggtgaccctgggcggcaacgtgaccctgcagtgcgtgagccaggtggccttcgacggcttcatcctgtgcaaggagggcgaggacgagcacccccagagactgaacagccacagccacgccagaggctggagctgggccatcttcagcgtgggccccgtgagccccagcagaagatggagctacagatgctacgcctacgacagcaacagcccctacgtgtggagcctgcccagcgacctgctggagctgctggtgcccggcgtgagcaagaagcccagcctgagcgtgcagcccggccccatggtggcccccggcgagagcctgaccctgcagtgcgtgagcgacgtgggctacgacagattcgtgctgtacaaggagggcgagagagacttcctgcagagacccggctggcagccccaggccggcctgagccaggccaacttcaccctgggccccgtgagccccagccacggcggccagtacagatgctacagcgcccacaacctgagcagcgagtggagcgcccccagcgaccccctggacatcctgatcaccggccagttctacgacagacccagcctgagctag

SEQ ID NO: 86839 - DNA, 1320 bp, Artificial Sequence
  Description of Artificial Sequence: Synthetic coding sequence
atgacccccatcctgaccgtgctgatctgcctgggcctgagcctggaccccagaacccacgtgcaggccggccccctgcccaagcccaccctgtgggccgagcccggcagcgtgatcacccagggcagccccgtgaccctgagatgccagggcagcctggagacccaggagtaccacctgtacagagagaagaagaccgccctgtggatcaccagaatcccccaggagctggtgaagaagggccagttccccatcctgagcatcacctgggagcacgccggcagatactgctgcatctacggcagccacaccgccggcctgagcgagagcagcgaccccctggagctggtggtgaccggcgcctacagcaagcccaccctgagcgccctgcccagccccgtggtgaccagcggcggcaacgtgaccatccagtgcgacagccaggtggccttcgacggcttcatcctgtgcaaggagggcgaggacgagcacccccagtgcctgaacagccacagccacgccagaggcagcagcagagccatcttcagcgtgggccccgtgagccccagcagaagatggagctacagatgctacggctacgacagcagagccccctacgtgtggagcctgcccagcgacctgctgggcctgctggtgcccggcgtgagcaagaagcccagcctgagcgtgcagcccggccccgtggtggcccccggcgagaagctgaccttccagtgcggcagcgacgccggctacgacagattcgtgctgtacaaggagtggggcagagacttcctgcagagacccggcagacagccccaggccggcctgagccaggccaacttcaccctgggccccgtgagcagaagctacggcggccagtacacctgcagcggcgcctacaacctgagcagcgagtggagcgcccccagcgaccccctggacatcctgatcaccggccagatcagagccagacccttcctgagcgtgagacccggccccaccgtggccagcggcgagaacgtgaccctgctgtgccagagccagggcggcatgcacaccttcctgctgaccaaggagggcgccgccgacagccccctgagactgaagagcaagagacagagccacaagtaccaggccgagttccccatgagccccgtgaccagcgcccacgccggcacctacagatgctacggcagcctgagcagcaacccctacctgctgacccaccccagcgaccccctggagctggtggtgagcggcgccgccgagaccctgagccccccccagaacaagagcgacagcaaggccggcgagtag

SEQ ID NO: 86840 - DNA, 1371 bp, Artificial Sequence
  Description of Artificial Sequence: Synthetic coding sequence
atgcacagaggcctgatccacccccagagcagcgccgtgggcggcgacgccatgacccccatcctgaccgtgctgatctgcctgggcctgagcctggaccccagaacccacgtgcaggccggccccctgcccaagcccaccctgtgggccgagcccggcagcgtgatcacccagggcagccccgtgaccctgagatgccagggcagcctggagacccaggagtaccacctgtacagagagaagaagaccgccctgtggatcaccagaatcccccaggagctggtgaagaagggccagttccccatcctgagcatcacctgggagcacgccggcagatactgctgcatctacggcagccacaccgccggcctgagcgagagcagcgaccccctggagctggtggtgaccggcgcctacagcaagcccaccctgagcgccctgcccagccccgtggtgaccagcggcggcaacgtgaccatccagtgcgacagccaggtggccttcgacggcttcatcctgtgcaaggagggcgaggacgagcacccccagtgcctgaacagccacagccacgccagaggcagcagcagagccatcttcagcgtgggccccgtgagccccagcagaagatggagctacagatgctacggctacgacagcagagccccctacgtgtggagcctgcccagcgacctgctgggcctgctggtgcccggcgtgagcaagaagcccagcctgagcgtgcagcccggccccgtggtggcccccggcgagaagctgaccttccagtgcggcagcgacgccggctacgacagattcgtgctgtacaaggagtggggcagagacttcctgcagagacccggcagacagccccaggccggcctgagccaggccaacttcaccctgggccccgtgagcagaagctacggcggccagtacacctgcagcggcgcctacaacctgagcagcgagtggagcgcccccagcgaccccctggacatcctgatcaccggccagatcagagccagacccttcctgagcgtgagacccggccccaccgtggccagcggcgagaacgtgaccctgctgtgccagagccagggcggcatgcacaccttcctgctgaccaaggagggcgccgccgacagccccctgagactgaagagcaagagacagagccacaagtaccaggccgagttccccatgagccccgtgaccagcgcccacgccggcacctacagatgctacggcagcctgagcagcaacccctacctgctgacccaccccagcgaccccctggagctggtggtgagcggcgccgccgagaccctgagccccccccagaacaagagcgacagcaaggccggcgagtag

SEQ ID NO: 86841 - DNA, 1959 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcggccccagcggcggccccagcagccccaccaccggccccaccagcaccagcgccggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaagcacacccagcccgaggacggcgtggagatggacaccagacagagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcctgaccctgagaagagaggccaccgagcccccccccagccaggagggccccagccccgccgtgcccagcatctacgccaccctggccatccactag

SEQ ID NO: 86842 - DNA, 1953 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcggccccagcggcggccccagcagccccaccaccggccccaccagcaccagcggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaagcacacccagcccgaggacggcgtggagatggacaccagaagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcctgaccctgagaagagaggccaccgagcccccccccagccaggagggccccagccccgccgtgcccagcatctacgccaccctggccatccactag

SEQ ID NO: 86843 - DNA, 1953 bp, Artificial Sequence; identical to SEQ ID NO: 86842
  Description of Artificial Sequence: Synthetic coding sequence

SEQ ID NO: 86844 - DNA, 1905 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcgccggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaagcacacccagcccgaggacggcgtggagatggacaccagaagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcctgaccctgagaagagaggccaccgagcccccccccagccaggagggccccagccccgccgtgcccagcatctacgccaccctggccatccactag

SEQ ID NO: 86845 - DNA, 1953 bp, Artificial Sequence; identical to SEQ ID NO: 86842
  Description of Artificial Sequence: Synthetic coding sequence

SEQ ID NO: 86846 - DNA, 1533 bp, Artificial Sequence
  Description of Artificial Sequence: Synthetic coding sequence
atgacccccatcctgaccgtgctgatctgcctgggcctgagcctgggccccagaacccacgtgcaggccggccacctgcccaagcccaccctgtgggccgagcccggcagcgtgatcacccagggcagccccgtgaccctgagatgccagggcggccaggagacccaggagtacagactgtacagagagaagaagaccgccctgtggatcaccagaatcccccaggagctggtgaagaagggccagttccccatccccagcatcacctgggagcacgccggcagatacagatgctactacggcagcgacaccgccggcagaagcgagagcagcgaccccctggagctggtggtgaccggcgcctacatcaagcccaccctgagcgcccagcccagccccgtggtgaacagcggcggcaacgtgatcctgcagtgcgacagccaggtggccttcgacggcttcagcctgtgcaaggagggcgaggacgagcacccccagtgcctgaacagccagccccacgccagaggcagcagcagagccatcttcagcgtgggccccgtgagccccagcagaagatggtggtacagatgctacgcctacgacagcaacagcccctacgagtggagcctgcccagcgacctgctggagctgctggtgctgggcgtgagcaagaagcccagcctgagcgtgcagcccggccccatcgtggcccccgaggagaccctgaccctgcagtgcggcagcgacgccggctacaacagattcgtgctgtacaaggacggcgagagagacttcctgcagctggccggcgcccagccccaggccggcctgagccaggccaacttcaccctgggccccgtgagcagaagctacggcggccagtacagatgctacggcgcccacaacctgagcagcgagtggagcgcccccagcgaccccctggacatcctgatcgccggccagttctacgacagagtgagcctgagcgtgcagcccggccccaccgtggccagcggcgagaacgtgaccctgctgtgccagagccagggctggatgcagaccttcctgctgaccaaggagggcgccgccgacgacccctggagactgagaagcacctaccagagccagaagtaccaggccgagttccccatgggccccgtgaccagcgcccacgccggcacctacagatgctacggcagccagagcagcaagccctacctgctgacccaccccagcgaccccctggagctggtggtgagcggccccagcggcggccccagcagccccaccaccggccccaccagcaccagcggccccgaggaccagcccctgacccccaccggcagcgacccccagagcggcctgggcagacacctgggcgtggtgatcggcatcctggtggccgtgatcctgctgctgctgctgctgctgctgctgttcctgatcctgagacacagaagacagggcaagcactggaccagcagccccgcccagctgcccatgcccagaaagaagaccagcatgctgccctag

SEQ ID NO: 86847 - DNA, 1797 bp, Artificial Sequence
  Description of Artificial Sequence: Synthetic coding sequence
atgacccccatcgtgaccgtgctgatctgcctgggcctgagcctgggccccagaacccacgtgcagaccggcaccatccccaagcccaccctgtgggccgagcccgacagcgtgatcacccagggcagccccgtgaccctgagctgccagggcagcctggaggcccaggagtacagactgtacagagagaagaagagcgccagctggatcaccagaatcagacccgagctggtgaagaacggccagttccacatccccagcatcacctgggagcacaccggcagatacggctgccagtactacagcagagccagatggagcgagctgagcgaccccctggtgctggtgatgaccggcgcctaccccaagcccaccctgagcgcccagcccagccccgtggtgaccagcggcggcagagtgaccctgcagtgcgagagccaggtggccttcggcggcttcatcctgtgcaaggagggcgaggaggagcacccccagtgcctgaacagccagccccacgccagaggcagcagcagagccatcttcagcgtgggccccgtgagccccaacagaagatggagccacagatgctacggctacgacctgaacagcccctacgtgtggagcagccccagcgacctgctggagctgctggtgcccggcgtgagcaagaagcccagcctgagcgtgcagcccggccccgtggtggcccccggcgagagcctgaccctgcagtgcgtgagcgacgtgggctacgacagattcgtgctgtacaaggagggcgagagagacctgagacagctgcccggcagacagccccaggccggcctgagccaggccaacttcaccctgggccccgtgagcagaagctacggcggccagtacagatgctacggcgcccacaacctgagcagcgagtgcagcgcccccagcgaccccctggacatcctgatcaccggccagatcagaggcacccccttcatcagcgtgcagcccggccccaccgtggccagcggcgagaacgtgaccctgctgtgccagagctggagacagttccacaccttcctgctgaccaaggccggcgccgccgacgcccccctgagactgagaagcatccacgagtaccccaagtaccaggccgagttccccatgagccccgtgaccagcgcccacgccggcacctacagatgctacggcagcctgaacagcgacccctacctgctgagccaccccagcgagcccctggagctggtggtgagcggccccagcatgggcagcagccccccccccaccggccccatcagcacccccgccggccccgaggaccagcccctgacccccaccggcagcgacccccagagcggcctgggcagacacctgggcgtggtgatcggcatcctggtggccgtggtgctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaaggacacccagcccgaggacggcgtggagatggacaccagagccgccgccagcgaggccccccaggacgtgacctacgcccagctgcacagcctgaccctgagaagaaaggccaccgagcccccccccagccaggagagagagccccccgccgagcccagcatctacgccaccctggccatccactag

SEQ ID NO: 86848 - DNA, 1449 bp, Artificial Sequence
  Description of Artificial Sequence: Synthetic coding sequence
atgaccggcgcctaccccaagcccaccctgagcgcccagcccagccccgtggtgaccagcggcggcagagtgaccctgcagtgcgagagccaggtggccttcggcggcttcatcctgtgcaaggagggcgaggaggagcacccccagtgcctgaacagccagccccacgccagaggcagcagcagagccatcttcagcgtgggccccgtgagccccaacagaagatggagccacagatgctacggctacgacctgaacagcccctacgtgtggagcagccccagcgacctgctggagctgctggtgcccggcgtgagcaagaagcccagcctgagcgtgcagcccggccccgtggtggcccccggcgagagcctgaccctgcagtgcgtgagcgacgtgggctacgacagattcgtgctgtacaaggagggcgagagagacctgagacagctgcccggcagacagccccaggccggcctgagccaggccaacttcaccctgggccccgtgagcagaagctacggcggccagtacagatgctacggcgcccacaacctgagcagcgagtgcagcgcccccagcgaccccctggacatcctgatcaccggccagatcagaggcacccccttcatcagcgtgcagcccggccccaccgtggccagcggcgagaacgtgaccctgctgtgccagagctggagacagttccacaccttcctgctgaccaaggccggcgccgccgacgcccccctgagactgagaagcatccacgagtaccccaagtaccaggccgagttccccatgagccccgtgaccagcgcccacgccggcacctacagatgctacggcagcctgaacagcgacccctacctgctgagccaccccagcgagcccctggagctggtggtgagcggccccagcatgggcagcagccccccccccaccggccccatcagcacccccgccggccccgaggaccagcccctgacccccaccggcagcgacccccagagcggcctgggcagacacctgggcgtggtgatcggcatcctggtggccgtggtgctgctgctgctgctgctgctgctgctgttcctgatcctgagacacagaagacagggcaagcactggaccagcacccagagaaaggccgacttccagcaccccgccggcgccgtgggccccgagcccaccgacagaggcctgcagtggagaagcagccccgccgccgacgcccaggaggagaacctgtacgccgccgtgaaggacacccagcccgaggacggcgtggagatggacaccagagccgccgccagcgaggccccccaggacgtgacctacgcccagctgcacagcctgaccctgagaagaaaggccaccgagcccccccccagccaggagagagagccccccgccgagcccagcatctacgccaccctggccatccactag

SEQ ID NO: 86849 - DNA, 1932 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagccaggaggcccaggagtacagactgcacaaggagggcagccccgagcccctggacagaaacaaccccctggagcccaagaacaaggccagattcagcatccccagcatgaccgagcaccacgccggcagatacagatgccactactacagcagcgccggctggagcgagcccagcgaccccctggagatggtgatgaccggcgcctacagcaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcagaggcttccaggccctgttccccgtgggccccgtgacccccagccacagatggagattcacctgctactactactacaccaacaccccctgggtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacaacagattcgtgctgtacaaggagggcgagagagacttcctgcagagacccggccagcagccccaggccggcctgagccaggccaacttcaccctgggccccgtgagccccagcaacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccccgaggaccagcccctgaacccccccggcagcggcccccagaacccccccggcctgggcagcggcgccggcaccagagccgccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 86850 - DNA, 1896 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagccaggaggcccaggagtacagactgcacaaggagggcagccccgagcccctggacagaaacaaccccctggagcccaagaacaaggccagattcagcatccccagcatgaccgagcaccacgccggcagatacagatgccactactacagcagcgccggctggagcgagcccagcgaccccctggagatggtgatgaccggcgcctacagcaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcagaggcttccaggccctgttccccgtgggccccgtgacccccagccacagatggagattcacctgctactactactacaccaacaccccctgggtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacaacagattcgtgctgtacaaggagggcgagagagacttcctgcagagacccggccagcagccccaggccggcctgagccaggccaacttcaccctgggccccgtgagccccagcaacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccacagcggcggcagcagcctgccccccaccggcccccccagcacccccggcctgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 86851 - DNA, 1947 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagcctggaggcccaggagtaccagctggacaaggagggcagccccgagcccctggacagaaacaaccccctggagcccaagaacaaggccagattcagcatccccagcatgacccagcaccacgccggcagatacagatgccactactacagcagcgccggctggagcgagcccagcgaccccctggagctggtgatgaccggcgcctacagcaagcccaccctgagcgccctgcccagccccgtggtggccagcggcggcaacatgaccctgagatgcggcagccagaagggctaccaccacttcgtgctgatgaaggagggcgagcaccagctgcccagaaccctggacagccagcagctgcacagcagaggcttccaggccctgttccccgtgggccccgtgacccccagccacagatggagattcacctgctactactactacaccaacaccccctgggtgtggagccaccccagcgaccccctggagatcctgcccagcggcgtgagcagaaagcccagcctgctgaccctgcagggccccgtgctggcccccggccagagcctgaccctgcagtgcggcagcgacgtgggctacaacagattcgtgctgtacaaggagggcgagagagacttcctgcagagacccggccagcagccccaggccggcctgagccaggccaacttcaccctgggccccgtgagccccagcaacggcggccagtacagatgctacggcgcccacaacctgagcagcgagtggagcgcccccagcgaccccctgaacatcctgatggccggccagatctacgacaccgtgagcctgagcgcccagcccggccccaccgtggccagcggcgagaacgtgaccctgctgtgccagagctggtggcagttcgacaccttcctgctgaccaaggagggcgccgcccacccccccctgagactgagaagcatgtacggcgcccacaagtaccaggccgagttccccatgagccccgtgaccagcgcccacgccggcacctacagatgctacggcagctacagcagcaacccccacctgctgagccaccccagcgagcccctggagctggtggtgagcggccacagcggcggcagcagcctgccccccaccggcccccccagcacccccggcggccccgaggaccagcccctgaacccccccggcagcggcccccagaacagactgggcagatacctggaggtgctgatcggcgtgagcgtggccttcgtgctgctgctgttcctgctgctgttcctgctgctgagaagacagagacacagcaagcacagaaccagcgaccagagaaagaccgacttccagagacccgccggcgccgccgagaccgagcccaaggacagaggcctgctgagaagaagcagccccgccgccgacgtgcaggaggagaacctgtacgccgccgtgaaggacacccagagcgaggacagagtggagctggacagccagagcccccacgacgaggacccccaggccgtgacctacgcccccgtgaagcacagcagccccagaagagagatggccagcccccccagcagcctgagcggcgagttcctggacaccaaggacagacaggtggaggaggacagacagatggacaccgaggccgccgccagcgaggccagccaggacgtgacctacgcccagctgcacagcctgaccctgagaagaaaggccaccgagcccccccccagccaggagggcgagccccccgccgagcccagcatctacgccaccctggccatccactag

SEQ ID NO: 86852 - DNA, 1896 bp, Artificial Sequence; identical to SEQ ID NO: 86850
  Description of Artificial Sequence: Synthetic coding sequence

SEQ ID NO: 86853 - DNA, 477 bp, Artificial Sequence
  Description of Artificial Sequence: Synthetic coding sequence
atgacccccgccctgaccgccctgctgtgcctgggcctgagcctgggccccagaaccagagtgcaggccggccccttccccaagcccaccctgtgggccgagcccggcagcgtgatcagctggggcagccccgtgaccatctggtgccagggcagccaggaggcccaggagtacagactgcacaaggagggcagccccgagcccctggacagaaacaaccccctggagcccaagaacaaggccagattcagcatccccagcatgaccgagcaccacgccggcagatacagatgccactactacagcagcgccggctggagcgagcccagcgaccccctggagatggtgatgaccggcgcctacagcaagcccaccctgagcgccctgcccagccccgtggtggccagcggcggcaacatgaccctgagatgcggcagccagaagggctaccaccacttcgtgctgatgaaggagtag

SEQ ID NO: 86854 - DNA, 1347 bp, Artificial Sequence
  Description of Artificial Sequence: Synthetic coding sequence
atgatccccaccttcaccgccctgctgtgcctgggcctgagcctgggccccagaacccacatgcaggccggccccctgcccaagcccaccctgtgggccgagcccggcagcgtgatcagctggggcaacagcgtgaccatctggtgccagggcaccctggaggccagagagtacagactggacaaggaggagagccccgccccctgggacagacagaaccccctggagcccaagaacaaggccagattcagcatccccagcatgaccgaggactacgccggcagatacagatgctactacagaagccccgtgggctggagccagcccagcgaccccctggagctggtgatgaccggcgcctacagcaagcccaccctgagcgccctgcccagccccctggtgaccagcggcaagagcgtgaccctgctgtgccagagcagaagccccatggacaccttcctgctgatcaaggagagagccgcccaccccctgctgcacctgagaagcgagcacggcgcccagcagcaccaggccgagttccccatgagccccgtgaccagcgtgcacggcggcacctacagatgcttcagcagccacggcttcagccactacctgctgagccaccccagcgaccccctggagctgatcgtgagcggcagcctggaggaccccagacccagccccaccagaagcgtgagcaccgccgccggccccgaggaccagcccctgatgcccaccggcagcgtgccccacagcggcctgagaagacactgggaggtgctgatcggcgtgctggtggtgagcatcctgctgctgagcctgctgctgttcctgctgctgcagcactggagacagggcaagcacagaaccctggcccagagacaggccgacttccagagaccccccggcgccgccgagcccgagcccaaggacggcggcctgcagagaagaagcagccccgccgccgacgtgcagggcgagaacttctgcgccgccgtgaagaacacccagcccgaggacggcgtggagatggacaccagacagagcccccacgacgaggacccccaggccgtgacctacgccaaggtgaagcacagcagacccagaagagagatggccagcccccccagccccctgagcggcgagttcctggacaccaaggacagacaggccgaggaggacagacagatggacaccgaggccgccgccagcgaggccccccaggacgtgacctacgcccagctgcacagcttcaccctgagacagaaggccaccgagcccccccccagccaggagggcgccagccccgccgagcccagcgtgtacgccaccctggccatccactag

SEQ ID NO: 86855 - DNA, 1347 bp, Artificial Sequence; identical to SEQ ID NO: 86854
  Description of Artificial Sequence: Synthetic coding sequence

SEQ ID NO: 86856 - DNA, 1773 bp, Artificial Sequence
  Description of Artificial Sequence: Synthetic coding sequence
atgaccctgaccctgagcgtgctgatctgcctgggcctgagcgtgggccccagaacctgcgtgcaggccggcaccctgcccaagcccaccctgtgggccgagcccgccagcgtgatcgccagaggcaagcccgtgaccctgtggtgccagggccccctggagaccgaggagtacagactggacaaggagggcctgccctgggccagaaagagacagaaccccctggagcccggcgccaaggccaagttccacatccccagcaccgtgtacgacagcgccggcagatacagatgctactacgagacccccgccggctggagcgagcccagcgaccccctggagctggtggccaccggcttctacgccgagcccaccctgctggccctgcccagccccgtggtggccagcggcggcaacgtgaccctgcagtgcgacaccctggacggcctgctgaccttcgtgctggtggaggaggagcagaagctgcccagaaccctgtacagccagaagctgcccaagggccccagccaggccctgttccccgtgggccccgtgacccccagctgcagatggagattcagatgctactactactacagaaagaacccccaggtgtggagcaaccccagcgacctgctggagatcctggtgcccggcgtgagcagaaagcccagcctgctgatcccccagggcagcgtggtggccagaggcggcagcctgaccctgcagtgcagaagcgacgtgggctacgacatcttcgtgctgtacaaggagggcgagcacgacctggtgcagggcagcggccagcagccccaggccggcctgagccaggccaacttcaccctgggccccgtgagcagaagccacggcggccagtacagatgctacggcgcccacaacctgagccccagatggagcgcccccagcgaccccctggacatcctgatcgccggcctgatccccgacatccccgccctgagcgtgcagcccggccccaaggtggccagcggcgagaacgtgaccctgctgtgccagagctggcaccagatcgacaccttcttcctgaccaaggagggcgccgcccacccccccctgtgcctgaagagcaagtaccagagctacagacaccaggccgagttcagcatgagccccgtgaccagcgcccagggcggcacctacagatgctacagcgccatcagaagctacccctacctgctgagcagccccagctacccccaggagctggtggtgagcggccccagcggcgaccccagcctgagccccaccggcagcacccccacccccggccccgaggaccagcccctgacccccaccggcctggacccccagagcggcctgggcagacacctgggcgtggtgaccggcgtgagcgtggccttcgtgctgctgctgttcctgctgctgttcctgctgctgagacacagacaccagagcaagcacagaaccagcgcccacttctacagacccgccggcgccgccggccccgagcccaaggaccagggcctgcagaagagagccagccccgtggccgacatccaggaggagatcctgaacgccgccgtgaaggacacccagcccaaggacggcgtggagatggacgccagagccgccgccagcgaggccccccaggacgtgacctacgcccagctgcacagcctgaccctgagaagagaggccaccgagcccccccccagccaggagagagagccccccgccgagcccagcatctacgcccccctggccatccactag

SEQ ID NO: 86857 - DNA, 1776 bp, Artificial Sequence
  Description of Artificial Sequence: Synthetic coding sequence
atgaccctgaccctgagcgtgctgatctgcctgggcctgagcgtgggccccagaacctgcgtgcaggccggcaccctgcccaagcccaccctgtgggccgagcccgccagcgtgatcgccagaggcaagcccgtgaccctgtggtgccagggccccctggagaccgaggagtacagactggacaaggagggcctgccctgggccagaaagagacagaaccccctggagcccggcgccaaggccaagttccacatccccagcaccgtgtacgacagcgccggcagatacagatgctactacgagacccccgccggctggagcgagcccagcgaccccctggagctggtggccaccggcttctacgccgagcccaccctgctggccctgcccagccccgtggtggccagcggcggcaacgtgaccctgcagtgcgacaccctggacggcctgctgaccttcgtgctggtggaggaggagcagaagctgcccagaaccctgtacagccagaagctgcccaagggccccagccaggccctgttccccgtgggccccgtgacccccagctgcagatggagattcagatgctactactactacagaaagaacccccaggtgtggagcaaccccagcgacctgctggagatcctggtgcccggcgtgagcagaaagcccagcctgctgatcccccagggcagcgtggtggccagaggcggcagcctgaccctgcagtgcagaagcgacgtgggctacgacatcttcgtgctgtacaaggagggcgagcacgacctggtgcagggcagcggccagcagccccaggccggcctgagccaggccaacttcaccctgggccccgtgagcagaagccacggcggccagtacagatgctacggcgcccacaacctgagccccagatggagcgcccccagcgaccccctggacatcctgatcgccggcctgatccccgacatccccgccctgagcgtgcagcccggccccaaggtggccagcggcgagaacgtgaccctgctgtgccagagctggcaccagatcgacaccttcttcctgaccaaggagggcgccgcccacccccccctgtgcctgaagagcaagtaccagagctacagacaccaggccgagttcagcatgagccccgtgaccagcgcccagggcggcacctacagatgctacagcgccatcagaagctacccctacctgctgagcagccccagctacccccaggagctggtggtgagcggccccagcggcgaccccagcctgagccccaccggcagcacccccacccccgccggccccgaggaccagcccctgacccccaccggcctggacccccagagcggcctgggcagacacctgggcgtggtgaccggcgtgagcgtggccttcgtgctgctgctgttcctgctgctgttcctgctgctgagacacagacaccagagcaagcacagaaccagcgcccacttctacagacccgccggcgccgccggccccgagcccaaggaccagggcctgcagaagagagccagccccgtggccgacatccaggaggagatcctgaacgccgccgtgaaggacacccagcccaaggacggcgtggagatggacgccagagccgccgccagcgaggccccccaggacgtgacctacgcccagctgcacagcctgaccctgagaagagaggccaccgagcccccccccagccaggagagagagccccccgccgagcccagcatctacgcccccctggccatccactag

SEQ ID NO: 86858 - DNA, 1869 bp, Artificial Sequence
  Description of Artificial Sequence: Synthetic coding sequence
atgaccctgaccctgagcgtgctgatctgcctgggcctgagcgtgggccccagaacctgcgtgcaggccggcaccctgcccaagcccaccctgtgggccgagcccgccagcgtgatcgccagaggcaagcccgtgaccctgtggtgccagggccccctggagaccgaggagtacagactggacaaggagggcctgccctgggccagaaagagacagaaccccctggagcccggcgccaaggccaagttccacatccccagcaccgtgtacgacagcgccggcagatacagatgctactacgagacccccgccggctggagcgagcccagcgaccccctggagctggtggccaccgccctgcccagccccgtggtggccagcggcggcaacgtgaccctgcagtgcgacaccctggacggcctgctgaccttcgtgctggtggaggaggagcagaagctgcccagaaccctgtacagccagaagctgcccaagggccccagccaggccctgttccccgtgggccccgtgacccccagctgcagatggagattcagatgctactactactacagaaagaacccccaggtgtggagcaaccccagcgacctgctggagatcctggtgcccggcgtgagcagaaagcccagcctgctgatcccccagggcagcgtggtggccagaggcggcagcctgaccctgcagtgcagaagcgacgtgggctacgacatcttcgtgctgtacaaggagggcgagcacgacctggtgcagggcagcggccagcagccccaggccggcctgagccaggccaacttcaccctgggccccgtgagcagaagccacggcggccagtacagatgctacggcgcccacaacctgagccccagatggagcgcccccagcgaccccctggacatcctgatcgccggcctgatccccgacatccccgccctgagcgtgcagcccggccccaaggtggccagcggcgagaacgtgaccctgctgtgccagagctggcaccagatcgacaccttcttcctgaccaaggagggcgccgcccacccccccctgtgcctgaagagcaagtaccagagctacagacaccaggccgagttcagcatgagccccgtgaccagcgcccagggcggcacctacagatgctacagcgccatcagaagctacccctacctgctgagcagccccagctacccccaggagctggtggtgagcggccccagcggcgaccccagcctgagccccaccggcagcacccccacccccgccggccccgaggaccagcccctgacccccaccggcctggacccccagagcggcctgggcagacacctgggcgtggtgaccggcgtgagcgtggccttcgtgctgctgctgttcctgctgctgttcctgctgctgagacacagacaccagagcaagcacagaaccagcgcccacttctacagacccgccggcgccgccggccccgagcccaaggaccagggcctgcagaagagagccagccccgtggccgacatccaggaggagatcctgaacgccgccgtgaaggacacccagcccaaggacggcgtggagatggacgccagacagagcccccacgacgaggacccccaggccgtgacctacgccgaggtgaagcacagcagacccagaagagagatggccagcccccccagccccctgagcggcgagttcctggacaccaaggacagacaggccgaggaggacagacagatggacaccgagagagtgctgagcagccccggcccccaggccagcccccccccccccagaagcctgcccctgaccctgcccagatgcagactgctgcacctgaagccccccagaatgtag

SEQ ID NO: 86859 - DNA, 2595 bp, Artificial Sequence
  Description of Artificial Sequence: Synthetic coding sequence
atgggctgctggggccagctgctggtgtggttcggcgccgccggcgccatcctgtgcagcagccccggcagccaggagaccttcctgagaagcagccccctgcccctggccagccccagccccagagaccccaaggtgagcgccccccccagcatcctggagcccgccagccccctgaacagccccggcaccgagggcagctggctgttcagcacctgcggcgccagcggcagacacggccccacccagacccagtgcgacggcgcctacgccggcaccagcgtggtggtgaccgtgggcgccgccggccagctgagaggcgtgcagctgtggagagtgcccggccccggccagtacctgatcagcgcctacggcgccgccggcggcaagggcgccaagaaccacctgagcagagcccacggcgtgttcgtgagcgccatcttcagcctgggcctgggcgagagcctgtacatcctggtgggccagcagggcgaggacgcctgccccggcggcagccccgagagccagctggtgtgcctgggcgagagcagagccgtggaggagcacgccgccatggacggcagcgagggcgtgcccggcagcagaagatgggccggcggcggcggcggcggcggcggcgccacctacgtgttcagagtgagagccggcgagctggagcccctgctggtggccgccggcggcggcggcagagcctacctgagacccagagacagaggcagaacccaggccagccccgagaagctggagaacagaagcgaggcccccggcagcggcggcagaggcggcgccgccggcggcggcggcggctggaccagcagagcccccagcccccaggccggcagaagcctgcaggagggcgccgagggcggccagggctgcagcgaggcctgggccaccctgggctgggccgccgccggcggcttcggcggcggcggcggcgcctgcaccgccggcggcggcggcggcggctacagaggcggcgacgccagcgagaccgacaacctgtgggccgacggcgaggacggcgtgagcttcatccaccccagcagcgagctgttcctgcagcccctggccgtgaccgagaaccacggcgaggtggagatcagaagacacctgaactgcagccactgccccctgagagactgccagtggcaggccgagctgcagctggccgagtgcctgtgccccgagggcatggagctggccgtggacaacgtgacctgcatggacctgcacaagccccccggccccctggtgctgatggtggccgtggtggccaccagcaccctgagcctgctgatggtgtgcggcgtgctgatcctggtgaagcagaagaagtggcagggcctgcaggagatgagactgcccagccccgagctggagctgagcaagctgagaaccagcgccatcagaaccgcccccaacccctactactgccaggtgggcctgggccccgcccagagctggcccctgccccccggcgtgaccgaggtgagccccgccaacgtgaccctgctgagagccctgggccacggcgccttcggcgaggtgtacgagggcctggtgatcggcctgcccggcgacagcagccccctgcaggtggccatcaagaccctgcccgagctgtgcagcccccaggacgagctggacttcctgatggaggccctgatcatcagcaagttcagacaccagaacatcgtgagatgcgtgggcctgagcctgagagccacccccagactgatcctgctggagctgatgagcggcggcgacatgaagagcttcctgagacacagcagaccccacctgggccagcccagccccctggtgatgagagacctgctgcagctggcccaggacatcgcccagggctgccactacctggaggagaaccacttcatccacagagacatcgccgccagaaactgcctgctgagctgcgccggccccagcagagtggccaagatcggcgacttcggcatggccagagacatctacagagccagctactacagaagaggcgacagagccctgctgcccgtgaagtggatgccccccgaggccttcctggagggcatcttcaccagcaagaccgacagctggagcttcggcgtgctgctgtgggagatcttcagcctgggctacatgccctaccccggcagaaccaaccaggaggtgctggacttcgtggtgggcggcggcagaatggacccccccagaggctgccccggccccgtgtacagaatcatgacccagtgctggcagcacgagcccgagctgagacccagcttcgccagcatcctggagagactgcagtactgcacccaggaccccgacgtgctgaacagcctgctgcccatggagctgggccccacccccgaggaggagggcaccagcggcctgggcaacagaagcctggagtgcctgagacccccccagccccaggagctgagccccgagaagctgaagagctggggcggcagccccctgggcccctggctgagcagcggcctgaagcccctgaagagcagaggcctgcagccccagaacctgtggaaccccacctacagaagctag

SEQ ID NO: 86860 - DNA, 2412 bp, Artificial Sequence
  Description of Artificial Sequence: Synthetic coding sequence
atgggctgctggggccagctgctggtgtggttcggcgccgccggcgccatcctgtgcagcagccccggcagccaggagaccttcctgagaagcagccccctgcccctggccagccccagccccagagaccccaaggtgagcgccccccccagcatcctggagcccgccagccccctgaacagccccggcaccgagggcagctggctgttcagcacctgcggcgccagcggcagacacggccccacccagacccagtgcgacggcgcctacgccggcaccagcgtggtggtgaccgtgggcgccgccggccagctgagaggcgtgcagctgtggagagtgcccggccccggccagtacctgatcagcgcctacggcgccgccggcggcaagggcgccaagaaccacctgagcagagcccacggcgtgttcgtgagcgccatcttcagcctgggcctgggcgagagcctgtacatcctggtgggccagcagggcgaggacgcctgccccggcggcagccccgagagccagctggtgtgcctgggcgagagcagagccgtggaggagcacgccgccatggacggcagcgagggcgtgcccggcagcagaagatgggccggcggcggcggcggcggcggcggcgccacctacgtgttcagagtgagagccggcgagctggagcccctgctggtggccgccggcggcggcggcagagcctacctgagacccagagacagaggcagaacccaggccagccccgagaagctggagaacagaagcgaggcccccggcagcggcggcagaggcggcgccgccggcggcgacgccagcgagaccgacaacctgtgggccgacggcgaggacggcgtgagcttcatccaccccagcagcgagctgttcctgcagcccctggccgtgaccgagaaccacggcgaggtggagatcagaagacacctgaactgcagccactgccccctgagagactgccagtggcaggccgagctgcagctggccgagtgcctgtgccccgagggcatggagctggccgtggacaacgtgacctgcatggacctgcacaagccccccggccccctggtgctgatggtggccgtggtggccaccagcaccctgagcctgctgatggtgtgcggcgtgctgatcctggtgaagcagaagaagtggcagggcctgcaggagatgagactgcccagccccgagctggagctgagcaagctgagaaccagcgccatcagaaccgcccccaacccctactactgccaggtgggcctgggccccgcccagagctggcccctgccccccggcgtgaccgaggtgagccccgccaacgtgaccctgctgagagccctgggccacggcgccttcggcgaggtgtacgagggcctggtgatcggcctgcccggcgacagcagccccctgcaggtggccatcaagaccctgcccgagctgtgcagcccccaggacgagctggacttcctgatggaggccctgatcatcagcaagttcagacaccagaacatcgtgagatgcgtgggcctgagcctgagagccacccccagactgatcctgctggagctgatgagcggcggcgacatgaagagcttcctgagacacagcagaccccacctgggccagcccagccccctggtgatgagagacctgctgcagctggcccaggacatcgcccagggctgccactacctggaggagaaccacttcatccacagagacatcgccgccagaaactgcctgctgagctgcgccggccccagcagagtggccaagatcggcgacttcggcatggccagagacatctacagagccagctactacagaagaggcgacagagccctgctgcccgtgaagtggatgccccccgaggccttcctggagggcatcttcaccagcaagaccgacagctggagcttcggcgtgctgctgtgggagatcttcagcctgggctacatgccctaccccggcagaaccaaccaggaggtgctggacttcgtggtgggcggcggcagaatggacccccccagaggctgccccggccccgtgtacagaatcatgacccagtgctggcagcacgagcccgagctgagacccagcttcgccagcatcctggagagactgcagtactgcacccaggaccccgacgtgctgaacagcctgctgcccatggagctgggccccacccccgaggaggagggcaccagcggcctgggcaacagaagcctggagtgcctgagacccccccagccccaggagctgagccccgagaagctgaagagctggggcggcagccccctgggcccctggctgagcagcggcctgaagcccctgaagagcagaggcctgcagccccagaacctgtggaaccccacctacagaagctag

SEQ ID NO: 86861 - DNA, 1437 bp, Artificial Sequence
  Description of Artificial Sequence: Synthetic coding sequence
atgggctgctggggccagctgctggtgtggttcggcgccgccggcgccatcctgtgcagcagccccggcagccaggagaccttcctgagaagcagccccctgcccctggccagccccagccccagagaccccaaggtgagcgccccccccagcatcctggagcccgccagccccctgaacagccccggcaccgagggcagctggctgttcagcacctgcggcgccagcggcagacacggccccacccagacccagtgcgacggcgcctacgccggcaccagcgtggtggtgaccgtgggcgccgccggccagctgagaggcgtgcagctgtggagagtgcccggccccggccagtacctgatcagcgcctacggcgccgccggcggcaagggcgccaagaaccacctgagcagagcccacggcgtgttcgtgagcgccatcttcagcctgggcctgggcgagagcctgtacatcctggtgggccagcagggcgaggacgcctgccccggcggcagccccgagagccagctggtgtgcctgggcgagagcagagccgtggaggagcacgccgccatggacggcagcgagggcgtgcccggcagcagaagatgggccggcggcggcggcggcggcggcggcgccacctacgtgttcagagtgagagccggcgagctggagcccctgctggtggccgccggcggcggcggcagagcctacctgagacccagagacagaggcagaacccaggccagccccgagaagctggagaacagaagcgaggcccccggcagcggcggcagaggcggcgccgccggcggcggcggcggctggaccagcagagcccccagcccccaggccggcagaagcctgcaggagggcgccgagggcggccagggctgcagcgaggcctgggccaccctgggctgggccgccgccggcggcttcggcggcggcggcggcgcctgcaccgccggcggcggcggcggcggctacagaggcggcgacgccagcgagaccgacaacctgtgggccgacggcgaggacggcgtgagcttcatccaccccagcagcgagctgttcctgcagcccctggccgtgaccgagaaccacggcgaggtggagatcagaagacacctgaactgcagccactgccccctgagagactgccagtggcaggccgagctgcagctggccgagtgcctgtgccccgagggcatggagctggccgtggacaacgtgacctgcatggacctgcacaagccccccggccccctggtgctgatggtggccgtggtggccaccagcaccctgagcctgctgatggtgtgcggcgtgctgatcctgggcaccaagagactggccggcaccgtggacagcagactgctgctgagcagcgagctgggctgggtgagcgccggcggcggcagaagaagatag

SEQ ID NO: 86862 - DNA, 2205 bp, Artificial Sequence
  Description of Artificial Sequence: Synthetic coding sequence
atgggctgctggggccagctgctggtgtggttcggcgccgccggcgccatcctgtgcagcagccccggcagccaggagaccttcctgagaagcagccccctgcccctggccagccccagccccagagaccccaaggtgagcgccccccccagcatcctggagcccgccagccccctgaacagccccggcaccgagggcagctggctgttcagcacctgcggcgccagcggcagacacggccccacccagacccagtgcgacggcgcctacgccggcaccagcgtggtggtgaccgtgggcgccgccggccagctgagaggcgtgcagctgtggagagtgcccggccccggccagtacctgatcagcgcctacggcgccgccggcggcaagggcgccaagaaccacctgagcagagcccacggcgtgttcgtgagcgccatcttcagcctgggcctgggcgagagcctgtacatcctggtgggccagcagggcgaggacgcctgccccggcggcagccccgagagccagctggtgtgcctgggcgagagcagagccgtggaggagcacgccgccatggacggcagcgagggcgtgcccggcagcagaagatgggccggcggcggcggcggcggcggcggcgccacctacgtgttcagagtgagagccggcgagctggagcccctgctggtggccgccggcggcggcggcagagcctacctgagacccagagacagaggcagaacccaggccagccccgagaagctggagaacagaagcgaggcccccggcagcggcggcagaggcggcgccgccggcggcgacgccagcgagaccgacaacctgtgggccgacggcgaggacggcgtgagcttcatccaccccagcagcgagctgttcctgcagcccctggccgtgaccgagaaccacggcgaggtggagatcagaagacacctgaactgcagccactgccccctgagagactgccagtggcaggccgagctgcagctggccgagtgcctgtgccccgagggcatggagctggccgtggacaacgtgacctgcatggacctgcacaagccccccggccccctggtgctgatggtggccgtggtggccaccagcaccctgagcctgctgatggtgtgcggcgtgctgatcctgggcggcgcctggcccggccccgtgctggccagcgccaccagatgccacagaggcttccccagccagtgctacagcgcccagaccctgcccgagctgtgcagcccccaggacgagctggacttcctgatggaggccctgatcatcagcaagttcagacaccagaacatcgtgagatgcgtgggcctgagcctgagagccacccccagactgatcctgctggagctgatgagcggcggcgacatgaagagcttcctgagacacagcagaccccacctgggccagcccagccccctggtgatgagagacctgctgcagctggcccaggacatcgcccagggctgccactacctggaggagaaccacttcatccacagagacatcgccgccagaaactgcctgctgagctgcgccggccccagcagagtggccaagatcggcgacttcggcatggccagagacatctacagagccagctactacagaagaggcgacagagccctgctgcccgtgaagtggatgccccccgaggccttcctggagggcatcttcaccagcaagaccgacagctggagcttcggcgtgctgctgtgggagatcttcagcctgggctacatgccctaccccggcagaaccaaccaggaggtgctggacttcgtggtgggcggcggcagaatggacccccccagaggctgccccggccccgtgtacagaatcatgacccagtgctggcagcacgagcccgagctgagacccagcttcgccagcatcctggagagactgcagtactgcacccaggaccccgacgtgctgaacagcctgctgcccatggagctgggccccacccccgaggaggagggcaccagcggcctgggcaacagaagcctggagtgcctgagacccccccagccccaggagctgagccccgagaagctgaagagctggggcggcagccccctgggcccctggctgagcagcggcctgaagcccctgaagagcagaggcctgcagccccagaacctgtggaaccccacctacagaagctag

SEQ ID NO: 86863 - DNA, 180 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagaggccccggcctgctgagagccggcacccccctgtgcatcagcgccgaggccgccagcgcccagcagtag

SEQ ID NO: 86864 - DNA, 201 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagcccccagcgtgctggtgcccggccccggcctgctgagagccggcacccccctgtgcatcagcgccgaggccgccagcgcccagcagtag

SEQ ID NO: 86865 - DNA, 222 bp, Artificial Sequence
  Description of Artificial Sequence: Synthetic coding sequence
atgctgagcagaaacgacgtgaagagactggagagaagctggcacctgctgagctggagccaggcccagggcagcagcgagcaggagctgcactacgccagcctgcagagactgcccgtgcccagcagcgagggccccgacctgagaggcagagacaagagaggcaccaaggaggaccccagagccgactacgcctgcatcgccgagaacaagcccacctag

SEQ ID NO: 86866 - DNA, 201 bp, Artificial Sequence
  Description of Artificial Sequence: Synthetic coding sequence
atgctgagcagaaacgacgtgaagagactggagagaagctgggcccagggcagcagcgagcaggagctgcactacgccagcctgcagagactgcccgtgcccagcagcgagggccccgacctgagaggcagagacaagagaggcaccaaggaggaccccagagccgactacgcctgcatcgccgagaacaagcccacctag

SEQ ID NO: 86867 - DNA, 108 bp, Artificial Sequence
  Description of Artificial Sequence: Synthetic coding sequence
atgctgagcagaaacgacgcccccagcgtgctggtgcccggccccggcctgctgagagccggcacccccctgtgcatcagcgccgaggccgccagcgcccagcagtag

SEQ ID NO: 86868 - DNA, 315 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagtgaagagactggagagaagctggcacctgctgagctggagccaggcccagggcagcagcgagcaggagctgcactacgccagcctgcagagactgcccgtgcccagcagcgagggccccgacctgagaggcagagacaagagaggcaccaaggaggaccccagagccgactacgcctgcatcgccgagaacaagcccacctag

SEQ ID NO: 86869 - DNA, 42 bp, Artificial Sequence
  Description of Artificial Sequence: Synthetic coding sequence
atgctgagcagaaacgacgaggccgccagcgcccagcagtag

SEQ ID NO: 86870 - DNA, 108 bp, Artificial Sequence; identical to SEQ ID NO: 86867
  Description of Artificial Sequence: Synthetic coding sequence

SEQ ID NO: 86871 - DNA, 276 bp, Artificial Sequence
  Description of Artificial Sequence: Synthetic coding sequence
atgatctacgtgagcaccggcgcctggggctgggccggcagctgcttctggcagtggagcttctgcccccccgcctgcgtgggctgcatcgaggagcacctgctgagctggagccaggcccagggcagcagcgagcaggagctgcactacgccagcctgcagagactgcccgtgcccagcagcgagggccccgacctgagaggcagagacaagagaggcaccaaggaggaccccagagccgactacgcctgcatcgccgagaacaagcccacctag

SEQ ID NO: 86872 - DNA, 156 bp, Artificial Sequence
  Description of Artificial Sequence: Synthetic coding sequence
atgctgagcagaaacgacgtgaagagactggagagaagctggagactgcccgtgcccagcagcgagggccccgacctgagaggcagagacaagagaggcaccaaggaggaccccagagccgactacgcctgcatcgccgagaacaagcccacctag

SEQ ID NO: 86873 - DNA, 192 bp, Artificial Sequence
  Description of Artificial Sequence: Synthetic coding sequence
atgcacctgtgcagaggctgccagtgccccgccgtgagagacctgaccagcggcgccgagaccagagaggcccccagaagaatccaggagctgaccatgcccgccctgctgagaaccaacccccccgagcaccccagacacctgccccagcccagaagagtggacagagtgcccctgtggagcagccagtag

SEQ ID NO: 86874 - DNA, 222 bp, Artificial Sequence; identical to SEQ ID NO: 86865
  Description of Artificial Sequence: Synthetic coding sequence

SEQ ID NO: 86875 - DNA, 108 bp, Artificial Sequence; identical to SEQ ID NO: 86867
  Description of Artificial Sequence: Synthetic coding sequence

SEQ ID NO: 86876 - DNA, 201 bp, Artificial Sequence; identical to SEQ ID NO: 86864
  Description of Artificial Sequence: Synthetic coding sequence

SEQ ID NO: 86877 - DNA, 315 bp, Artificial Sequence; identical to SEQ ID NO: 86868
  Description of Artificial Sequence: Synthetic coding sequence

SEQ ID NO: 86878 - DNA, 135 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagaggccgccagcgcccagcagtag

SEQ ID NO: 86879 - DNA, 201 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagtgaagagactggagagaagctggagactgcccgtgcccagcagcgagggccccgacctgagaggcagagacaagagaggcaccaagtag

SEQ ID NO: 86880 - DNA, 201 bp, Artificial Sequence; identical to SEQ ID NO: 86866
  Description of Artificial Sequence: Synthetic coding sequence

SEQ ID NO: 86881 - DNA, 294 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagtgaagagactggagagaagctgggcccagggcagcagcgagcaggagctgcactacgccagcctgcagagactgcccgtgcccagcagcgagggccccgacctgagaggcagagacaagagaggcaccaaggaggaccccagagccgactacgcctgcatcgccgagaacaagcccacctag

SEQ ID NO: 86882 - DNA, 180 bp, Artificial Sequence; identical to SEQ ID NO: 86863
  Description of Artificial Sequence: Synthetic coding sequence

SEQ ID NO: 86883 - DNA, 87 bp, Artificial Sequence
  Description of Artificial Sequence: Synthetic coding sequence
atgctgagcagaaacgacggccccggcctgctgagagccggcacccccctgtgcatcagcgccgaggccgccagcgcccagcagtag

SEQ ID NO: 86884 - DNA, 87 bp, Artificial Sequence; identical to SEQ ID NO: 86883
  Description of Artificial Sequence: Synthetic coding sequence

SEQ ID NO: 86885 - DNA, 87 bp, Artificial Sequence; identical to SEQ ID NO: 86883
  Description of Artificial Sequence: Synthetic coding sequence

SEQ ID NO: 86886 - DNA, 87 bp, Artificial Sequence; identical to SEQ ID NO: 86883
  Description of Artificial Sequence: Synthetic coding sequence

SEQ ID NO: 86887 - DNA, 42 bp, Artificial Sequence; identical to SEQ ID NO: 86869
  Description of Artificial Sequence: Synthetic coding sequence

SEQ ID NO: 86888 - DNA, 249 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagtgaagagactggagagaagctggagactgcccgtgcccagcagcgagggccccgacctgagaggcagagacaagagaggcaccaaggaggaccccagagccgactacgcctgcatcgccgagaacaagcccacctag

SEQ ID NO: 86889 - DNA, 201 bp, Artificial Sequence; identical to SEQ ID NO: 86866
  Description of Artificial Sequence: Synthetic coding sequence

SEQ ID NO: 86890 - DNA, 201 bp, Artificial Sequence; identical to SEQ ID NO: 86866
  Description of Artificial Sequence: Synthetic coding sequence

SEQ ID NO: 86891 - DNA, 294 bp, Artificial Sequence; identical to SEQ ID NO: 86881
  Description of Artificial Sequence: Synthetic coding sequence

SEQ ID NO: 86892 - DNA, 156 bp, Artificial Sequence; identical to SEQ ID NO: 86872
  Description of Artificial Sequence: Synthetic coding sequence

SEQ ID NO: 86893 - DNA, 294 bp, Artificial Sequence; identical to SEQ ID NO: 86881
  Description of Artificial Sequence: Synthetic coding sequence

SEQ ID NO: 86894 - DNA, 315 bp, Artificial Sequence; identical to SEQ ID NO: 86868
  Description of Artificial Sequence: Synthetic coding sequence

SEQ ID NO: 86895 - DNA, 132 bp, Artificial Sequence
  Description of Artificial Sequence: Synthetic coding sequence
tacagaggcatgatgatctacgtgagcaccggcgcctggggctgggccggcagctgcttctggcagtggagcttctgcccccccgcctgcgtgggctgcatcgaggagagactgcccgtgcccagcagctag

SEQ ID NO: 86896 - DNA, 111 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagatag

SEQ ID NO: 86897 - DNA, 315 bp, Artificial Sequence; identical to SEQ ID NO: 86868
  Description of Artificial Sequence: Synthetic coding sequence

SEQ ID NO: 86898 - DNA, 141 bp, Artificial Sequence
  Description of Artificial Sequence: Synthetic coding sequence
atgctgagcagaaacgacgacatctgcatctacggcggcctgggcctgggcggcctgctgctgctggccgtggtgctgctgagcgcctgcctgtgctggctgcacagaagagagcactgcctggccctggagcccctgtag

SEQ ID NO: 86899 - DNA, 42 bp, Artificial Sequence; identical to SEQ ID NO: 86869
  Description of Artificial Sequence: Synthetic coding sequence

SEQ ID NO: 86900 - DNA, 87 bp, Artificial Sequence; identical to SEQ ID NO: 86883
  Description of Artificial Sequence: Synthetic coding sequence

SEQ ID NO: 86901 - DNA, 201 bp, Artificial Sequence; identical to SEQ ID NO: 86866
  Description of Artificial Sequence: Synthetic coding sequence

SEQ ID NO: 86902 - DNA, 87 bp, Artificial Sequence; identical to SEQ ID NO: 86883
  Description of Artificial Sequence: Synthetic coding sequence

SEQ ID NO: 86903 - DNA, 87 bp, Artificial Sequence; identical to SEQ ID NO: 86883
  Description of Artificial Sequence: Synthetic coding sequence

SEQ ID NO: 86904 - DNA, 132 bp, Artificial Sequence
  Description of Artificial Sequence: Synthetic coding sequence
tgaagcagaaacgacgacatctgcatctacggcggcctgggcctgggcggcctgctgctgctggccgtggtgctgctgagcgcctgcctgtgctggctgcacagaagagaggccgccagcgcccagcagtag

SEQ ID NO: 86905 - DNA, 156 bp, Artificial Sequence; identical to SEQ ID NO: 86872
  Description of Artificial Sequence: Synthetic coding sequence

SEQ ID NO: 86906 - DNA, 108 bp, Artificial Sequence; identical to SEQ ID NO: 86867
  Description of Artificial Sequence: Synthetic coding sequence

SEQ ID NO: 86907 - DNA, 42 bp, Artificial Sequence; identical to SEQ ID NO: 86869
  Description of Artificial Sequence: Synthetic coding sequence

SEQ ID NO: 86908 - DNA, 294 bp, Artificial Sequence; identical to SEQ ID NO: 86881
  Description of Artificial Sequence: Synthetic coding sequence

SEQ ID NO: 86909 - DNA, 201 bp, Artificial Sequence; identical to SEQ ID NO: 86866
  Description of Artificial Sequence: Synthetic coding sequence

SEQ ID NO: 86910 - DNA, 141 bp, Artificial Sequence; identical to SEQ ID NO: 86898
  Description of Artificial Sequence: Synthetic coding sequence

SEQ ID NO: 86911 - DNA, 132 bp, Artificial Sequence; identical to SEQ ID NO: 86904
  Description of Artificial Sequence: Synthetic coding sequence

SEQ ID NO: 86912 - DNA, 141 bp, Artificial Sequence; identical to SEQ ID NO: 86898
  Description of Artificial Sequence: Synthetic coding sequence

SEQ ID NO: 86913 - DNA, 87 bp, Artificial Sequence; identical to SEQ ID NO: 86883
  Description of Artificial Sequence: Synthetic coding sequence

SEQ ID NO: 86914 - DNA, 132 bp, Artificial Sequence; identical to SEQ ID NO: 86904
  Description of Artificial Sequence: Synthetic coding sequence

SEQ ID NO: 86915 - DNA, 201 bp, Artificial Sequence; identical to SEQ ID NO: 86866
  Description of Artificial Sequence: Synthetic coding sequence

SEQ ID NO: 86916 - DNA, 180 bp, Artificial Sequence; identical to SEQ ID NO: 86863
  Description of Artificial Sequence: Synthetic coding sequence

SEQ ID NO: 86917 - DNA, 222 bp, Artificial Sequence; identical to SEQ ID NO: 86865
  Description of Artificial Sequence: Synthetic coding sequence

SEQ ID NO: 86918 - DNA, 201 bp, Artificial Sequence; identical to SEQ ID NO: 86864
  Description of Artificial Sequence: Synthetic coding sequence

SEQ ID NO: 86919 - DNA, 201 bp, Artificial Sequence; identical to SEQ ID NO: 86866
  Description of Artificial Sequence: Synthetic coding sequence

SEQ ID NO: 86920 - DNA, 87 bp, Artificial Sequence; identical to SEQ ID NO: 86883
  Description of Artificial Sequence: Synthetic coding sequence

SEQ ID NO: 86921 - DNA, 249 bp, Artificial Sequence; identical to SEQ ID NO: 86888
  Description of Artificial Sequence: Synthetic coding sequence

SEQ ID NO: 86922 - DNA, 156 bp, Artificial Sequence; identical to SEQ ID NO: 86872
  Description of Artificial Sequence: Synthetic coding sequence

SEQ ID NO: 86923 - DNA, 180 bp, Artificial Sequence; identical to SEQ ID NO: 86863
  Description of Artificial Sequence: Synthetic coding sequence

SEQ ID NO: 86924 - DNA, 201 bp, Artificial Sequence; identical to SEQ ID NO: 86866
  Description of Artificial Sequence: Synthetic coding sequence

SEQ ID NO: 86925 - DNA, 156 bp, Artificial Sequence; identical to SEQ ID NO: 86872
  Description of Artificial Sequence: Synthetic coding sequence

SEQ ID NO: 86926 - DNA, 249 bp, Artificial Sequence; identical to SEQ ID NO: 86888
  Description of Artificial Sequence: Synthetic coding sequence

SEQ ID NO: 86927 - DNA, 141 bp, Artificial Sequence; identical to SEQ ID NO: 86898
  Description of Artificial Sequence: Synthetic coding sequence

SEQ ID NO: 86928 - DNA, 108 bp, Artificial Sequence; identical to SEQ ID NO: 86867
  Description of Artificial Sequence: Synthetic coding sequence

SEQ ID NO: 86929 - DNA, 249 bp, Artificial Sequence; identical to SEQ ID NO: 86888
  Description of Artificial Sequence: Synthetic coding sequence

SEQ ID NO: 86930 - DNA, 87 bp, Artificial Sequence; identical to SEQ ID NO: 86883
  Description of Artificial Sequence: Synthetic coding sequence

SEQ ID NO: 86931 - DNA, 294 bp, Artificial Sequence; identical to SEQ ID NO: 86881
  Description of Artificial Sequence: Synthetic coding sequence

SEQ ID NO: 86932 - DNA, 87 bp, Artificial Sequence; identical to SEQ ID NO: 86883
  Description of Artificial Sequence: Synthetic coding sequence

SEQ ID NO: 86933 - DNA, 108 bp, Artificial Sequence; identical to SEQ ID NO: 86867
  Description of Artificial Sequence: Synthetic coding sequence

SEQ ID NO: 86934 - DNA, 294 bp, Artificial Sequence; identical to SEQ ID NO: 86881
  Description of Artificial Sequence: Synthetic coding sequence

SEQ ID NO: 86935 - DNA, 201 bp, Artificial Sequence; identical to SEQ ID NO: 86866
  Description of Artificial Sequence: Synthetic coding sequence

SEQ ID NO: 86936 - DNA, 201 bp, Artificial Sequence; identical to SEQ ID NO: 86866
  Description of Artificial Sequence: Synthetic coding sequence

SEQ ID NO: 86937 - DNA, 42 bp, Artificial Sequence; identical to SEQ ID NO: 86869
  Description of Artificial Sequence: Synthetic coding sequence

SEQ ID NO: 86938 - DNA, 87 bp, Artificial Sequence; identical to SEQ ID NO: 86883
  Description of Artificial Sequence: Synthetic coding sequence

SEQ ID NO: 86939 - DNA, 111 bp, Artificial Sequence; identical to SEQ ID NO: 86896
  Description of Artificial Sequence: Synthetic coding sequence

SEQ ID NO: 86940 - DNA, 294 bp, Artificial Sequence; identical to SEQ ID NO: 86881
  Description of Artificial Sequence: Synthetic coding sequence

SEQ ID NO: 86941 - DNA, 180 bp, Artificial Sequence; identical to SEQ ID NO: 86863
  Description of Artificial Sequence: Synthetic coding sequence

SEQ ID NO: 86942 - DNA, 294 bp, Artificial Sequence; identical to SEQ ID NO: 86881
  Description of Artificial Sequence: Synthetic coding sequence

SEQ ID NO: 86943 - DNA, 201 bp, Artificial Sequence; identical to SEQ ID NO: 86864
  Description of Artificial Sequence: Synthetic coding sequence

SEQ ID NO: 86944 - DNA, 87 bp, Artificial Sequence; identical to SEQ ID NO: 86883
  Description of Artificial Sequence: Synthetic coding sequence

SEQ ID NO: 86945 - DNA, 180 bp, Artificial Sequence; identical to SEQ ID NO: 86863
  Description of Artificial Sequence: Synthetic coding sequence

SEQ ID NO: 86946 - DNA, 201 bp, Artificial Sequence; identical to SEQ ID NO: 86866
  Description of Artificial Sequence: Synthetic coding sequence

SEQ ID NO: 86947 - DNA, 108 bp, Artificial Sequence; identical to SEQ ID NO: 86867
  Description of Artificial Sequence: Synthetic coding sequence

SEQ ID NO: 86948 - DNA, 201 bp, Artificial Sequence; identical to SEQ ID NO: 86866
  Description of Artificial Sequence: Synthetic coding sequence

SEQ ID NO: 86949 - DNA, 87 bp, Artificial Sequence; identical to SEQ ID NO: 86883
  Description of Artificial Sequence: Synthetic coding sequence

SEQ ID NO: 86950 - DNA, 108 bp, Artificial Sequence; identical to SEQ ID NO: 86867
  Description of Artificial Sequence: Synthetic coding sequence

SEQ ID NO: 86951 - DNA, 132 bp, Artificial Sequence; identical to SEQ ID NO: 86904
  Description of Artificial Sequence: Synthetic coding sequence

SEQ ID NO: 86952 - DNA, 111 bp, Artificial Sequence; identical to SEQ ID NO: 86896
  Description of Artificial Sequence: Synthetic coding sequence

SEQ ID NO: 86953 - DNA, 111 bp, Artificial Sequence; identical to SEQ ID NO: 86896
  Description of Artificial Sequence: Synthetic coding sequence

SEQ ID NO: 86954 - DNA, 201 bp, Artificial Sequence; identical to SEQ ID NO: 86866
  Description of Artificial Sequence: Synthetic coding sequence

SEQ ID NO: 86955 - DNA, 294 bp, Artificial Sequence; identical to SEQ ID NO: 86881
  Description of Artificial Sequence: Synthetic coding sequence

SEQ ID NO: 86956 - DNA, 87 bp, Artificial Sequence; identical to SEQ ID NO: 86883
  Description of Artificial Sequence: Synthetic coding sequence

SEQ ID NO: 86957 - DNA, 315 bp, Artificial Sequence; identical to SEQ ID NO: 86868
  Description of Artificial Sequence: Synthetic coding sequence

SEQ ID NO: 86958 - DNA, 201 bp, Artificial Sequence; identical to SEQ ID NO: 86866
  Description of Artificial Sequence: Synthetic coding sequence

SEQ ID NO: 86959 - DNA, 111 bp, Artificial Sequence; identical to SEQ ID NO: 86896
  Description of Artificial Sequence: Synthetic coding sequence

SEQ ID NO: 86960 - DNA, 294 bp, Artificial Sequence; identical to SEQ ID NO: 86881
  Description of Artificial Sequence: Synthetic coding sequence

SEQ ID NO: 86961 - DNA, 156 bp, Artificial Sequence; identical to SEQ ID NO: 86872
  Description of Artificial Sequence: Synthetic coding sequence

SEQ ID NO: 86962 - DNA, 315 bp, Artificial Sequence; identical to SEQ ID NO: 86868
  Description of Artificial Sequence: Synthetic coding sequence

SEQ ID NO: 86963 - DNA, 294 bp, Artificial Sequence; identical to SEQ ID NO: 86881
  Description of Artificial Sequence: Synthetic coding sequence

SEQ ID NO: 86964 - DNA, 315 bp, Artificial Sequence; identical to SEQ ID NO: 86868
  Description of Artificial Sequence: Synthetic coding sequence

SEQ ID NO: 86965 - DNA, 156 bp, Artificial Sequence; identical to SEQ ID NO: 86872
  Description of Artificial Sequence: Synthetic coding sequence

SEQ ID NO: 86966 - DNA, 201 bp, Artificial Sequence; identical to SEQ ID NO: 86864
  Description of Artificial Sequence: Synthetic coding sequence

SEQ ID NO: 86967 - DNA, 111 bp, Artificial Sequence; identical to SEQ ID NO: 86896
  Description of Artificial Sequence: Synthetic coding sequence

SEQ ID NO: 86968 - DNA, 222 bp, Artificial Sequence; identical to SEQ ID NO: 86865
  Description of Artificial Sequence: Synthetic coding sequence

SEQ ID NO: 86969 - DNA, 201 bp, Artificial Sequence; identical to SEQ ID NO: 86866
  Description of Artificial Sequence: Synthetic coding sequence

SEQ ID NO: 86970 - DNA, 201 bp, Artificial Sequence; identical to SEQ ID NO: 86866
  Description of Artificial Sequence: Synthetic coding sequence

SEQ ID NO: 86971 - DNA, 108 bp, Artificial Sequence; identical to SEQ ID NO: 86867
  Description of Artificial Sequence: Synthetic coding sequence

SEQ ID NO: 86972 - DNA, 87 bp, Artificial Sequence; identical to SEQ ID NO: 86883
  Description of Artificial Sequence: Synthetic coding sequence

SEQ ID NO: 86973 - DNA, 141 bp, Artificial Sequence; identical to SEQ ID NO: 86898
  Description of Artificial Sequence: Synthetic coding sequence

SEQ ID NO: 86974 - DNA, 141 bp, Artificial Sequence; identical to SEQ ID NO: 86898
  Description of Artificial Sequence: Synthetic coding sequence

SEQ ID NO: 86975 - DNA, 201 bp, Artificial Sequence; identical to SEQ ID NO: 86864
  Description of Artificial Sequence: Synthetic coding sequence

SEQ ID NO: 86976 - DNA, 141 bp, Artificial Sequence; identical to SEQ ID NO: 86898
  Description of Artificial Sequence: Synthetic coding sequence

SEQ ID NO: 86977 - DNA, 87 bp, Artificial Sequence; identical to SEQ ID NO: 86883
  Description of Artificial Sequence: Synthetic coding sequence

SEQ ID NO: 86978 - DNA, 294 bp, Artificial Sequence; identical to SEQ ID NO: 86881
  Description of Artificial Sequence: Synthetic coding sequence

SEQ ID NO: 86979 - DNA, 180 bp, Artificial Sequence; identical to SEQ ID NO: 86863
  Description of Artificial Sequence: Synthetic coding sequence

SEQ ID NO: 86980 - DNA, 294 bp, Artificial Sequence; identical to SEQ ID NO: 86881
  Description of Artificial Sequence: Synthetic coding sequence

SEQ ID NO: 86981 - DNA, 87 bp, Artificial Sequence; identical to SEQ ID NO: 86883
  Description of Artificial Sequence: Synthetic coding sequence

SEQ ID NO: 86982 - DNA, 111 bp, Artificial Sequence; identical to SEQ ID NO: 86896
  Description of Artificial Sequence: Synthetic coding sequence

SEQ ID NO: 86983 - DNA, 156 bp, Artificial Sequence; identical to SEQ ID NO: 86872
  Description of Artificial Sequence: Synthetic coding sequence

SEQ ID NO: 86984 - DNA, 42 bp, Artificial Sequence; identical to SEQ ID NO: 86869
  Description of Artificial Sequence: Synthetic coding sequence

SEQ ID NO: 86985 - DNA, 201 bp, Artificial Sequence; identical to SEQ ID NO: 86866
  Description of Artificial Sequence: Synthetic coding sequence

SEQ ID NO: 86986 - DNA, 87 bp, Artificial Sequence; identical to SEQ ID NO: 86883
  Description of Artificial Sequence: Synthetic coding sequence

SEQ ID NO: 86987 - DNA, 315 bp, Artificial Sequence; identical to SEQ ID NO: 86868
  Description of Artificial Sequence: Synthetic coding sequence

SEQ ID NO: 86988 - DNA, 249 bp, Artificial Sequence; identical to SEQ ID NO: 86888
  Description of Artificial Sequence: Synthetic coding sequence

SEQ ID NO: 86989 - DNA, 201 bp, Artificial Sequence; identical to SEQ ID NO: 86866
  Description of Artificial Sequence: Synthetic coding sequence

SEQ ID NO: 86990 - DNA, 87 bp, Artificial Sequence; identical to SEQ ID NO: 86883
  Description of Artificial Sequence: Synthetic coding sequence

SEQ ID NO: 86991 - DNA, 132 bp, Artificial Sequence; identical to SEQ ID NO: 86904
  Description of Artificial Sequence: Synthetic coding sequence

SEQ ID NO: 86992 - DNA, 249 bp, Artificial Sequence; identical to SEQ ID NO: 86888
  Description of Artificial Sequence: Synthetic coding sequence

SEQ ID NO: 86993 - DNA, 201 bp, Artificial Sequence; identical to SEQ ID NO: 86866
  Description of Artificial Sequence: Synthetic coding sequence

SEQ ID NO: 86994 - DNA, 180 bp, Artificial Sequence; identical to SEQ ID NO: 86863
  Description of Artificial Sequence: Synthetic coding sequence

SEQ ID NO: 86995 - DNA, 87 bp, Artificial Sequence; identical to SEQ ID NO: 86883
  Description of Artificial Sequence: Synthetic coding sequence

SEQ ID NO: 86996 - DNA, 249 bp, Artificial Sequence; identical to SEQ ID NO: 86888
  Description of Artificial Sequence: Synthetic coding sequence

SEQ ID NO: 86997 - DNA, 111 bp, Artificial Sequence; identical to SEQ ID NO: 86896
  Description of Artificial Sequence: Synthetic coding sequence

SEQ ID NO: 86998 - DNA, 222 bp, Artificial Sequence; identical to SEQ ID NO: 86865
  Description of Artificial Sequence: Synthetic coding sequence

SEQ ID NO: 86999 - DNA, 201 bp, Artificial Sequence; identical to SEQ ID NO: 86866
  Description of Artificial Sequence: Synthetic coding sequence

SEQ ID NO: 87000 - DNA, 87 bp, Artificial Sequence; identical to SEQ ID NO: 86883
  Description of Artificial Sequence: Synthetic coding sequence

SEQ ID NO: 87001 - DNA, 201 bp, Artificial Sequence; identical to SEQ ID NO: 86864
  Description of Artificial Sequence: Synthetic coding sequence

SEQ ID NO: 87002 - DNA, 222 bp, Artificial Sequence; identical to SEQ ID NO: 86865
  Description of Artificial Sequence: Synthetic coding sequence

SEQ ID NO: 87003 - DNA, 201 bp, Artificial Sequence; identical to SEQ ID NO: 86864
  Description of Artificial Sequence: Synthetic coding sequence

SEQ ID NO: 87004 - DNA, 87 bp, Artificial Sequence; identical to SEQ ID NO: 86883
  Description of Artificial Sequence: Synthetic coding sequence

SEQ ID NO: 87005 - DNA, 87 bp, Artificial Sequence; identical to SEQ ID NO: 86883
  Description of Artificial Sequence: Synthetic coding sequence

SEQ ID NO: 87006 - DNA, 87 bp, Artificial Sequence; identical to SEQ ID NO: 86883
  Description of Artificial Sequence: Synthetic coding sequence

SEQ ID NO: 87007 - DNA, 87 bp, Artificial Sequence; identical to SEQ ID NO: 86883
  Description of Artificial Sequence: Synthetic coding sequence

SEQ ID NO: 87008 - DNA, 294 bp, Artificial Sequence; identical to SEQ ID NO: 86881
  Description of Artificial Sequence: Synthetic coding sequence

SEQ ID NO: 87009 - DNA, 222 bp, Artificial Sequence; identical to SEQ ID NO: 86865
  Description of Artificial Sequence: Synthetic coding sequence

SEQ ID NO: 87010 - DNA, 87 bp, Artificial Sequence; identical to SEQ ID NO: 86883
  Description of Artificial Sequence: Synthetic coding sequence

SEQ ID NO: 87011 - DNA, 294 bp, Artificial Sequence; identical to SEQ ID NO: 86881
  Description of Artificial Sequence: Synthetic coding sequence

SEQ ID NO: 87012 - DNA, 201 bp, Artificial Sequence; identical to SEQ ID NO: 86866
  Description of Artificial Sequence: Synthetic coding sequence

SEQ ID NO: 87013 - DNA, 87 bp, Artificial Sequence; identical to SEQ ID NO: 86883
  Description of Artificial Sequence: Synthetic coding sequence

SEQ ID NO: 87014 - DNA, 201 bp, Artificial Sequence; identical to SEQ ID NO: 86866
  Description of Artificial Sequence: Synthetic coding sequence

SEQ ID NO: 87015 - DNA, 42 bp, Artificial Sequence; identical to SEQ ID NO: 86869
  Description of Artificial Sequence: Synthetic coding sequence

SEQ ID NO: 87016 - DNA, 132 bp, Artificial Sequence; identical to SEQ ID NO: 86895
  Description of Artificial Sequence: Synthetic coding sequence

SEQ ID NO: 87017 - DNA, 201 bp, Artificial Sequence; identical to SEQ ID NO: 86866
  Description of Artificial Sequence: Synthetic coding sequence

SEQ ID NO: 87018 - DNA, 294 bp, Artificial Sequence; identical to SEQ ID NO: 86881
  Description of Artificial Sequence: Synthetic coding sequence

SEQ ID NO: 87019 - DNA, 222 bp, Artificial Sequence; identical to SEQ ID NO: 86865
  Description of Artificial Sequence: Synthetic coding sequence

SEQ ID NO: 87020 - DNA, 42 bp, Artificial Sequence; identical to SEQ ID NO: 86869
  Description of Artificial Sequence: Synthetic coding sequence

SEQ ID NO: 87021 - DNA, 276 bp, Artificial Sequence; identical to SEQ ID NO: 86871
  Description of Artificial Sequence: Synthetic coding sequence

SEQ ID NO: 87022 - DNA, 276 bp, Artificial Sequence; identical to SEQ ID NO: 86871
  Description of Artificial Sequence: Synthetic coding sequence

SEQ ID NO: 87023 - DNA, 276 bp, Artificial Sequence; identical to SEQ ID NO: 86871
  Description of Artificial Sequence: Synthetic coding sequence

SEQ ID NO: 87024 - DNA, 108 bp, Artificial Sequence; identical to SEQ ID NO: 86867
  Description of Artificial Sequence: Synthetic coding sequence

SEQ ID NO: 87025 - DNA, 276 bp, Artificial Sequence; identical to SEQ ID NO: 86871
  Description of Artificial Sequence: Synthetic coding sequence

SEQ ID NO: 87026 - DNA, 108 bp, Artificial Sequence; identical to SEQ ID NO: 86867
  Description of Artificial Sequence: Synthetic coding sequence

SEQ ID NO: 87027 - DNA, 108 bp, Artificial Sequence; identical to SEQ ID NO: 86867
  Description of Artificial Sequence: Synthetic coding sequence

SEQ ID NO: 87028 - DNA, 276 bp, Artificial Sequence; identical to SEQ ID NO: 86871
  Description of Artificial Sequence: Synthetic coding sequence

SEQ ID NO: 87029 - DNA, 276 bp, Artificial Sequence; identical to SEQ ID NO: 86871
  Description of Artificial Sequence: Synthetic coding sequence

SEQ ID NO: 87030 - DNA, 108 bp, Artificial Sequence; identical to SEQ ID NO: 86867
  Description of Artificial Sequence: Synthetic coding sequence

SEQ ID NO: 87031 - DNA, 108 bp, Artificial Sequence; identical to SEQ ID NO: 86867
  Description of Artificial Sequence: Synthetic coding sequence

SEQ ID NO: 87032 - DNA, 108 bp, Artificial Sequence; identical to SEQ ID NO: 86867
  Description of Artificial Sequence: Synthetic coding sequence

SEQ ID NO: 87033 - DNA, 108 bp, Artificial Sequence; identical to SEQ ID NO: 86867
  Description of Artificial Sequence: Synthetic coding sequence

SEQ ID NO: 87034 - DNA, 276 bp, Artificial Sequence; identical to SEQ ID NO: 86871
  Description of Artificial Sequence: Synthetic coding sequence

SEQ ID NO: 87035 - DNA, 843 bp, Artificial Sequence
  Description of Artificial Sequence: Synthetic coding sequence
atggagagagagatggtgctgtgcctggcccagaccatccacacccaggaggacctgcccagacccagcatcagcgccgagcccggcaccgtgatccccctgggcagccacgtgaccttcgtgtgcagaggccccgtgggcgtgcagaccttcagactggagagagagagcagaagcacctacaacgacaccgaggacgtgagccaggccagccccagcgagagcgaggccagattcagaatcgacagcgtgagcgagggcaacgccggcccctacagatgcatctactacaagccccccaagtggagcgagcagagcgactacctggagctgctggtgaaggagaccagcggcggccccgacagccccgacaccgagcccggcagcagcgccggccccacccagagacccagcgacaacagccacaacgagcacgcccccgccagccagggcctgaaggccgagcacctgtacatcctgatcggcgtgagcgtggtgttcctgttctgcctgctgctgctggtgctgttctgcctgcacagacagaaccagatcaagcagggcccccccagaagcaaggacgaggagcagaagccccagcagagacccgacctggccgtggacgtgctggagagaaccgccgacaaggccaccgtgaacggcctgcccgagaaggacagagagaccgacaccagcgccctggccgccggcagcagccaggaggtgacctacgcccagctggaccactgggccctgacccagagaaccgccagagccgtgagcccccagagcaccaagcccatggccgagagcatcacctacgccgccgtggccagacactag

SEQ ID NO: 87036 - DNA, 813 bp, Artificial Sequence
  Description of Artificial Sequence: Synthetic coding sequence
atgagcccccaccccaccgccctgctgggcctggtgctgtgcctggcccagaccatccacacccaggaggaggacctgcccagacccagcatcagcgccgagcccggcaccgtgatccccctgggcagccacgtgaccttcgtgtgcagaggccccgtgggcgtgcagaccttcagactggagagagagagcagaagcacctacaacgacaccgaggacgtgagccaggccagccccagcgagagcgaggccagattcagaatcgacagcgtgagcgagggcaacgccggcccctacagatgcatctactacaagccccccaagtggagcgagcagagcgactacctggagctgctggtgaagggccccacccagagacccagcgacaacagccacaacgagcacgcccccgccagccagggcctgaaggccgagcacctgtacatcctgatcggcgtgagcgtggtgttcctgttctgcctgctgctgctggtgctgttctgcctgcacagacagaaccagatcaagcagggcccccccagaagcaaggacgaggagcagaagccccagcagagacccgacctggccgtggacgtgctggagagaaccgccgacaaggccaccgtgaacggcctgcccgagaaggacagagagaccgacaccagcgccctggccgccggcagcagccaggaggtgacctacgcccagctggaccactgggccctgacccagagaaccgccagagccgtgagcccccagagcaccaagcccatggccgagagcatcacctacgccgccgtggccagacactag

SEQ ID NO: 87037 - DNA, 864 bp, Artificial Sequence
  Description of Artificial Sequence: Synthetic coding sequence
atgagcccccaccccaccgccctgctgggcctggtgctgtgcctggcccagaccatccacacccaggaggaggacctgcccagacccagcatcagcgccgagcccggcaccgtgatccccctgggcagccacgtgaccttcgtgtgcagaggccccgtgggcgtgcagaccttcagactggagagagagagcagaagcacctacaacgacaccgaggacgtgagccaggccagccccagcgagagcgaggccagattcagaatcgacagcgtgagcgagggcaacgccggcccctacagatgcatctactacaagccccccaagtggagcgagcagagcgactacctggagctgctggtgaaggagaccagcggcggccccgacagccccgacaccgagcccggcagcagcgccggccccacccagagacccagcgacaacagccacaacgagcacgcccccgccagccagggcctgaaggccgagcacctgtacatcctgatcggcgtgagcgtggtgttcctgttctgcctgctgctgctggtgctgttctgcctgcacagacagaaccagatcaagcagggcccccccagaagcaaggacgaggagcagaagccccagcagagacccgacctggccgtggacgtgctggagagaaccgccgacaaggccaccgtgaacggcctgcccgagaaggacagagagaccgacaccagcgccctggccgccggcagcagccaggaggtgacctacgcccagctggaccactgggccctgacccagagaaccgccagagccgtgagcccccagagcaccaagcccatggccgagagcatcacctacgccgccgtggccagacactag

SEQ ID NO: 87038 - DNA, 1545 bp, Artificial Sequence
  Description of Artificial Sequence: Synthetic coding sequence
atgctgaccagagtgaagagcgccgtggccaacttcatgggcggcatcatggccggcagcagcggcagcgagcacggcggcggcagctgcggcggcagcgacctgcccctgagattcccctacggcagacccgagttcctgggcctgagccaggacgaggtggagtgcagcgccgaccacatcgccagacccatcctgatcctgaaggagaccagaagactgccctgggccaccggctacgccgaggtgatcaacgccggcaagagcacccacaacgaggaccaggccagctgcgaggtgctgaccgtgaagaagaaggccggcgccgtgaccagcacccccaacagaaacagcagcaagagaagaagcagcctgcccaacggcgagggcctgcagctgaaggagaacagcgagagcgagggcgtgagctgccactactggagcctgttcgacggccacgccggcagcggcgccgccgtggtggccagcagactgctgcagcaccacatcaccgagcagctgcaggacatcgtggacatcctgaagaacagcgccgtgctgccccccacctgcctgggcgaggagcccgagaacacccccgccaacagcagaaccctgaccagagccgccagcctgagaggcggcgtgggcgcccccggcagccccagcaccccccccaccagattcttcaccgagaagaagatcccccacgagtgcctggtgatcggcgccctggagagcgccttcaaggagatggacctgcagatcgagagagagagaagcagctacaacatcagcggcggctgcaccgccctgatcgtgatctgcctgctgggcaagctgtacgtggccaacgccggcgacagcagagccatcatcatcagaaacggcgagatcatccccatgagcagcgagttcacccccgagaccgagagacagagactgcagtacctggccttcatgcagccccacctgctgggcaacgagttcacccacctggagttccccagaagagtgcagagaaaggagctgggcaagaagatgctgtacagagacttcaacatgaccggctgggcctacaagaccatcgaggacgaggacctgaagttccccctgatctacggcgagggcaagaaggccagagtgatggccaccatcggcgtgaccagaggcctgggcgaccacgacctgaaggtgcacgacagcaacatctacatcaagcccttcctgagcagcgcccccgaggtgagaatctacgacctgagcaagtacgaccacggcagcgacgacgtgctgatcctggccaccgacggcctgtgggacgtgctgagcaacgaggaggtggccgaggccatcacccagttcctgcccaactgcgaccccgacgacccccacagatacaccctggccgcccaggacctggtgatgagagccagaggcgtgctgaaggacagaggctggagaatcagcaacgacagactgggcagcggcgacgacatcagcgtgtacgtgatccccctgatccacggcaacaagctgagctag

SEQ ID NO: 87039 - DNA, 1527 bp, Artificial Sequence
  Description of Artificial Sequence: Synthetic coding sequence
atgctgccccagagaaacctgagcaagagacaggtgcccaccatgcacatccccgtgaagaccagaagactgctggccgccctgaaggtgctggacaccaaggacctgaccatcgagaaggtggtgatcaacggccaggaggtgaagtacgccctgggcgagagacagagctacaagggcagccccatggagatcagcctgcccatcgccctgagcaagaaccaggagatcgtgatcgagatcagcttcgagaccagccccaagagcagcgccctgcagtggctgacccccgagcagaccagcggcaaggagcacccctacctgttcagccagtgccaggccatccactgcagagccatcctgccctgccaggacacccccagcgtgaagctgacctacaccgccgaggtgagcgtgcccaaggagctggtggccctgatgagcgccatcagagacggcgagacccccgaccccgaggaccccagcagaaagatctacaagttcatccagaaggtgcccatcccctgctacctgatcgccctggtggtgggcgccctggagagcagacagatcggccccagaaccctggtgtggagcgagaaggagcaggtggagaagagcgcctacgagttcagcgagaccgagagcatgctgaagatcgccgaggacctgggcggcccctacgtgtggggccagtacgacctgctggtgctgccccccagcttcccctacggcggcatggagaacccctgcctgaccttcgtgacccccaccctgctggccggcgacaagagcctgagcaacgtgatcgcccacgagatcagccacagctggaccggcaacctggtgaccaacaagacctgggaccacttctggctgaacgagggccacaccgtgtacctggagagacacatctgcggcagactgttcggcgagaagttcagacacttcaacgccctgggcggctggggcgagctgcagaacagcgtgaagaccttcggcgagacccaccccttcaccaagctggtggtggacctgaccgacatcgaccccgacgtggcctacagcagcgtgccctacgagaagggcttcgccctgctgttctacctggagcagctgctgggcggccccgagatcttcctgggcttcctgaaggcctacgtggagaagttcagctacaagagcatcaccaccgacgactggaaggacttcctgtacagctacttcaaggacaaggtggacgtgctgaaccaggtggactggaacgcctggctgtacagccccggcctgccccccatcaagcccaactacgacatgaccctgaccaacgcctgcatcgccctgagccagagatggatcaccgccaaggaggacgacctgaacagcttcaacgccaccgacctgaaggacctgagcagccaccagctgaacgagttcctggcccagaccctgcagagaatggccgccgccctgcacagcatccaggtgggcggcagaaacagcttcggcgccaaggacggcaactag

SEQ ID NO: 87040 - DNA, 1764 bp, Artificial Sequence
  Description of Artificial Sequence: Synthetic coding sequence
atgctgccccagagaaacctgagcaagagacaggtgcccaccatgcacatccccgtgaagaccagaagactgctggccgccctgaaggtgctggacaccaaggacctgaccatcgagaaggtggtgatcaacggccaggaggtgaagtacgccctgggcgagagacagagctacaagggcagccccatggagatcagcctgcccatcgccctgagcaagaaccaggagatcgtgatcgagatcagcttcgagaccagccccaagagcagcgccctgcagtggctgacccccgagcagaccagcggcaaggagcacccctacctgttcagccagtgccaggccatccactgcagagccatcctgccctgccaggacacccccagcgtgaagctgacctacaccgccgaggtgagcgtgcccaaggagctggtggccctgatgagcgccatcagagacggcgagacccccgaccccgaggaccccagcagaaagatctacaagttcatccagaaggtgcccatcccctgctacctgatcgccctggtggtgggcgccctggagagcagacagatcggccccagaaccctggtgtggagcgagaaggagcaggtggagaagagcgcctacgagttcagcgagaccgagagcatgctgaagatcgccgaggacctgggcggcccctacgtgtggggccagtacgacctgctggtgctgccccccagcttcccctacggcggcatggagaacccctgcctgaccttcgtgacccccaccctgctggccggcgacaagagcctgagcaacgtgatcgcccacgagatcagccacagctggaccggcaacctggtgaccaacaagacctgggaccacttctggctgaacgagggccacaccgtgtacctggagagacacatctgcggcagactgttcggcgagaagttcagacacttcaacgccctgggcggctggggcgagctgcagaacagcgtgaagaccttcggcgagacccaccccttcaccaagctggtggtggacctgaccgacatcgaccccgacgtggcctacagcagcgtgccctacgagaagggcttcgccctgctgttctacctggagcagctgctgggcggccccgagatcttcctgggcttcctgaaggcctacgtggagaagttcagctacaagagcatcaccaccgacgactggaaggacttcctgtacagctacttcaaggacaaggtggacgtgctgaaccaggtggactggaacgcctggctgtacagccccggcctgccccccatcaagcccaactacgacatgaccctgaccaacgcctgcatcgccctgagccagagatggatcaccgccaaggaggacgacctgaacagcttcaacgccaccgacctgaaggacctgagcagccaccagctgaacgagttcctggcccagaccctgcagagagcccccctgcccctgggccacatcaagagaatgcaggaggtgtacaacttcaacgccatcaacaacagcgagatcagattcagatggctgagactgtgcatccagagcaagtgggaggacgccatccccctggccctgaagatggccaccgagcagggcagaatgaagttcaccagacccctgttcaaggacctggccgccttcgacaagagccacgaccaggccgtgagaacctaccaggagcacaaggccagcatgcaccccgtgaccgccatgctggtgggcaaggacctgaaggtggactag

SEQ ID NO: 87041 - DNA, 1059 bp, Artificial Sequence
  Description of Artificial Sequence: Synthetic coding sequence
atgaacaccaccagcagcgccgccccccccagcctgggcgtggagttcatcagcctgctggccatcatcctgctgagcgtggccctggccgtgggcctgcccggcaacagcttcgtggtgtggagcatcctgaagagaatgcagaagagaagcgtgaccgccctgatggtgctgaacctggccctggccgacctggccgtgctgctgaccgcccccttcttcctgcacttcctggcccagggcacctggagcttcggcctggccggctgcagactgtgccactacgtgtgcggcgtgagcatgtacgccagcgtgctgctgatcaccgccatgagcctggacagaagcctggccgtggccagacccttcgtgagccagaagctgagaaccaaggccatggccagaagagtgctggccggcatctgggtgctgagcttcctgctggccacccccgtgctggcctacagaaccgtggtgccctggaagaccaacatgagcctgtgcttccccagataccccagcgagggccacagagccttccacctgatcttcgaggccgtgaccggcttcctgctgcccttcctggccgtggtggccagctacagcgacatcggcagaagactgcaggccagaagattcagaagaagcagaagaaccggcagactggtggtgctgatcatcctgaccttcgccgccttctggctgccctaccacgtggtgaacctggccgaggccggcagagccctggccggccaggccgccggcctgggcctggtgggcaagagactgagcctggccagaaacgtgctgatcgccctggccttcctgagcagcagcgtgaaccccgtgctgtacgcctgcgccggcggcggcctgctgagaagcgccggcgtgggcttcgtggccaagctgctggagggcaccggcagcgaggccagcagcaccagaagaggcggcagcctgggccagaccgccagaagcggccccgccgccctggagcccggccccagcgagagcctgaccgccagcagccccctgaagctgaacgagctgaactag

SEQ ID NO: 87042 - DNA, 1059 bp, Artificial Sequence; identical to SEQ ID NO: 87041
  Description of Artificial Sequence: Synthetic coding sequence

SEQ ID NO: 87043 - DNA, 1059 bp, Artificial Sequence; identical to SEQ ID NO: 87041
  Description of Artificial Sequence: Synthetic coding sequence

SEQ ID NO: 87044 - DNA, 309 bp, Artificial Sequence
  Description of Artificial Sequence: Synthetic coding sequence
atgaacaccaccagcagcgccgccccccccagcctgggcgtggagttcatcagcctgctggccatcatcctgctgagcgtggccctggccgtgggcctgcccggcaacagcttcgtggtgtggagcatcctgaagagaatgcagaagagaagcgtgaccgccctgatggtgctgaacctggccctggccgacctggccgtgctgctgaccgcccccttcttcctgcacttcctggcccagggcacctggagcttcggcctggccggctgcagactgtgccactacgtgtgcggcgtgagcatgtactag

SEQ ID NO: 87045 - DNA, 483 bp, Artificial Sequence
  Description of Artificial Sequence: Synthetic coding sequence
atgagcgtgtgctacagaccccccggcaacgagaccctgctgagctggaagaccagcagagccaccggcaccgccttcctgctgctggccgccctgctgggcctgcccggcaacggcttcgtggtgtggagcctggccggctggagacccgccagaggcagacccctggccgccaccctggtgctgcacctggccctggccgacggcgccgtgctgctgctgacccccctgttcgtggccttcctgaccagacaggcctggcccctgggccaggccggctgcaaggccgtgtactacgtgtgcgccctgagcatgtacgccagcgtgctgctgaccggcctgctgagcctgcagagatgcctggccgtgaccagacccttcctggcccccagactgagaagccccgccctggccagaagactgctgctggccgtgtggctggccgccctgctgctggccgtgcccgccgccgtgtacagatag

SEQ ID NO: 87046 - DNA, 1170 bp, Artificial Sequence
  Description of Artificial Sequence: Synthetic coding sequence
atggcccccagccacagagccagccaggtgggcttctgccccacccccgagagacccctgtggagactgccccccacctgcagacccagaagaatgagcgtgtgctacagaccccccggcaacgagaccctgctgagctggaagaccagcagagccaccggcaccgccttcctgctgctggccgccctgctgggcctgcccggcaacggcttcgtggtgtggagcctggccggctggagacccgccagaggcagacccctggccgccaccctggtgctgcacctggccctggccgacggcgccgtgctgctgctgacccccctgttcgtggccttcctgaccagacaggcctggcccctgggccaggccggctgcaaggccgtgtactacgtgtgcgccctgagcatgtacgccagcgtgctgctgaccggcctgctgagcctgcagagatgcctggccgtgaccagacccttcctggcccccagactgagaagccccgccctggccagaagactgctgctggccgtgtggctggccgccctgctgctggccgtgcccgccgccgtgtacagacacctgtggagagacagagtgtgccagctgtgccaccccagccccgtgcacgccgccgcccacctgagcctggagaccctgaccgccttcgtgctgcccttcggcctgatgctgggctgctacagcgtgaccctggccagactgagaggcgccagatggggcagcggcagacacggcgccagagtgggcagactggtgagcgccatcgtgctggccttcggcctgctgtgggccccctaccacgccgtgaacctgctgcaggccgtggccgccctggccccccccgagggcgccctggccaagctgggcggcgccggccaggccgccagagccggcaccaccgccctggccttcttcagcagcagcgtgaaccccgtgctgtacgtgttcaccgccggcgacctgctgcccagagccggccccagattcctgaccagactgttcgagggcagcggcgaggccagaggcggcggcagaagcagagagggcaccatggagctgagaaccaccccccagctgaaggtggtgggccagggcagaggcaacggcgaccccggcggcggcatggagaaggacggccccgagtgggacctgtag

SEQ ID NO: 87047 - DNA, 960 bp, Artificial Sequence
  Description of Artificial Sequence: Synthetic coding sequence
atgagcgtgtgctacagaccccccggcaacgagaccctgctgagctggaagaccagcagagccaccggcaccgccttcctgctgctggccgccctgctgggcctgcccggcaacggcttcgtggtgtggagcctggccggctggagacccgccagaggcagacccctggccgccaccctggtgctgcacctggccctggccgacggcgccgtgctgctgctgacccccctgttcgtggccttcctgaccagacaggcctggcccctgggccaggccggctgcaaggccgtgtactacgtgtgcgccctgagcatgtacgccagcgtgctgctgaccggcctgctgagcctgcagagatgcctggccgtgaccagacccttcctggcccccagactgagaagccccgccctggccagaagactgctgctggccgtgtggctggccgccctgctgctggccgtgcccgccgccgtgtacagacacctgtggagagacagagtgtgccagctgtgccaccccagccccgtgcacgccgccgcccacctgagcctggagaccctgaccgccttcgtgctgcccttcggcctgatgctgggctgctacagcgtgaccctggccagactgagaggcgccagatggggcagcggcagacacggcgccagagtgggcagactggtgagcgccatcgtgctggccttcggcctgctgtgggccccctaccacgccgtgaacctgctgcaggccgtggccgccctggccccccccgagggcgccctggccaagctgggcggcgccggccaggccgccagagccggcaccaccgccctggccttcttcagcagcagcgtgaaccccgtgctgtacgtgttcaccgccggcgacctgctgcccagagccggccccagattcctgaccagactgttcgagggcagcggcgaggccagaggcggcggcagatag

SEQ ID NO: 87048 - DNA, 1077 bp, Artificial Sequence
  Description of Artificial Sequence: Synthetic coding sequence
atgagcgtgtgctacagaccccccggcaacgagaccctgctgagctggaagaccagcagagccaccggcaccgccttcctgctgctggccgccctgctgggcctgcccggcaacggcttcgtggtgtggagcctggccggctggagacccgccagaggcagacccctggccgccaccctggtgctgcacctggccctggccgacggcgccgtgctgctgctgacccccctgttcgtggccttcctgaccagacaggcctggcccctgggccaggccggctgcaaggccgtgtactacgtgtgcgccctgagcatgtacgccagcgtgctgctgaccggcctgctgagcctgcagagatgcctggccgtgaccagacccttcctggcccccagactgagaagccccgccctggccagaagactgctgctggccgtgtggctggccgccctgctgctggccgtgcccgccgccgtgtacagacacctgtggagagacagagtgtgccagctgtgccaccccagccccgtgcacgccgccgcccacctgagcctggagaccctgaccgccttcgtgctgcccttcggcctgatgctgggctgctacagcgtgaccctggccagactgagaggcgccagatggggcagcggcagacacggcgccagagtgggcagactggtgagcgccatcgtgctggccttcggcctgctgtgggccccctaccacgccgtgaacctgctgcaggccgtggccgccctggccccccccgagggcgccctggccaagctgggcggcgccggccaggccgccagagccggcaccaccgccctggccttcttcagcagcagcgtgaaccccgtgctgtacgtgttcaccgccggcgacctgctgcccagagccggccccagattcctgaccagactgttcgagggcagcggcgaggccagaggcggcggcagaagcagagagggcaccatggagctgagaaccaccccccagctgaaggtggtgggccagggcagaggcaacggcgaccccggcggcggcatggagaaggacggccccgagtgggacctgtag

SEQ ID NO: 87049 - DNA, 1077 bp, Artificial Sequence; identical to SEQ ID NO: 87048
  Description of Artificial Sequence: Synthetic coding sequence

SEQ ID NO: 87050 - DNA, 453 bp, Artificial Sequence
  Description of Artificial Sequence: Synthetic coding sequence
atgaaggacgaggtggccctgctggccgccgtgaccctgctgggcgtgctgctgcaggcctacttcagcctgcaggtgatcagcgccagaagagccttcagagtgagcccccccctgaccaccggcccccccgagttcgagagagtgtacagagcccaggtgaactgcagcgagtacttccccctgttcctggccaccctgtgggtggccggcatcttcttccacgagggcgccgccgccctgtgcggcctggtgtacctgttcgccagactgagatacttccagggctacgccagaagcgcccagctgagactggcccccctgtacgccagcgccagagccctgtggctgctggtggccctggccgccctgggcctgctggcccacttcctgcccgccgccctgagagccgccctgctgggcagactgagaaccctgctgccctgggcctag

SEQ ID NO: 87051 - DNA, 1161 bp, Artificial Sequence
  Description of Artificial Sequence: Synthetic coding sequence
atggaggagctggacgccctgctggaggagctggagagaagcaccctgcaggacagcgacgagtacagcaaccccgcccccctgcccctggaccagcacagcagaaaggagaccaacctggacgagaccagcgagatcctgagcatccaggacaacaccagccccctgcccgcccagctggtgtacaccaccaacatccaggagctgaacgtgtacagcgaggcccaggagcccaaggagagccccccccccagcaagaccagcgccgccgcccagctggacgagctgatggcccacctgaccgagatgcaggccaaggtggccgtgagagccgacgccggcaagaagcacctgcccgacaagcaggaccacaaggccagcctggacagcatgctgggcggcctggagcaggagctgcaggacctgggcatcgccaccgtgcccaagggccactgcgccagctgccagaagcccatcgccggcaaggtgatccacgccctgggccagagctggcaccccgagcacttcgtgtgcacccactgcaaggaggagatcggcagcagccccttcttcgagagaagcggcctggcctactgccccaacgactaccaccagctgttcagccccagatgcgcctactgcgccgcccccatcctggacaaggtgctgaccgccatgaaccagacctggcaccccgagcacttcttctgcagccactgcggcgaggtgttcggcgccgagggcttccacgagaaggacaagaagccctactgcagaaaggacttcctggccatgttcagccccaagtgcggcggctgcaacagacccgtgctggagaactacctgagcgccatggacaccgtgtggcaccccgagtgcttcgtgtgcggcgactgcttcaccagcttcagcaccggcagcttcttcgagctggacggcagacccttctgcgagctgcactaccaccacagaagaggcaccctgtgccacggctgcggccagcccatcaccggcagatgcatcagcgccatgggctacaagttccaccccgagcacttcgtgtgcgccttctgcctgacccagctgagcaagggcatcttcagagagcagaacgacaagacctactgccagccctgcttcaacaagctgttccccctgtag

SEQ ID NO: 87052 - DNA, 1176 bp, Artificial Sequence
  Description of Artificial Sequence: Synthetic coding sequence
atgagcaccctgctgatcagcagcagcgacgccctgctggaggagctggagagaagcaccctgcaggacagcgacgagtacagcaaccccgcccccctgcccctggaccagcacagcagaaaggagaccaacctggacgagaccagcgagatcctgagcatccaggacaacaccagccccctgcccgcccagctggtgtacaccaccaacatccaggagctgaacgtgtacagcgaggcccaggagcccaaggagagccccccccccagcaagaccagcgccgccgcccagctggacgagctgatggcccacctgaccgagatgcaggccaaggtggccgtgagagccgacgccggcaagaagcacctgcccgacaagcaggaccacaaggccagcctggacagcatgctgggcggcctggagcaggagctgcaggacctgggcatcgccaccgtgcccaagggccactgcgccagctgccagaagcccatcgccggcaaggtgatccacgccctgggccagagctggcaccccgagcacttcgtgtgcacccactgcaaggaggagatcggcagcagccccttcttcgagagaagcggcctggcctactgccccaacgactaccaccagctgttcagccccagatgcgcctactgcgccgcccccatcctggacaaggtgctgaccgccatgaaccagacctggcaccccgagcacttcttctgcagccactgcggcgaggtgttcggcgccgagggcttccacgagaaggacaagaagccctactgcagaaaggacttcctggccatgttcagccccaagtgcggcggctgcaacagacccgtgctggagaactacctgagcgccatggacaccgtgtggcaccccgagtgcttcgtgtgcggcgactgcttcaccagcttcagcaccggcagcttcttcgagctggacggcagacccttctgcgagctgcactaccaccacagaagaggcaccctgtgccacggctgcggccagcccatcaccggcagatgcatcagcgccatgggctacaagttccaccccgagcacttcgtgtgcgccttctgcctgacccagctgagcaagggcatcttcagagagcagaacgacaagacctactgccagccctgcttcaacaagctgttccccctgtag

SEQ ID NO: 87053 - DNA, 1131 bp, Artificial Sequence
  Description of Artificial Sequence: Synthetic coding sequence
atgaactacgagttcgagagagagatcggcttcatcaacagccagcccagcctggccgagtgcctgaccagcttcccccccgtggccgacaccttccagagcagcagcatcaagaccagcaccctgagccacagcaccctgatccccccccccttcgagcagaccatccccagcctgaaccccggcagccaccccagacacggcgccggcggcagacccaagcccagccccgccggcagcagaggcagccccgtgcccgccggcgccctgcagccccccgagtacccctggatgaaggagaagaaggccgccaagaagaccgccctgctgcccgccgccgccgccgccgccaccgccgccgccaccggccccgcctgcctgagccacaaggagagcctggagatcgccgacggcagcggcggcggcagcagaagactgagaaccgcctacaccaacacccagctgctggagctggagaaggagttccacttcaacaagtacctgtgcagacccagaagagtggagatcgccgccctgctggacctgaccgagagacaggtgaaggtgtggttccagaacagaagaatgaagcacaagagacagacccagtgcaaggagaaccagaacagcgagggcaagtgcaagagcctggaggacagcgagaaggtggaggaggacgaggaggagaagaccctgttcgagcaggccctgagcgtgagcggcgccctgctggagagagagggctacaccttccagcagaacgccctgagccagcagcaggcccccaacggccacaacggcgacagccagagcttccccgtgagccccctgaccagcaacgagaagaacctgaagcacttccagcaccagagccccaccgtgcccaactgcctgagcaccatgggccagaactgcggcgccggcctgaacaacgacagccccgaggccctggaggtgcccagcctgcaggacttcagcgtgttcagcaccgacagctgcctgcagctgagcgacgccgtgagccccagcctgcccggcagcctggacagccccgtggacatcagcgccgacagcctggacttcttcaccgacaccctgaccaccatcgacctgcagcacctgaactactag

SEQ ID NO: 87054 - DNA, 753 bp, Artificial Sequence
  Description of Artificial Sequence: Synthetic coding sequence
atgacccccggcagatgctgcctggccgccgacatccaggtggagaccttcatcttcaccgacggcgaggacgaggccctggccagacacaccggcaacgtggtgatcaccaactgcagcgccgcccacagcagacaggccctgagctgcaagatggccgtggagtacgacagattcatcgagagcggcagaaagtggttctgccacgtggacgacgacaactacgtgaacctgagagccctgctgagactgctggccagctacccccacaccagagacgtgtacgtgggcaagcccagcctggacagacccatccaggccatggagagagtgagcgagaacaaggtgagacccgtgcacttctggttcgccaccggcggcgccggcttctgcatcagcagaggcctggccctgaagatgagcccctgggccagcggcggccacttcatgaacaccgccgagagaatcagactgcccgacgactgcaccatcggctacatcgtggaggccctgctgggcgtgcccctgatcagaagcggcctgttccacagccacctggagaacctgcagcaggtgcccaccagcgagctgcacgagcaggtgaccctgagctacggcatgttcgagaacaagagaaacgccgtgcacgtgaagggccccttcagcgtggaggccgaccccagcagattcagaagcatccactgccacctgtaccccgacaccccctggtgccccagaaccgccatcttctag

SEQ ID NO: 87055 - DNA, 1086 bp, Artificial Sequence
  Description of Artificial Sequence: Synthetic coding sequence
atgctgaagagatgcggcagaagactgctgctggccctggccggcgccctgctggcctgcctgctggtgctgaccgccgaccccccccccccccccctgcccgccgagagaggcagaagagccctgagaagcctggccggccccgccggcgccgcccccgcccccggcctgggcgccgccgccgccgcccccggcgccctggtgagagacgtgcacagcctgagcgagtacttcagcctgctgaccagagccagaagagacgccggccccccccccggcgccgcccccagacccgccgacggccaccccagacccctggccgagcccctggcccccagagacgtgttcatcgccgtgaagaccaccaagaagttccacagagccagactggacctgctgctggagacctggatcagcagacacaaggagatgaccttcatcttcaccgacggcgaggacgaggccctggccagacacaccggcaacgtggtgatcaccaactgcagcgccgcccacagcagacaggccctgagctgcaagatggccgtggagtacgacagattcatcgagagcggcagaaagtggttctgccacgtggacgacgacaactacgtgaacctgagagccctgctgagactgctggccagctacccccacaccagagacgtgtacgtgggcaagcccagcctggacagacccatccaggccatggagagagtgagcgagaacaaggtgagacccgtgcacttctggttcgccaccggcggcgccggcttctgcatcagcagaggcctggccctgaagatgagcccctgggccagcggcggccacttcatgaacaccgccgagagaatcagactgcccgacgactgcaccatcggctacatcgtggaggccctgctgggcgtgcccctgatcagaagcggcctgttccacagccacctggagaacctgcagcaggtgcccaccagcgagctgcacgagcaggtgaccctgagctacggcatgttcgagaacaagagaaacgccgtgcacgtgaagggccccttcagcgtggaggccgaccccagcagatggggcaactag

SEQ ID NO: 87056 - DNA, 753 bp, Artificial Sequence; identical to SEQ ID NO: 87054
  Description of Artificial Sequence: Synthetic coding sequence

SEQ ID NO: 87057 - DNA, 927 bp, Artificial Sequence
  Description of Artificial Sequence: Synthetic coding sequence
atggacgagcagaccggcagactgagactggacacctactgcatgagcgccaagcagatctgggcctggagcaagtgcagcggcagactgtgggacgagcacatgaagtggatggagggctggaccgacagatggaccgacggctggatggacggctggatggacgagtggagccccacccccgccctgagaagctacggcggcggcctgagccagcagaccttcatcttcaccgacggcgaggacgaggccctggccagacacaccggcaacgtggtgatcaccaactgcagcgccgcccacagcagacaggccctgagctgcaagatggccgtggagtacgacagattcatcgagagcggcagaaagtggttctgccacgtggacgacgacaactacgtgaacctgagagccctgctgagactgctggccagctacccccacaccagagacgtgtacgtgggcaagcccagcctggacagacccatccaggccatggagagagtgagcgagaacaaggtgagacccgtgcacttctggttcgccaccggcggcgccggcttctgcatcagcagaggcctggccctgaagatgagcccctgggccagcggcggccacttcatgaacaccgccgagagaatcagactgcccgacgactgcaccatcggctacatcgtggaggccctgctgggcgtgcccctgatcagaagcggcctgttccacagccacctggagaacctgcagcaggtgcccaccagcgagctgcacgagcaggtgaccctgagctacggcatgttcgagaacaagagaaacgccgtgcacgtgaagggccccttcagcgtggaggccgaccccagcagattcagaagcatccactgccacctgtaccccgacaccccctggtgccccagaaccgccatcttctag

SEQ ID NO: 87058 - DNA, 1302 bp, Artificial Sequence
  Description of Artificial Sequence: Synthetic coding sequence
atgcagagaatgatccagcagttcgccgccgagtacaccagcaagaacagcagcacccaggaccccagccagcccaacagcaccaagaaccagagcctgcccaaggccagccccgtgaccaccagccccaccgccgccaccacccagaaccccgtgctgagcaagctgctgatggccgaccaggacagccccctggacctgaccgtgagaaagagccagagcgagcccagcgagcaggacggcgtgctggacctgagcaccaagaagagcccctgcgccggcagcaccagcctgagccacagccccggctgcagcagcacccagggcaacggcagacccggcagacccagccagtacagacccgacggcctgagaagcggcgacggcgtgccccccagaagcctgcaggacggcaccagagagggcttcggccacagcaccagcctgaaggtgcccctggccagaagcctgcagatcagcgaggagctgctgagcagaaaccagctgagcaccgccgccagcctgggccccagcggcctgcagaaccacggccagcacctgatcctgagcagagaggccagctgggccaagccccactacgagttcaacctgagcagaatgaagttcagaggcaacggcgccctgagcaacatcagcgacctgcccttcctggccgagaacagcgccttccccaagatggccctgcaggccaagcaggacggcaagaaggacgtgagccacagcagccccgtggacctgaagatcccccaggtgagaggcatggacctgagctgggagagcagaaccggcgaccagtacagctacagcagcctggtgatgggcagccagaccgagagcgccctgagcaagaagctgagagccatcctgcccaagcagagcagaaagagcatgctggacgccggccccgacagctggggcagcgacgccgagcagagcaccagcggccagccctaccccaccagcgaccaggagggcgaccccggcagcaagcagcccagaaagaagagaggcagatacagacagtacaacagcgagatcctggaggaggccatcagcgtggtgatgagcggcaagatgagcgtgagcaaggcccagagcatctacggcatcccccacagcaccctggagtacaaggtgaaggagagactgggcaccctgaagaacccccccaagaagaagatgaagctgatgagaagcgagggccccgacgtgagcgtgaagatcgagctggacccccagggcgaggccgcccagagcgccaacgagagcaagaacgagtag

SEQ ID NO: 87059 - DNA, 1302 bp, Artificial Sequence; identical to SEQ ID NO: 87058
  Description of Artificial Sequence: Synthetic coding sequence

SEQ ID NO: 87060 - DNA, 1302 bp, Artificial Sequence; identical to SEQ ID NO: 87058
  Description of Artificial Sequence: Synthetic coding sequence

SEQ ID NO: 87061 - DNA, 1221 bp, Artificial Sequence
  Description of Artificial Sequence: Synthetic coding sequence
atgcagagaatgatccagcagttcgccgccgagtacaccagcaagaacagcagcacccaggaccccagccagcccaacagcaccaagaaccagagcctgcccaaggccagccccgtgaccaccagccccaccgccgccaccacccagaaccccgtgctgagcaagctgctgatggccgaccaggacagccccctggacctgaccgtgagaaagagccagagcgagcccagcgagcaggacggcgtgctggacctgagcaccaagaagagcccctgcgccggcagcaccagcctgagccacagccccggctgcagcagcacccagggcaacggcagacccggcagacccagccagtacagacccgacggcctgagaagcggcgacggcgtgccccccagaagcctgcaggacggcaccagagagggcttcggccacagcaccagcctgaaggtgcccctggccagaagcctgcagatcagcgaggagctgctgagcagaaaccagctgagcaccgccgccagcctgggccccagcggcctgcagaaccacggccagcacctgatcctgagcagagaggccagctgggccaagccccactacgagttcaacctgagcagaatgaagttcagaggcaacggcgccctgagcaacatcagcgacctgcccttcctggccgagaacagcgccttccccaagatggccctgcaggccaagcaggacggcaagaaggacgtgagccacagcagccccgtggacctgaagatcccccaggtgagaggcatggacctgagctgggagagcagaaccggcgaccagtacagctacagcagcctggtgatgggcagccagaccgagagcgccctgagcaagaagctgagagccatcctgcccaagcagagcagaaagagcatgctggacgccggccccgacagctggggcagcgacgccgagcagagcaccagcggccagccctaccccaccagcgaccaggagggcgaccccggcagcaagcagcccagaaagaagagaggcagatacagacagtacaacagcgagatcctggaggaggccatcagcgtggtgatgagcggcaagatgagcgtgagcaaggcccagagcatctacggcatcccccacagcaccctggagtacaaggtgaaggagagactgggcaccctgaagaacccccccaagaagaagatgaagctgatgagcggctag

SEQ ID NO: 87062 - DNA, 957 bp, Artificial Sequence
  Description of Artificial Sequence: Synthetic coding sequence
atggacaagggcagagagagaatggccgccgccgccgccgccgccgccgccgccgccgccgccgcccagtgcagaagccccagatgcgccgccgagagaagaggcttcagaagagagctggacagctggagacacagactgatgcactgcgtgggcttcgagagcatcctggagggcctgtacggccccagactgagaagagacctgagcctgttcgaggactgcgagcccgaggagctgaccgactggagcatggacgagaagtgcagcttctgcaacctgcagagagaggccgtgagcgactgcatccccagcctggacagcagccagagcacccccaccgaggagctgagcagccagggccagagcaacaccgacaagatcgagtgccaggccgagaactacctgaacgccctgttcagaaagaaggacctgccccagaactgcgaccccaacatccccctggtggcccaggagctgatgaagaagatgatcagacagttcgccatcgagtacatcagcaagagcggcaagacccaggagaacagaaacggcagcatcggccccagcatcgtgtgcaagagcatccagatgaaccaggccgagaacagcctgcaggaggagcaggagggccccctggacctgaccgtgaacagaatgcaggagcagaacacccagcagggcgacggcgtgctggacctgagcaccaagaagaccagcatcaagagcgaggagagcagcatctgcgaccccagcagcgagaacagcgtggccggcatgctgcaggtgaagaccgacgagaagctgaacgtgagcgacgagaacaccgccagctgccccctgagccccatcaagatgtgcctgaacagacccatcgagtggaacctgaacctgaccaccgccagcctgaccagctgcaccgtgcacaaccagaacctgaagagcgaggagaagtag

SEQ ID NO: 87063 - DNA, 1557 bp, Artificial Sequence
  Description of Artificial Sequence: Synthetic coding sequence
atggacgagaagtgcagcttctgcaacctgcagagagaggccgtgagcgactgcatccccagcctggacagcagccagagcacccccaccgaggagctgagcagccagggccagagcaacaccgacaagatcgagtgccaggccgagaactacctgaacgccctgttcagaaagaaggacctgccccagaactgcgaccccaacatccccctggtggcccaggagctgatgaagaagatgatcagacagttcgccatcgagtacatcagcaagagcggcaagacccaggagaacagaaacggcagcatcggccccagcatcgtgtgcaagagcatccagatgaaccaggccgagaacagcctgcaggaggagcaggagggccccctggacctgaccgtgaacagaatgcaggagcagaacacccagcagggcgacggcgtgctggacctgagcaccaagaagaccagcatcaagagcgaggagagcagcatctgcgaccccagcagcgagaacagcgtggccggcagactgcacagaaacagagaggactacgtggagagaagcgccgagttcgccgacggcctgctgagcaaggccctgaaggacatccagagcggcgccctggacatcaacaaggccggcatcctgtacggcatcccccagaagaccctgctgctgcacctggaggccctgcccgccggcaagcccgccagcttcaagaacaagaccagagacttccacgacagctacagctacaaggacagcaaggagacctgcgccgtgctgcagaaggtggccctgtgggccagagcccaggccgagagaaccgagaagagcaagctgaacctgctggagaccagcgagatcaagttccccaccgccagcacctacctgcaccagctgaccctgcagaagatggtgacccagttcaaggagaagaacgagagcctgcagtacgagaccagcaaccccaccgtgcagctgaagatcccccagctgagagtgagcagcgtgagcaagagccagcccgacggcagcggcctgctggacgtgatgtaccaggtgagcaagaccagcagcgtgctggagggcagcgccctgcagaagctgaagaacatcctgcccaagcagaacaagatcgagtgcagcggccccgtgacccacagcagcgtggacagctacttcctgcacggcgacctgagccccctgtgcctgaacagcaagaacggcaccgtggacggcaccagcgagaacaccgaggacggcctggacagaaaggacagcaagcagcccagaaagaagagaggcagatacagacagtacgaccacgagatcatggaggaggccatcgccatggtgatgagcggcaagatgagcgtgagcaaggcccagggcatctacggcgtgccccacagcaccctggagtacaaggtgaaggagagaagcggcaccctgaagaccccccccaagaagaagctgagactgcccgacaccggcctgtacaacatgaccgacagcggcaccggcagctgcaagaacagcagcaagcccgtgtag

SEQ ID NO: 87064 - DNA, 1809 bp, Artificial Sequence
  Description of Artificial Sequence: Synthetic coding sequence
atggacaagggcagagagagaatggccgccgccgccgccgccgccgccgccgccgccgccgccgcccagtgcagaagccccagatgcgccgccgagagaagaggcttcagaagagagctggacagctggagacacagactgatgcactgcgtgggcttcgagagcatcctggagggcctgtacggccccagactgagaagagacctgagcctgttcgaggactgcgagcccgaggagctgaccgactggagcatggacgagaagtgcagcttctgcaacctgcagagagaggccgtgagcgactgcatccccagcctggacagcagccagagcacccccaccgaggagctgagcagccagggccagagcaacaccgacaagatcgagtgccaggccgagaactacctgaacgccctgttcagaaagaaggacctgccccagaactgcgaccccaacatccccctggtggcccaggagctgatgaagaagatgatcagacagttcgccatcgagtacatcagcaagagcggcaagacccaggagaacagaaacggcagcatcggccccagcatcgtgtgcaagagcatccagatgaaccaggccgagaacagcctgcaggaggagcaggagggccccctggacctgaccgtgaacagaatgcaggagcagaacacccagcagggcgacggcgtgctggacctgagcaccaagaagaccagcatcaagagcgaggagagcagcatctgcgaccccagcagcgagaacagcgtggccggcagactgcacagaaacagagaggactacgtggagagaagcgccgagttcgccgacggcctgctgagcaaggccctgaaggacatccagagcggcgccctggacatcaacaaggccggcatcctgtacggcatcccccagaagaccctgctgctgcacctggaggccctgcccgccggcaagcccgccagcttcaagaacaagaccagagacttccacgacagctacagctacaaggacagcaaggagacctgcgccgtgctgcagaaggtggccctgtgggccagagcccaggccgagagaaccgagaagagcaagctgaacctgctggagaccagcgagatcaagttccccaccgccagcacctacctgcaccagctgaccctgcagaagatggtgacccagttcaaggagaagaacgagagcctgcagtacgagaccagcaaccccaccgtgcagctgaagatcccccagctgagagtgagcagcgtgagcaagagccagcccgacggcagcggcctgctggacgtgatgtaccaggtgagcaagaccagcagcgtgctggagggcagcgccctgcagaagctgaagaacatcctgcccaagcagaacaagatcgagtgcagcggccccgtgacccacagcagcgtggacagctacttcctgcacggcgacctgagccccctgtgcctgaacagcaagaacggcaccgtggacggcaccagcgagaacaccgaggacggcctggacagaaaggacagcaagcagcccagaaagaagagaggcagatacagacagtacgaccacgagatcatggaggaggccatcgccatggtgatgagcggcaagatgagcgtgagcaaggcccagggcatctacggcgtgccccacagcaccctggagtacaaggtgaaggagagaagcggcaccctgaagaccccccccaagaagaagctgagactgcccgacaccggcctgtacaacatgaccgacagcggcaccggcagctgcaagaacagcagcaagcccgtgtag

SEQ ID NO: 87065 - DNA, 435 bp, Artificial Sequence
  Description of Artificial Sequence: Synthetic coding sequence
atggaccacggctacgaggagaccagcgtgtacctgaaggactgcatccccagcctggacagcagccagagcacccccaccgaggagctgagcagccagggccagagcaacaccgacaagatcgagtgccaggccgagaactacctgaacgccctgttcagaaagaaggacctgccccagaactgcgaccccaacatccccctggtggcccaggagctgatgaagaagatgatcagacagttcgccatcgagtacatcagcaagagcggcaagacccaggagaacagaaacggcagcatcggccccagcatcgtgtgcaagagcatccagatgaaccaggccgagaacagcctgcaggaggagcaggagggccccctggacctgaccgtgaacagaatgcaggagcagaacacccagcaggcctgctacaagtag

SEQ ID NO: 87066 - DNA, 2187 bp, Artificial Sequence
  Description of Artificial Sequence: Synthetic coding sequence
atgaaccagcccgagagcgccaacgaccccgagcccctgtgcgccgtgtgcggccaggcccacagcctggaggagaaccacttctacagctaccccgaggaggtggacgacgacctgatctgccacatctgcctgcaggccctgctggaccccctggacaccccctgcggccacacctactgcaccctgtgcctgaccaacttcctggtggagaaggacttctgccccatggacagaaagcccctggtgctgcagcactgcaagaagagcagcatcctggtgaacaagctgctgaacaagctgctggtgacctgccccttcagagagcactgcacccaggtgctgcagagatgcgacctggagcaccacttccagaccagctgcaagggcgccagccactacggcctgaccaaggacagaaagagaagaagccaggacggctgccccgacggctgcgccagcctgaccgccaccgcccccagccccgaggtgagcgccgccgccaccatcagcctgatgaccgacgagcccggcctggacaaccccgcctacgtgagcagcgccgaggacggccagcccgccatcagccccgtggacagcggcagaagcaacagaaccagagccagacccttcgagagaagcaccatcagaagcagaagcttcaagaagatcaacagagccctgagcgtgctgagaagaaccaagagcggcagcgccgtggccaaccacgccgaccagggcagagagaacagcgagaacaccaccgcccccgaggtgttccccagactgtaccacctgatccccgacggcgagatcaccagcatcaagatcaacagagtggaccccagcgagagcctgagcatcagactggtgggcggcagcgagacccccctggtgcacatcatcatccagcacatctacagagacggcgtgatcgccagagacggcagactgctgcccggcgacatcatcctgaaggtgaacggcatggacatcagcaacgtgccccacaactacgccgtgagactgctgagacagccctgccaggtgctgtggctgaccgtgatgagagagcagaagttcagaagcagaaacaacggccaggcccccgacgcctacagacccagagacgacagcttccacgtgatcctgaacaagagcagccccgaggagcagctgggcatcaagctggtgagaaaggtggacgagcccggcgtgttcatcttcaacgtgctggacggcggcgtggcctacagacacggccagctggaggagaacgacagagtgctggccatcaacggccacgacctgagatacggcagccccgagagcgccgcccacctgatccaggccagcgagagaagagtgcacctggtggtgagcagacaggtgagacagagaagccccgacatcttccaggaggccggctggaacagcaacggcagctggagccccggccccggcgagagaagcaacacccccaagcccctgcaccccaccatcacctgccacgagaaggtggtgaacatccagaaggaccccggcgagagcctgggcatgaccgtggccggcggcgccagccacagagagtgggacctgcccatctacgtgatcagcgtggagcccggcggcgtgatcagcagagacggcagaatcaagaccggcgacatcctgctgaacgtggacggcgtggagctgaccgaggtgagcagaagcgaggccgtggccctgctgaagagaaccagcagcagcatcgtgctgaaggccctggaggtgaaggagtacgagccccaggaggactgcagcagccccgccgccctggacagcaaccacaacatggccccccccagcgactggagccccagctgggtgatgtggctggagctgcccagatgcctgtacaactgcaaggacatcgtgctgagaagaaacaccgccggcagcctgggcttctgcatcgtgggcggctacgaggagtacaacggcaacaagcccttcttcatcaagagcatcgtggagggcacccccgcctacaacgacggcagaatcagatgcggcgacatcctgctggccgtgaacggcagaagcaccagcggcatgatccacgcctgcctggccagactgctgaaggagctgaagggcagaatcaccctgaccatcgtgagctggcccggcaccttcctgtag

SEQ ID NO: 87067 - DNA, 1899 bp, Artificial Sequence
  Description of Artificial Sequence: Synthetic coding sequence
atgaaggccctgctgctgctggtgctgccctggctgagccccgccaactacatcgacaacgtgggcaacctgcacttcctgtacagcgagctgtgcaagggcgccagccactacggcctgaccaaggacagaaagagaagaagccaggacggctgccccgacggctgcgccagcctgaccgccaccgcccccagccccgaggtgagcgccgccgccaccatcagcctgatgaccgacgagcccggcctggacaaccccgcctacgtgagcagcgccgaggacggccagcccgccatcagccccgtggacagcggcagaagcaacagaaccagagccagacccttcgagagaagcaccatcagaagcagaagcttcaagaagatcaacagagccctgagcgtgctgagaagaaccaagagcggcagcgccgtggccaaccacgccgaccagggcagagagaacagcgagaacaccaccgcccccgaggtgttccccagactgtaccacctgatccccgacggcgagatcaccagcatcaagatcaacagagtggaccccagcgagagcctgagcatcagactggtgggcggcagcgagacccccctggtgcacatcatcatccagcacatctacagagacggcgtgatcgccagagacggcagactgctgcccggcgacatcatcctgaaggtgaacggcatggacatcagcaacgtgccccacaactacgccgtgagactgctgagacagccctgccaggtgctgtggctgaccgtgatgagagagcagaagttcagaagcagaaacaacggccaggcccccgacgcctacagacccagagacgacagcttccacgtgatcctgaacaagagcagccccgaggagcagctgggcatcaagctggtgagaaaggtggacgagcccggcgtgttcatcttcaacgtgctggacggcggcgtggcctacagacacggccagctggaggagaacgacagagtgctggccatcaacggccacgacctgagatacggcagccccgagagcgccgcccacctgatccaggccagcgagagaagagtgcacctggtggtgagcagacaggtgagacagagaagccccgacatcttccaggaggccggctggaacagcaacggcagctggagccccggccccggcgagagaagcaacacccccaagcccctgcaccccaccatcacctgccacgagaaggtggtgaacatccagaaggaccccggcgagagcctgggcatgaccgtggccggcggcgccagccacagagagtgggacctgcccatctacgtgatcagcgtggagcccggcggcgtgatcagcagagacggcagaatcaagaccggcgacatcctgctgaacgtggacggcgtggagctgaccgaggtgagcagaagcgaggccgtggccctgctgaagagaaccagcagcagcatcgtgctgaaggccctggaggtgaaggagtacgagccccaggaggactgcagcagccccgccgccctggacagcaaccacaacatggccccccccagcgactggagccccagctgggtgatgtggctggagctgcccagatgcctgtacaactgcaaggacatcgtgctgagaagaaacaccgccggcagcctgggcttctgcatcgtgggcggctacgaggagtacaacggcaacaagcccttcttcatcaagagcatcgtggagggcacccccgcctacaacgacggcagaatcagatgcggcgacatcctgctggccgtgaacggcagaagcaccagcggcatgatccacgcctgcctggccagactgctgaaggagctgaagggcagaatcaccctgaccatcgtgagctggcccggcaccttcctgtag

SEQ ID NO: 87068 - DNA, 21 bp, Artificial Sequence
  Description of Artificial Sequence: Synthetic coding sequence
atgaaccagcccgagagctag

SEQ ID NO: 87069 - DNA, 51 bp, Artificial Sequence
  Description of Artificial Sequence: Synthetic coding sequence
atgaaccagcccgagagcgccaacgaccccgagcccctgtgcgccgtgtag

SEQ ID NO: 87070 - DNA, 300 bp, Artificial Sequence
  Description of Artificial Sequence: Synthetic coding sequence
atgaaccagcccgagagcgccaacgaccccgagcccctgtgcgccgtgtgcggccaggcccacagcctggaggagaaccacttctacagctaccccgaggaggtggacgacgacctgatctgccacatctgcctgcaggccctgctggaccccctggacaccccctgcggccacacctactgcaccctgtgcctgaccaacttcctggtggagaaggacttctgccccatggacagaaagcccctggtgctgcagcactgcaagaagagcagcatcctggtgaacaagctgctgaactag

SEQ ID NO: 87071 - DNA, 273 bp, Artificial Sequence
  Description of Artificial Sequence: Synthetic coding sequence
atgaaccagcccgagagcgccaacgaccccgagcccctgtgcgccgtgtgcggccaggcccacagcctggaggagaaccacttctacagctaccccgaggaggtggacgacgacctgatctgccacatctgcctgcaggccctgctggaccccctggacaccccctgcggccacacctactgcaccctgtgcctgaccaacttcctggtggagaaggacttctgccccatggacagaaagcccctggtgctgcagcactgcaagaagagctag

SEQ ID NO: 87072 - DNA, 381 bp, Artificial Sequence
  Description of Artificial Sequence: Synthetic coding sequence
atgaaccagcccgagagcgccaacgaccccgagcccctgtgcgccgtgtgcggccaggcccacagcctggaggagaaccacttctacagctaccccgaggaggtggacgacgacctgatctgccacatctgcctgcaggccctgctggaccccctggacaccccctgcggccacacctactgcaccctgtgcctgaccaacttcctggtggagaaggacttctgccccatggacagaaagcccctggtgctgcagcactgcaagaagagcagcatcctggtgaacaagctgctgaacaagctgctggtgacctgccccttcagagagcactgcacccaggtgctgcagagatgcgacctggagcaccacttccagacctag

SEQ ID NO: 87073 - DNA, 1701 bp, Artificial Sequence
  Description of Artificial Sequence: Synthetic coding sequence
atggccgtgcagaccgccgtgagagccagccagcccagactgccccccctggacaaccccgcctacgtgagcagcgccgaggacggccagcccgccatcagccccgtggacagcggcagaagcaacagaaccagagccagacccttcgagagaagcaccatcagaagcagaagcttcaagaagatcaacagagccctgagcgtgctgagaagaaccaagagcggcagcgccgtggccaaccacgccgaccagggcagagagaacagcgagaacaccaccgcccccgaggtgttccccagactgtaccacctgatccccgacggcgagatcaccagcatcaagatcaacagagtggaccccagcgagagcctgagcatcagactggtgggcggcagcgagacccccctggtgcacatcatcatccagcacatctacagagacggcgtgatcgccagagacggcagactgctgcccggcgacatcatcctgaaggtgaacggcatggacatcagcaacgtgccccacaactacgccgtgagactgctgagacagccctgccaggtgctgtggctgaccgtgatgagagagcagaagttcagaagcagaaacaacggccaggcccccgacgcctacagacccagagacgacagcttccacgtgatcctgaacaagagcagccccgaggagcagctgggcatcaagctggtgagaaaggtggacgagcccggcgtgttcatcttcaacgtgctggacggcggcgtggcctacagacacggccagctggaggagaacgacagagtgctggccatcaacggccacgacctgagatacggcagccccgagagcgccgcccacctgatccaggccagcgagagaagagtgcacctggtggtgagcagacaggtgagacagagaagccccgacatcttccaggaggccggctggaacagcaacggcagctggagccccggccccggcgagagaagcaacacccccaagcccctgcaccccaccatcacctgccacgagaaggtggtgaacatccagaaggaccccggcgagagcctgggcatgaccgtggccggcggcgccagccacagagagtgggacctgcccatctacgtgatcagcgtggagcccggcggcgtgatcagcagagacggcagaatcaagaccggcgacatcctgctgaacgtggacggcgtggagctgaccgaggtgagcagaagcgaggccgtggccctgctgaagagaaccagcagcagcatcgtgctgaaggccctggaggtgaaggagtacgagccccaggaggactgcagcagccccgccgccctggacagcaaccacaacatggccccccccagcgactggagccccagctgggtgatgtggctggagctgcccagatgcctgtacaactgcaaggacatcgtgctgagaagaaacaccgccggcagcctgggcttctgcatcgtgggcggctacgaggagtacaacggcaacaagcccttcttcatcaagagcatcgtggagggcacccccgcctacaacgacggcagaatcagatgcggcgacatcctgctggccgtgaacggcagaagcaccagcggcatgatccacgcctgcctggccagactgctgaaggagctgaagggcagaatcaccctgaccatcgtgagctggcccggcaccttcctgtag

SEQ ID NO: 87074 - DNA, 2073 bp, Artificial Sequence
  Description of Artificial Sequence: Synthetic coding sequence
atgggcaccaccagcgacgagatggtgagcgtggagcagaccagcagcagcagcctgaaccccctgtgcttcgagtgcggccagcagcactggaccagagagaaccacctgtacaactaccagaacgaggtggacgacgacctggtgtgccacatctgcctgcagcccctgctgcagcccctggacaccccctgcggccacaccttctgctacaagtgcctgagaaacttcctgcaggagaaggacttctgccccctggacagaaagagactgcacttcaagctgtgcaagaagagcagcatcctggtgcacaagctgctggacaagctgctggtgctgtgccccttcagcagcgtgtgcaaggacgtgatgcagagatgcgacctggaggcccacctgaagaacagatgccccggcgccagccacagaagagtggccctggagagaagaaagaccagcagaacccaggccgagatcgagaacgagaacggccccaccctgctggaccccgccggcaccctgagccccgaggccgactgcctgggcaccggcgccgtgcccgtggagagacacctgaccagcgccagcctgagcacctggagcgaggagcccggcctggacaaccccgccttcgaggagagcgccggcgccgacaccacccagcagcccctgagcctgcccgagggcgagatcaccaccatcgagatccacagaagcaacccctacatccagctgggcatcagcatcgtgggcggcaacgagacccccctgatcaacatcgtgatccaggaggtgtacagagacggcgtgatcgccagagacggcagactgctggccggcgaccagatcctgcaggtgaacaactacaacatcagcaacgtgagccacaactacgccagagccgtgctgagccagccctgcaacaccctgcacctgaccgtgctgagagagagaagattcggcaacagagcccacaaccacagcgacagcaacagccccagagaggagatcttccaggtggccctgcacaagagagacagcggcgagcagctgggcatcaagctggtgagaagaaccgacgagcccggcgtgttcatcctggacctgctggagggcggcctggccgcccaggacggcagactgagcagcaacgacagagtgctggccatcaacggccacgacctgaagtacggcacccccgagctggccgcccagatcatccaggccagcggcgagagagtgaacctgaccatcgccagacccggcaagccccagcccggcaacaccatcagagaggccggcaaccacagcagcagcagccagcaccacaccccccccccctactacagcagacccagcagccacaaggacctgacccagtgcgtgacctgccaggagaagcacatcaccgtgaagaaggagccccacgagagcctgggcatgaccgtggccggcggcagaggcagcaagagcggcgagctgcccatcttcgtgaccagcgtgcccccccacggctgcctggccagagacggcagaatcaagagaggcgacgtgctgctgaacatcaacggcatcgacctgaccaacctgagccacagcgaggccgtggccatgctgaaggccagcgccgccagccccgccgtggccctgaaggccctggaggtgcagatcgtggaggaggccacccagaacgccgaggagcagcccagcaccttcagcgagaacgagtacgacgccagctggagccccagctgggtgatgtggctgggcctgcccagcaccctgcacagctgccacgacatcgtgctgagaagaagctacctgggcagctggggcttcagcatcgtgggcggctacgaggagaaccacaccaaccagcccttcttcatcaagaccatcgtgctgggcacccccgcctactacgacggcagactgaagtgcggcgacatgatcgtggccgtgaacggcctgagcaccgtgggcatgagccacagcgccctggtgcccatgctgaaggagcagagaaacaaggtgaccctgaccgtgatctgctggcccggcagcctggtgtag

SEQ ID NO: 87075 - DNA, 2115 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggcgacagcgagaacctgagagccggcatcgtggccggcaacagcagcgagtgcggccagcagcccgtggtggagaagtgcgagaccatccacgtggccatcgtgtgcgccggctacaacgccagcagagacgtggtgaccctggtgaagagcgtgctgttccacagaagaaaccccctgcacttccacctgatcgccgacagcatcgccgagcagatcctggccaccctgttccagacctggatggtgcccgccgtgagagtggacttctacaacgccgacgagctgaagagcgaggtgagctggatccccaacaagcactacagcggcatctacggcctgatgaagctggtgctgaccaagaccctgcccgccaacctggagagagtgatcgtgctggacaccgacatcaccttcgccaccgacatcgccgagctgtgggccgtgttccacaagttcaagggccagcaggtgctgggcctggtggagaaccagagcgactggtacctgggcaacctgtggaagaaccacagaccctggcccgccctgggcagaggctacaacaccggcgtgatcctgctgctgctggacaagctgagaaagatgaagtgggagcagatgtggagactgaccgccgagagagagctgatgggcatgctgagcaccagcctggccgaccaggacatcttcaacgccgtgatcaagcagaaccccttcctggtgtaccagctgccctgcttctggaacgtgcagctgagcgaccacaccagaagcgagcagtgctacagagacgtgagcgacctgaagctgcagaagcagctgagcgagctggacgaggacgacctgtgctacgagttcagaagagagagattcaccgtgcacagaacccacctgtacttcctgcactacgagtacgagcccgccgccgacagcaccgacgtgaccctggtggcccagctgagcatggacagactgcagatgctggaggccatctgcaagcactgggagggccccatcagcctggccctgtacctgagcgacgccgaggcccagcagttcctgagatacgcccagggcagcgaggtgctgatgagcagacacaacgtgggctaccacatcgtgtacaaggagggccagttctaccccgtgaacctgctgagaaacgtggccatgaagcacatcagcaccccctacatgttcctgagcgacatcgacttcctgcccatgtacggcctgtacgagtacctgagaaagagcgtgatccagctggacctggccaacaccaagaaggccatgatcgtgcccgccttcgagaccctgagatacagactgagcttccccaagagcaaggccgagctgctgagcatgctggacatgggcaccctgttcaccttcagataccacgtgtggaccaagggccacgcccccaccaacttcgccaagtggagaaccgccaccaccccctacagagtggagtgggaggccgacttcgagccctacgtggtggtgagaagagactgccccgagtacgacagaagattcgtgggcttcggctggaacaaggtggcccacatcatggagctggacgtgcaggagtacgagttcatcgtgctgcccaacgcctacatgatccacatgccccacgcccccagcttcgacatcaccaagttcagaagcaacaagcagtacagaatctgcctgaagaccctgaaggaggagttccagcaggacatgagcagaagatacggcttcgccgccctgaagtacctgaccgccgagaacaacagctag

SEQ ID NO: 87076 - DNA, 2271 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggcgacagcgagaacctgagagccggcatcgtggccggcaacagcagcgagtgcggccagcagcccgtggtggagaagtgcgagaccatccacgtggccatcgtgtgcgccggctacaacgccagcagagacgtggtgaccctggtgaagagcgtgctgttccacagaagaaaccccctgcacttccacctgatcgccgacagcatcgccgagcagatcctggccaccctgttccagacctggatggtgcccgccgtgagagtggacttctacaacgccgacgagctgaagagcgaggtgagctggatccccaacaagcactacagcggcatctacggcctgatgaagctggtgctgaccaagaccctgcccgccaacctggagagagtgatcgtgctggacaccgacatcaccttcgccaccgacatcgccgagctgtgggccgtgttccacaagttcaagggccagcaggtgctgggcctggtggagaaccagagcgactggtacctgggcaacctgtggaagaaccacagaccctggcccgccctgggcagaggctacaacaccggcgtgatcctgctgctgctggacaagctgagaaagatgaagtgggagcagatgtggagactgaccgccgagagagagctgatgggcatgctgagcaccagcctggccgaccaggacatcttcaacgccgtgatcaagcagaaccccttcctggtgtaccagctgccctgcttctggaacgtgcagctgagcgaccacaccagaagcgagcagtgctacagagacgtgagcgacctgaaggtgatccactggaacagccccaagaagctgagagtgaagaacaagcacgtggagttcttcagaaacctgtacctgaccttcctggagtacgacggcaacctgctgagaagagagctgttcggctgccccagcgaggccgacgtgaacagcgagaacctgcagaagcagctgagcgagctggacgaggacgacctgtgctacgagttcagaagagagagattcaccgtgcacagaacccacctgtacttcctgcactacgagtacgagcccgccgccgacagcaccgacgtgaccctggtggcccagctgagcatggacagactgcagatgctggaggccatctgcaagcactgggagggccccatcagcctggccctgtacctgagcgacgccgaggcccagcagttcctgagatacgcccagggcagcgaggtgctgatgagcagacacaacgtgggctaccacatcgtgtacaaggagggccagttctaccccgtgaacctgctgagaaacgtggccatgaagcacatcagcaccccctacatgttcctgagcgacatcgacttcctgcccatgtacggcctgtacgagtacctgagaaagagcgtgatccagctggacctggccaacaccaagaaggccatgatcgtgcccgccttcgagaccctgagatacagactgagcttccccaagagcaaggccgagctgctgagcatgctggacatgggcaccctgttcaccttcagataccacgtgtggaccaagggccacgcccccaccaacttcgccaagtggagaaccgccaccaccccctacagagtggagtgggaggccgacttcgagccctacgtggtggtgagaagagactgccccgagtacgacagaagattcgtgggcttcggctggaacaaggtggcccacatcatggagctggacgtgcaggagtacgagttcatcgtgctgcccaacgcctacatgatccacatgccccacgcccccagcttcgacatcaccaagttcagaagcaacaagcagtacagaatctgcctgaagaccctgaaggaggagttccagcaggacatgagcagaagatacggcttcgccgccctgaagtacctgaccgccgagaacaacagctag

SEQ ID NO: 87077 - DNA, 2271 bp, Artificial Sequence; identical to SEQ ID NO: 87076
  Description of Artificial Sequence: Synthetic coding sequence

SEQ ID NO: 87078 - DNA, 2115 bp, Artificial Sequence; identical to SEQ ID NO: 87075
  Description of Artificial Sequence: Synthetic coding sequence

SEQ ID NO: 87079 - DNA, 408 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggcgacagcgagaacctgagagccggcatcgtggccggcaacagcagcgagtgcggccagcagcccgtggtggagaagtgctag

SEQ ID NO: 87080 - DNA, 144 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagctag

SEQ ID NO: 87081 - DNA, 411 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggcgacagcgagaacctgagagccggcatcgtggccggcaacagcagcgagtgcggccagcagcccgtggtggagaagtgcgagtag

SEQ ID NO: 87082 - DNA, 183 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagatag

SEQ ID NO: 87083 - DNA, 330 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggctag

SEQ ID NO: 87084 - DNA, 2124 bp, Artificial Sequence
  Description of Artificial Sequence: Synthetic coding sequence
atgctgggcatctgcagaggcagaagaaagttcctggccgccagcctgagcctgctgtgcatccccgccatcacctggatctacctgttcagcggcagcttcgaggacggcaagcccgtgagcctgagccccctggagagccaggcccacagccccagatacaccgccagcagccagagagagagagagagcctggaggtgagaatgagagaggtggaggaggagaacagagccctgagaagacagctgagcctggcccagggcagagcccccagccacagaagaggcaaccacagcaagacctacagcatggaggagggcaccggcgacagcgagaacctgagagccggcatcgtggccggcaacagcagcgagtgcggccagcagcccgtggtggagaagtgcgagaccatccacgtggccatcgtgtgcgccggctacaacgccagcagagacgtggtgaccctggtgaagagcgtgctgttccacagaagaaaccccctgcacttccacctgatcgccgacagcatcgccgagcagatcctggccaccctgttccagacctggatggtgcccgccgtgagagtggacttctacaacgccgacgagctgaagagcgaggtgagctggatccccaacaagcactacagcggcatctacggcctgatgaagctggtgctgaccaagaccctgcccgccaacctggagagagtgatcgtgctggacaccgacatcaccttcgccaccgacatcgccgagctgtgggccgtgttccacaagttcaagggccagcaggtgctgggcctggtggagaaccagagcgactggtacctgggcaacctgtggaagaaccacagaccctggcccgccctgggcagaggctacaacaccggcgtgatcctgctgctgctggacaagctgagaaagatgaagtgggagcagatgtggagactgaccgccgagagagagctgatgggcatgctgagcaccagcctggccgaccaggacatcttcaacgccgtgatcaagcagaaccccttcctggtgtaccagctgccctgcttctggaacgtgcagctgagcgaccacaccagaagcgagcagtgctacagagacgtgagcgacctgaaggtgatccactggaacagccccaagaagctgagagtgaagaacaagcacgtggagttcttcagaaacctgtacctgaccttcctggagtacgacggcaacctgctgagaagagagctgttcggctgccccagcgaggccgacgtgaacagcgagaacctgcagaagcagctgagcgagctggacgaggacgacctgtgctacgagttcagaagagagagattcaccgtgcacagaacccacctgtacttcctgcactacgagtacgagcccgccgccgacagcaccgacgtgaccctggtggcccagctgagcatggacagactgcagatgctggaggccatctgcaagcactgggagggccccatcagcctggccctgtacctgagcgacgccgaggcccagcagttcctgagatacgcccagggcagcgaggtgctgatgagcagacacaacgtgggctaccacatcgtgtacaaggagggccagttctaccccgtgaacctgctgagaaacgtggccatgaagcacatcagcaccccctacatgttcctgagcgacatcgacttcctgcccatgtacggcctgtacgagtacctgagataccacgtgtggaccaagggccacgcccccaccaacttcgccaagtggagaaccgccaccaccccctacagagtggagtgggaggccgacttcgagccctacgtggtggtgagaagagactgccccgagtacgacagaagattcgtgggcttcggctggaacaaggtggcccacatcatggagctggacgtgcaggagtacgagttcatcgtgctgcccaacgcctacatgatccacatgccccacgcccccagcttcgacatcaccaagttcagaagcaacaagcagtacagaatctgcctgaagaccctgaaggaggagttccagcaggacatgagcagaagatacggcttcgccgccctgaagtacctgaccgccgagaacaacagctag

SEQ ID NO: 87085 - DNA, 1668 bp, Artificial Sequence
  Description of Artificial Sequence: Synthetic coding sequence
atgctgatctggagcgaggtgagctggatccccaacaagcactacagcggcatctacggcctgatgaagctggtgctgaccaagaccctgcccgccaacctggagagagtgatcgtgctggacaccgacatcaccttcgccaccgacatcgccgagctgtgggccgtgttccacaagttcaagggccagcaggtgctgggcctggtggagaaccagagcgactggtacctgggcaacctgtggaagaaccacagaccctggcccgccctgggcagaggctacaacaccggcgtgatcctgctgctgctggacaagctgagaaagatgaagtgggagcagatgtggagactgaccgccgagagagagctgatgggcatgctgagcaccagcctggccgaccaggacatcttcaacgccgtgatcaagcagaaccccttcctggtgtaccagctgccctgcttctggaacgtgcagctgagcgaccacaccagaagcgagcagtgctacagagacgtgagcgacctgaaggtgatccactggaacagccccaagaagctgagagtgaagaacaagcacgtggagttcttcagaaacctgtacctgaccttcctggagtacgacggcaacctgctgagaagagagctgttcggctgccccagcgaggccgacgtgaacagcgagaacctgcagaagcagctgagcgagctggacgaggacgacctgtgctacgagttcagaagagagagattcaccgtgcacagaacccacctgtacttcctgcactacgagtacgagcccgccgccgacagcaccgacgtgaccctggtggcccagctgagcatggacagactgcagatgctggaggccatctgcaagcactgggagggccccatcagcctggccctgtacctgagcgacgccgaggcccagcagttcctgagatacgcccagggcagcgaggtgctgatgagcagacacaacgtgggctaccacatcgtgtacaaggagggccagttctaccccgtgaacctgctgagaaacgtggccatgaagcacatcagcaccccctacatgttcctgagcgacatcgacttcctgcccatgtacggcctgtacgagtacctgagaaagagcgtgatccagctggacctggccaacaccaagaaggccatgatcgtgcccgccttcgagaccctgagatacagactgagcttccccaagagcaaggccgagctgctgagcatgctggacatgggcaccctgttcaccttcagataccacgtgtggaccaagggccacgcccccaccaacttcgccaagtggagaaccgccaccaccccctacagagtggagtgggaggccgacttcgagccctacgtggtggtgagaagagactgccccgagtacgacagaagattcgtgggcttcggctggaacaaggtggcccacatcatggagctggacgtgcaggagtacgagttcatcgtgctgcccaacgcctacatgatccacatgccccacgcccccagcttcgacatcaccaagttcagaagcaacaagcagtacagaatctgcctgaagaccctgaaggaggagttccagcaggacatgagcagaagatacggcttcgccgccctgaagtacctgaccgccgagaacaacagctag

SEQ ID NO: 87086 - DNA, 1098 bp, Artificial Sequence
  Description of Artificial Sequence: Synthetic coding sequence
atggccaaggtggccaaggacctgaaccccggcgtgaagaagatgagcctgggccagctgcagagcgccagaggcgtggcctgcctgggctgcaagggcacctgcagcggcttcgagccccacagctggagaaagatctgcaagagctgcaagtgcagccaggaggaccactgcctgaccagcgacctggaggacgacagaaagatcggcagactgctgatggacagcaagtacagcaccctgaccgccagagtgaagggcggcgacggcatcagaatctacaagagaaacagaatgatcatgaccaaccccatcgccaccggcaaggaccccaccttcgacaccatcacctacgagtgggccccccccggcgtgacccagaagctgggcctgcagtacatggagctgatccccaaggagaagcagcccgtgaccggcaccgagggcgccttctacagaagaagacagctgatgcaccagctgcccatctacgaccaggaccccagcagatgcagaggcctgctggagaacgagctgaagctgatggaggagttcgtgaagcagtacaagagcgaggccctgggcgtgggcgaggtggccctgcccggccagggcggcctgcccaaggaggagggcaagcagcaggagaagcccgagggcgccgagaccaccgccgccaccaccaacggcagcctgagcgaccccagcaaggaggtggagtacgtgtgcgagctgtgcaagggcgccgccccccccgacagccccgtggtgtacagcgacagagccggctacaacaagcagtggcaccccacctgcttcgtgtgcgccaagtgcagcgagcccctggtggacctgatctacttctggaaggacggcgccccctggtgcggcagacactactgcgagagcctgagacccagatgcagcggctgcgacgagatcatcttcgccgaggactaccagagagtggaggacctggcctggcacagaaagcacttcgtgtgcgagggctgcgagcagctgctgagcggcagagcctacatcgtgaccaagggccagctgctgtgccccacctgcagcaagagcaagagaagctag

SEQ ID NO: 87087 - DNA, 762 bp, Artificial Sequence
  Description of Artificial Sequence: Synthetic coding sequence
atgttcggcatgcagggcgacgtgttcggcctgagagccaccttcatggagggcctgcagtacatggagctgatccccaaggagaagcagcccgtgaccggcaccgagggcgccttctacagaagaagacagctgatgcaccagctgcccatctacgaccaggaccccagcagatgcagaggcctgctggagaacgagctgaagctgatggaggagttcgtgaagcagtacaagagcgaggccctgggcgtgggcgaggtggccctgcccggccagggcggcctgcccaaggaggagggcaagcagcaggagaagcccgagggcgccgagaccaccgccgccaccaccaacggcagcctgagcgaccccagcaaggaggtggagtacgtgtgcgagctgtgcaagggcgccgccccccccgacagccccgtggtgtacagcgacagagccggctacaacaagcagtggcaccccacctgcttcgtgtgcgccaagtgcagcgagcccctggtggacctgatctacttctggaaggacggcgccccctggtgcggcagacactactgcgagagcctgagacccagatgcagcggctgcgacgagatcatcttcgccgaggactaccagagagtggaggacctggcctggcacagaaagcacttcgtgtgcgagggctgcgagcagctgctgagcggcagagcctacatcgtgaccaagggccagctgctgtgccccacctgcagcaagagcaagagaagctag

SEQ ID NO: 87088 - DNA, 879 bp, Artificial Sequence
  Description of Artificial Sequence: Synthetic coding sequence
atggacagcaagtacagcaccctgaccgccagagtgaagggcggcgacggcatcagaatctacaagagaaacagaatgatcatgaccaaccccatcgccaccggcaaggaccccaccttcgacaccatcacctacgagtgggccccccccggcgtgacccagaagctgggcctgcagtacatggagctgatccccaaggagaagcagcccgtgaccggcaccgagggcgccttctacagaagaagacagctgatgcaccagctgcccatctacgaccaggaccccagcagatgcagaggcctgctggagaacgagctgaagctgatggaggagttcgtgaagcagtacaagagcgaggccctgggcgtgggcgaggtggccctgcccggccagggcggcctgcccaaggaggagggcaagcagcaggagaagcccgagggcgccgagaccaccgccgccaccaccaacggcagcctgagcgaccccagcaaggaggtggagtacgtgtgcgagctgtgcaagggcgccgccccccccgacagccccgtggtgtacagcgacagagccggctacaacaagcagtggcaccccacctgcttcgtgtgcgccaagtgcagcgagcccctggtggacctgatctacttctggaaggacggcgccccctggtgcggcagacactactgcgagagcctgagacccagatgcagcggctgcgacgagatcatcttcgccgaggactaccagagagtggaggacctggcctggcacagaaagcacttcgtgtgcgagggctgcgagcagctgctgagcggcagagcctacatcgtgaccaagggccagctgctgtgccccacctgcagcaagagcaagagaagctag

SEQ ID NO: 87089 - DNA, 744 bp, Artificial Sequence
  Description of Artificial Sequence: Synthetic coding sequence
atggccaaggtggccaaggacctgaaccccggcgtgaagaagatgagcctgggccagctgcagagcgccagaggcgtggcctgcctgggctgcaagggcacctgcagcggcttcgagccccacagctggagaaagatctgcaagagctgcaagtgcagccaggaggaccactgcctgaccagcgacctggaggacgacagaaagatcggcagactgctgatggacagcaagtacagcaccctgaccgccagagtgaagggcggcgacggcatcagaatctacaagagaaacagaatgatcatgaccaaccccatcgccaccggcaaggaccccaccttcgacaccatcacctacgagtgggccccccccggcgtgacccagaagctgggcctgcagtacatggagctgatccccaaggagaagcagcccgtgaccggcaccgagggcgccttctacagaagaagacagctgatgcaccagctgcccatctacgaccaggaccccagcagatgcagaggcctgctggagaacgagctgaagctgatggaggagttcgtgaagcagtacaagagcgaggccctgggcgtgggcgaggtggccctgcccggccagggcggcctgcccaaggaggagggcaagcagcaggagaagcccgagggcgccgagaccaccgccgccaccaccaacggcagcctgagcgaccccagcaaggaggtggagtacaagcccgtgcccctggtgtag

SEQ ID NO: 87090 - DNA, 786 bp, Artificial Sequence
  Description of Artificial Sequence: Synthetic coding sequence
atgaaccccaactgcgccagatgcggcaagatcgtgtaccccaccgagaaggtgaactgcctggacaagttctggcacaaggcctgcttccactgcgagacctgcaagatgaccctgaacatgaagaactacaagggctacgagaagaagccctactgcaacgcccactaccccaagcagagcttcaccatggtggccgacacccccgagaacctgagactgaagcagcagagcgagctgcagagccaggtgagatacaaggaggagttcgagaagaacaagggcaagggcttcagcgtggtggccgacacccccgagctgcagagaatcaagaagacccaggaccagatcagcaacatcaagtaccacgaggagttcgagaagagcagaatgggccccagcggcggcgagggcatggagcccgagagaagagacagccaggacggcagcagctacagaagacccctggagcagcagcagccccaccacatccccaccagcgcccccgtgtaccagcagccccagcagcagcccgtggcccagagctacggcggctacaaggagcccgccgcccccgtgagcatccagagaagcgcccccggcggcggcggcaagagatacagagccgtgtacgactacagcgccgccgacgaggacgaggtgagcttccaggacggcgacaccatcgtgaacgtgcagcagatcgacgacggctggatgtacggcaccgtggagagaaccggcgacaccggcatgctgcccgccaactacgtggaggccatctag

SEQ ID NO: 87091 - DNA, 501 bp, Artificial Sequence
  Description of Artificial Sequence: Synthetic coding sequence
atgaccctgaacatgaagaactacaagggctacgagaagaagccctactgcaacgcccactaccccaagcagagcttcaccatggtggccgacacccccgagaacctgagactgaagcagcagagcgagctgcagagccaggtgagatacaaggaggagttcgagaagaacaagggcaagggcttcagcgtggtggccgacacccccgagctgcagagaatcaagaagacccaggaccagatcagcaacatcaagtaccacgaggagttcgagaagagcagaatgggccccagcggcggcgagggcatggagcccgagagaagagacagccaggacggcagcagctacagaagacccctggagcagcagcagccccaccacatccccaccagcgcccccgtgtaccagcagccccagcagcagcccgtggcccagagctacggcggctacaaggagcccgccgcccccgtgagcatccagagaagcgcccccggcggctag

SEQ ID NO: 87092 - DNA, 618 bp, Artificial Sequence
  Description of Artificial Sequence: Synthetic coding sequence
atgctgcccctgagagacctgcaggacgacaccgagcacgaggagctgcagggcctgagagaggaggccctgctgcagagagtgagatacaaggaggagttcgagaagaacaagggcaagggcttcagcgtggtggccgacacccccgagctgcagagaatcaagaagacccaggaccagatcagcaacatcaagtaccacgaggagttcgagaagagcagaatgggccccagcggcggcgagggcatggagcccgagagaagagacagccaggacggcagcagctacagaagacccctggagcagcagcagccccaccacatccccaccagcgcccccgtgtaccagcagccccagcagcagcccgtggcccagagctacggcggctacaaggagcccgccgcccccgtgagcatccagagaagcgcccccggcggcggcggcaagagatacagagccgtgtacgactacagcgccgccgacgaggacgaggtgagcttccaggacggcgacaccatcgtgaacgtgcagcagatcgacgacggctggatgtacggcaccgtggagagaaccggcgacaccggcatgctgcccgccaactacgtggaggccatctag

SEQ ID NO: 87093 - DNA, 786 bp, Artificial Sequence; identical to SEQ ID NO: 87090
  Description of Artificial Sequence: Synthetic coding sequence

SEQ ID NO: 87094 - DNA, 378 bp, Artificial Sequence
  Description of Artificial Sequence: Synthetic coding sequence
atgaaccccaactgcgccagatgcggcaagatcgtgtaccccaccgagaaggtgaactgcctggacaagttctggcacaaggcctgcttccactgcgagacctgcaagatgaccctgaacatgaagaactacaagggctacgagaagaagccctactgcaacgcccactaccccaagcagagcttcaccatggtggccgacacccccgagaacctgagactgaagcagcagagcgagctgcagagccaggtgagatacaaggaggagttcgagaagaacaagggcaagggcttcagcgtggtggccgacacccccgagctgcagagaagcagcctgggcttcctgtggaacgagatcccccccagcccccacctgtag

SEQ ID NO: 87095 - DNA, 4050 bp, Artificial Sequence
  Description of Artificial Sequence: Synthetic coding sequence
atgaagaagatcagaatctgccacatcttcaccttctacagctggatgagctacgacgtgctgttccagagaaccgagctgggcgccctggagatctggagacagctgatctgcgcccacgtgtgcatctgcgtgggctggctgtacctgagagacagagtgtgcagcaagaaggacatcatcctgagaaccgagcagaacagcggcagaaccatcctgatcaaggccgtgaccgagaagaacttcgagaccaaggacttcagagccagcctggagaacggcgtgctgctgtgcgacctgatcaacaagctgaagcccggcgtgatcaagaagatcaacagactgagcacccccatcgccggcctggacaacatcaacgtgttcctgaaggcctgcgagcagatcggcctgaaggaggcccagctgttccaccccggcgacctgcaggacctgagcaacagagtgaccgtgaagcaggaggagaccgacagaagagtgaagaacgtgctgatcaccctgtactggctgggcagaaaggcccagagcaacccctactacaacggcccccacctgaacctgaaggccttcgagaacctgctgggccaggccctgaccaaggccctggaggacagcagcttcctgaagagaagcggcagagacagcggctacggcgacatctggtgccccgagagaggcgagttcctggccccccccagacaccacaagagagaggacagcttcgagagcctggacagcctgggcagcagaagcctgaccagctgcagcagcgacatcaccctgagaggcggcagagagggcttcgagagcgacaccgacagcgagttcaccttcaagatgcaggactacaacaaggacgacatgagctacagaagaatcagcgccgtggagcccaagaccgccctgcccttcaacagattcctgcccaacaagagcagacagcccagctacgtgcccgcccccctgagaaagaagaagcccgacaagcacgaggacaacagaagaagctgggccagccccgtgtacaccgaggccgacggcaccttcagcagactgttccagaagatctacggcgagaacggcagcaagagcatgagcgacgtgagcgccgaggacgtgcagaacctgagacagctgagatacgaggagatgcagaagatcaagagccagctgaaggagcaggaccagaagtggcaggacgacctggccaagtggaaggacagaagaaagagctacaccagcgacctgcagaagaagaaggaggagagagaggagatcgagaagcaggccctggagaagagcaagagaagcagcaagaccttcaaggagatgctgcaggacagagagagccagaaccagaagagcaccgtgcccagcagaagaagaatgtacagcttcgacgacgtgctggaggagggcaagagaccccccaccatgaccgtgagcgaggccagctaccagagcgagagagtggaggagaagggcgccacctaccccagcgagatccccaaggaggacagcaccaccttcgccaagagagaggacagagtgaccaccgagatccagctgcccagccagagccccgtggaggagcagagccccgccagcctgagcagcctgagaagcagaagcacccagatggagagcaccagagtgagcgccagcctgcccagaagctacagaaagaccgacaccgtgagactgaccagcgtggtgacccccagacccttcggcagccagaccagaggcatcagcagcctgcccagaagctacaccatggacgacgcctggaagtacaacggcgacgtggaggacatcaagagaacccccaacaacgtggtgagcacccccgcccccagccccgacgccagccagctggccagcagcctgagcagccagaaggaggtggccgccaccgaggaggacgtgaccagactgcccagccccaccagccccttcagcagcctgagccaggaccaggccgccaccagcaaggccaccctgagcagcaccagcggcctggacctgatgagcgagagcggcgagggcgagatcagcccccagagagaggtgagcagaagccaggaccagttcagcgacatgagaatcagcatcaaccagacccccggcaagagcctggacttcggcttcaccatcaagtgggacatccccggcatcttcgtggccagcgtggaggccggcagccccgccgagttcagccagctgcaggtggacgacgagatcatcgccatcaacaacaccaagttcagctacaacgacagcaaggagtgggaggaggccatggccaaggcccaggagaccggccacctggtgatggacgtgagaagatacggcaaggccggcagccccgagaccaagtggatcgacgccaccagcggcatctacaacagcgagaagagcagcaacctgagcgtgaccaccgacttcagcgagagcctgcagagcagcaacatcgagagcaaggagatcaacggcatccacgacgagagcaacgccttcgagagcaaggccagcgagagcatcagcctgaagaacctgaagagaagaagccagttcttcgagcagggcagcagcgacagcgtggtgcccgacctgcccgtgcccaccatcagcgcccccagcagatgggtgtgggaccaggaggaggagagaaagagacaggagagatggcagaaggagcaggacagactgctgcaggagaagtaccagagagagcaggagaagctgagagaggagtggcagagagccaagcaggaggccgagagagagaacagcaagtacctggacgaggagctgatggtgctgagcagcaacagcatgagcctgaccaccagagagcccagcctggccacctgggaggccacctggagcgagggcagcaagagcagcgacagagagggcaccagagccggcgaggaggagagaagacagccccaggaggaggtggtgcacgaggaccagggcaagaagccccaggaccagctggtgatcgagagagagagaaagtgggagcagcagctgcaggaggagcaggagcagaagagactgcaggccgaggccgaggagcagaagagacccgccgaggagcagaagagacaggccgagatcgagagagagaccagcgtgagaatctaccagtacagaagacccgtggacagctacgacatccccaagaccgaggaggccagcagcggcttcctgcccggcgacagaaacaagagcagaagcaccaccgagctggacgactacagcaccaacaagaacggcaacaacaagtacctggaccagatcggcaacatgaccagcagccagagaagaagcaagaaggagcaggtgcccagcggcgccgagctggagagacagcagatcctgcaggagatgagaaagagaacccccctgcacaacgacaacagctggatcagacagagaagcgccagcgtgaacaaggagcccgtgagcctgcccggcatcatgagaagaggcgagagcctggacaacctggacagccccagaagcaacagctggagacagcccccctggctgaaccagcccaccggcttctacgccagcagcagcgtgcaggacttcagcagaccccccccccagctggtgagcaccagcaacagagcctacatgagaaaccccagcagcagcgtgcccccccccagcgccggcagcgtgaagaccagcaccaccggcgtggccaccacccagagccccacccccagaagccacagccccagcgccagccagagcggcagccagctgagaaacagaagcgtgagcggcaagagaatctgcagctactgcaacaacatcctgggcaagggcgccgccatgatcatcgagagcctgggcctgtgctaccacctgcactgcttcaagtgcgtggcctgcgagtgcgacctgggcggcagcagcagcggcgccgaggtgagaatcagaaaccaccagctgtactgcaacgactgctacctgagattcaagagcggcagacccaccgccatgtag

SEQ ID NO: 87096 - DNA, 5013 bp, Artificial Sequence
  Description of Artificial Sequence: Synthetic coding sequence
atgaagaagatcagaatctgccacatcttcaccttctacagctggatgagctacgacgtgctgttccagagaaccgagctgggcgccctggagatctggagacagctgatctgcgcccacgtgtgcatctgcgtgggctggctgtacctgagagacagagtgtgcagcaagaaggacatcatcctgagaaccgagcagaacagcggcagaaccatcctgatcaaggccgtgaccgagaagaacttcgagaccaaggacttcagagccagcctggagaacggcgtgctgctgtgcgacctgatcaacaagctgaagcccggcgtgatcaagaagatcaacagactgagcacccccatcgccggcctggacaacatcaacgtgttcctgaaggcctgcgagcagatcggcctgaaggaggcccagctgttccaccccggcgacctgcaggacctgagcaacagagtgaccgtgaagcaggaggagaccgacagaagagtgaagaacgtgctgatcaccctgtactggctgggcagaaaggcccagagcaacccctactacaacggcccccacctgaacctgaaggccttcgagaacctgctgggccaggccctgaccaaggccctggaggacagcagcttcctgaagagaagcggcagagacagcggctacggcgacatctggtgccccgagagaggcgagttcctggccccccccagacaccacaagagagaggacagcttcgagagcctggacagcctgggcagcagaagcctgaccagctgcagcagcgacatcaccctgagaggcggcagagagggcttcgagagcgacaccgacagcgagttcaccttcaagatgcaggactacaacaaggacgacatgagctacagaagaatcagcgccgtggagcccaagaccgccctgcccttcaacagattcctgcccaacaagagcagacagcccagctacgtgcccgcccccctgagaaagaagaagcccgacaagcacgaggacaacagaagaagctgggccagccccgtgtacaccgaggccgacggcaccttcagcagcaaccagagaagaatctggggcaccaacgtggagaactggcccaccgtgcagggcaccagcaagagcagctgctacctggaggaggagaaggccaagaccagaagcatccccaacatcgtgaaggacgacctgtacgtgagaaagctgagccccgtgatgcccaaccccggcaacgccttcgaccagttcctgcccaagtgctggacccccgaggacgtgaactggaagagaatcaagagagagacctacaagccctggtacaaggagttccagggcttcagccagttcctgctgctgcaggccctgcagacctacagcgacgacatcctgagcagcgagacccacaccaagatcgaccccaccagcggccccagactgatcaccagaagaaagaacctgagctacgcccccggctacagaagagacgacctggagatggccgccctggaccccgacctggagaacgacgacttcttcgtgagaaagaccggcgccttccacgccaacccctacgtgctgagagccttcgaggacttcagaaagttcagcgagcaggacgacagcgtggagagagacatcatcctgcagtgcagagagggcgagctggtgctgcccgacctggagaaggacgacatgatcgtgagaagaatccccgcccagaagaaggaggtgcccctgagcggcgcccccgacagataccaccccgtgcccttccccgagccctggaccctgccccccgagatccaggccaagttcctgtgcgtgctggagagaacctgccccagcaaggagaagagcaacagctgcagaatcctggtgcccagctacagacagaagaaggacgacatgctgaccagaaagatccagagctggaagctgggcaccaccgtgccccccatcagcttcacccccggcccctgcagcgaggccgacctgaagagatgggaggccatcagagaggccagcagactgagacacaagaagagactgatggtggagagactgttccagaagatctacggcgagaacggcagcaagagcatgagcgacgtgagcgccgaggacgtgcagaacctgagacagctgagatacgaggagatgcagaagatcaagagccagctgaaggagcaggaccagaagtggcaggacgacctggccaagtggaaggacagaagaaagagctacaccagcgacctgcagaagaagaaggaggagagagaggagatcgagaagcaggccctggagaagagcaagagaagcagcaagaccttcaaggagatgctgcaggacagagagagccagaaccagaagagcaccgtgcccagcagaagaagaatgtacagcttcgacgacgtgctggaggagggcaagagaccccccaccatgaccgtgagcgaggccagctaccagagcgagagagtggaggagaagggcgccacctaccccagcgagatccccaaggaggacagcaccaccttcgccaagagagaggacagagtgaccaccgagatccagctgcccagccagagccccgtggaggagcagagccccgccagcctgagcagcctgagaagcagaagcacccagatggagagcaccagagtgagcgccagcctgcccagaagctacagaaagaccgacaccgtgagactgaccagcgtggtgacccccagacccttcggcagccagaccagaggcatcagcagcctgcccagaagctacaccatggacgacgcctggaagtacaacggcgacgtggaggacatcaagagaacccccaacaacgtggtgagcacccccgcccccagccccgacgccagccagctggccagcagcctgagcagccagaaggaggtggccgccaccgaggaggacgtgaccagactgcccagccccaccagccccttcagcagcctgagccaggaccaggccgccaccagcaaggccaccctgagcagcaccagcggcctggacctgatgagcgagagcggcgagggcgagatcagcccccagagagaggtgagcagaagccaggaccagttcagcgacatgagaatcagcatcaaccagacccccggcaagagcctggacttcggcttcaccatcaagtgggacatccccggcatcttcgtggccagcgtggaggccggcagccccgccgagttcagccagctgcaggtggacgacgagatcatcgccatcaacaacaccaagttcagctacaacgacagcaaggagtgggaggaggccatggccaaggcccaggagaccggccacctggtgatggacgtgagaagatacggcaaggccggcagccccgagaccaagtggatcgacgccaccagcggcatctacaacagcgagaagagcagcaacctgagcgtgaccaccgacttcagcgagagcctgcagagcagcaacatcgagagcaaggagatcaacggcatccacgacgagagcaacgccttcgagagcaaggccagcgagagcatcagcctgaagaacctgaagagaagaagccagttcttcgagcagggcagcagcgacagcgtggtgcccgacctgcccgtgcccaccatcagcgcccccagcagatgggtgtgggaccaggaggaggagagaaagagacaggagagatggcagaaggagcaggacagactgctgcaggagaagtaccagagagagcaggagaagctgagagaggagtggcagagagccaagcaggaggccgagagagagaacagcaagtacctggacgaggagctgatggtgctgagcagcaacagcatgagcctgaccaccagagagcccagcctggccacctgggaggccacctggagcgagggcagcaagagcagcgacagagagggcaccagagccggcgaggaggagagaagacagccccaggaggaggtggtgcacgaggaccagggcaagaagccccaggaccagctggtgatcgagagagagagaaagtgggagcagcagctgcaggaggagcaggagcagaagagactgcaggccgaggccgaggagcagaagagacccgccgaggagcagaagagacaggccgagatcgagagagagaccagcgtgagaatctaccagtacagaagacccgtggacagctacgacatccccaagaccgaggaggccagcagcggcttcctgcccggcgacagaaacaagagcagaagcaccaccgagctggacgactacagcaccaacaagaacggcaacaacaagtacctggaccagatcggcaacatgaccagcagccagagaagaagcaagaaggagcaggtgcccagcggcgccgagctggagagacagcagatcctgcaggagatgagaaagagaacccccctgcacaacgacaacagctggatcagacagagaagcgccagcgtgaacaaggagcccgtgagcctgcccggcatcatgagaagaggcgagagcctggacaacctggacagccccagaagcaacagctggagacagcccccctggctgaaccagcccaccggcttctacgccagcagcagcgtgcaggacttcagcagaccccccccccagctggtgagcaccagcaacagagcctacatgagaaaccccagcagcagcgtgcccccccccagcgccggcagcgtgaagaccagcaccaccggcgtggccaccacccagagccccacccccagaagccacagccccagcgccagccagagcggcagccagctgagaaacagcgtgctgcccgtgagcgtgaccagcgaggccctgccccaggagctgaagagcggcagcgagaccaccaactgcaccgccaccaccgccatcagcgacagcaacctggacggccagcccccctgcgacgtgagcctgcacaccaaggccctgctgcagatcgaggaggaggtggtggccgcccacgtggacctgtag

SEQ ID NO: 87097 - DNA, 4845 bp, Artificial Sequence
  Description of Artificial Sequence: Synthetic coding sequence
atgaagaagatcagaatctgccacatcttcaccttctacagctggatgagctacgacgtgctgttccagagaaccgagctgggcgccctggagatctggagacagctgatctgcgcccacgtgtgcatctgcgtgggctggctgtacctgagagacagagtgtgcagcaagaaggacatcatcctgagaaccgagcagaacagcggcagaaccatcctgatcaaggccgtgaccgagaagaacttcgagaccaaggacttcagagccagcctggagaacggcgtgctgctgtgcgacctgatcaacaagctgaagcccggcgtgatcaagaagatcaacagactgagcacccccatcgccggcctggacaacatcaacgtgttcctgaaggcctgcgagcagatcggcctgaaggaggcccagctgttccaccccggcgacctgcaggacctgagcaacagagtgaccgtgaagcaggaggagaccgacagaagagtgaagaacgtgctgatcaccctgtactggctgggcagaaaggcccagagcaacccctactacaacggcccccacctgaacctgaaggccttcgagaacctgctgggccaggccctgaccaaggccctggaggacagcagcttcctgaagagaagcggcagagacagcggctacggcgacatctggtgccccgagagaggcgagttcctggccccccccagacaccacaagagagaggacagcttcgagagcctggacagcctgggcagcagaagcctgaccagctgcagcagcgacatcaccctgagaggcggcagagagggcttcgagagcgacaccgacagcgagttcaccttcaagatgcaggactacaacaaggacgacatgagctacagaagaatcagcgccgtggagcccaagaccgccctgcccttcaacagattcctgcccaacaagagcagacagcccagctacgtgcccgcccccctgagaaagaagaagcccgacaagcacgaggacaacagaagaagctgggccagccccgtgtacaccgaggccgacggcaccttcagcagcaaccagagaagaatctggggcaccaacgtggagaactggcccaccgtgcagggcaccagcaagagcagctgctacctggaggaggagaaggccaagaccagaagcatccccaacatcgtgaaggacgacctgtacgtgagaaagctgagccccgtgatgcccaaccccggcaacgccttcgaccagttcctgcccaagtgctggacccccgaggacgtgaactggaagagaatcaagagagagacctacaagccctggtacaaggagttccagggcttcagccagttcctgctgctgcaggccctgcagacctacagcgacgacatcctgagcagcgagacccacaccaagatcgaccccaccagcggccccagactgatcaccagaagaaagaacctgagctacgcccccggctacagaagagacgacctggagatggccgccctggaccccgacctggagaacgacgacttcttcgtgagaaagaccggcgccttccacgccaacccctacgtgctgagagccttcgaggacttcagaaagttcagcgagcaggacgacagcgtggagagagacatcatcctgcagtgcagagagggcgagctggtgctgcccgacctggagaaggacgacatgatcgtgagaagaatccccgcccagaagaaggaggtgcccctgagcggcgcccccgacagataccaccccgtgcccttccccgagccctggaccctgccccccgagatccaggccaagttcctgtgcgtgctggagagaacctgccccagcaaggagaagagcaacagctgcagaatcctggtgcccagctacagacagaagaaggacgacatgctgaccagaaagatccagagctggaagctgggcaccaccgtgccccccatcagcttcacccccggcccctgcagcgaggccgacctgaagagatgggaggccatcagagaggccagcagactgagacacaagaagagactgatggtggagagactgttccagaagatctacggcgagaacggcagcaagagcatgagcgacgtgagcgccgaggacgtgcagaacctgagacagctgagatacgaggagatgcagaagatcaagagccagctgaaggagcaggaccagaagtggcaggacgacctggccaagtggaaggacagaagaaagagctacaccagcgacctgcagaagaagaaggaggagagagaggagatcgagaagcaggccctggagaagagcaagagaagcagcaagaccttcaaggagatgctgcaggacagagagagccagaaccagaagagcaccgtgcccagcagaagaagaatgtacagcttcgacgacgtgctggaggagggcaagagaccccccaccatgaccgtgagcgaggccagctaccagagcgagagagtggaggagaagggcgccacctaccccagcgagatccccaaggaggacagcaccaccttcgccaagagagaggacagagtgaccaccgagatccagctgcccagccagagccccgtggaggagcagagccccgccagcctgagcagcctgagaagcagaagcacccagatggagagcaccagagtgagcgccagcctgcccagaagctacagaaagaccgacaccgtgagactgaccagcgtggtgacccccagacccttcggcagccagaccagaggcatcagcagcctgcccagaagctacaccatggacgacgcctggaagtacaacggcgacgtggaggacatcaagagaacccccaacaacgtggtgagcacccccgcccccagccccgacgccagccagctggccagcagcctgagcagccagaaggaggtggccgccaccgaggaggacgtgaccagactgcccagccccaccagccccttcagcagcctgagccaggaccaggccgccaccagcaaggccaccctgagcagcaccagcggcctggacctgatgagcgagagcggcgagggcgagatcagcccccagagagaggtgagcagaagccaggaccagttcagcgacatgagaatcagcatcaaccagacccccggcaagagcctggacttcggcttcaccatcaagtgggacatccccggcatcttcgtggccagcgtggaggccggcagccccgccgagttcagccagctgcaggtggacgacgagatcatcgccatcaacaacaccaagttcagctacaacgacagcaaggagtgggaggaggccatggccaaggcccaggagaccggccacctggtgatggacgtgagaagatacggcaaggccggcagccccgagaccaagtggatcgacgccaccagcggcatctacaacagcgagaagagcagcaacctgagcgtgaccaccgacttcagcgagagcctgcagagcagcaacatcgagagcaaggagatcaacggcatccacgacgagagcaacgccttcgagagcaaggccagcgagagcatcagcctgaagaacctgaagagaagaagccagttcttcgagcagggcagcagcgacagcgtggtgcccgacctgcccgtgcccaccatcagcgcccccagcagatgggtgtgggaccaggaggaggagagaaagagacaggagagatggcagaaggagcaggacagactgctgcaggagaagtaccagagagagcaggagaagctgagagaggagtggcagagagccaagcaggaggccgagagagagaacagcaagtacctggacgaggagctgatggtgctgagcagcaacagcatgagcctgaccaccagagagcccagcctggccacctgggaggccacctggagcgagggcagcaagagcagcgacagagagggcaccagagccggcgaggaggagagaagacagccccaggaggaggtggtgcacgaggaccagggcaagaagccccaggaccagctggtgatcgagagagagagaaagtgggagcagcagctgcaggaggagcaggagcagaagagactgcaggccgaggccgaggagcagaagagacccgccgaggagcagaagagacaggccgagatcgagagagagaccagcgtgagaatctaccagtacagaagacccgtggacagctacgacatccccaagaccgaggaggccagcagcggcttcctgcccggcgacagaaacaagagcagaagcaccaccgagctggacgactacagcaccaacaagaacggcaacaacaagtacctggaccagatcggcaacatgaccagcagccagagaagaagcaagaaggagcaggtgcccagcggcgccgagctggagagacagcagatcctgcaggagatgagaaagagaacccccctgcacaacgacaacagctggatcagacagagaagcgccagcgtgaacaaggagcccgtgagcctgcccggcatcatgagaagaggcgagagcctggacaacctggacagccccagaagcaacagctggagacagcccccctggctgaaccagcccaccggcttctacgccagcagcagcgtgcaggacttcagcagaccccccccccagctggtgagcaccagcaacagagcctacatgagaaaccccagcagcagcgtgcccccccccagcgccggcagcgtgaagaccagcaccaccggcgtggccaccacccagagccccacccccagaagccacagccccagcgccagccagagcggcagccagctgagaaacagctggaccgccaacagacacgtgatgtag

SEQ ID NO: 87098 - DNA, 4158 bp, Artificial Sequence
  Description of Artificial Sequence: Synthetic coding sequence
atgcaggactacaacaaggacgacatgagctacagaagaatcagcgccgtggagcccaagaccgccctgcccttcaacagattcctgcccaacaagagcagacagcccagctacgtgcccgcccccctgagaaagaagaagcccgacaagcacgaggacaacagaagaagctgggccagccccgtgtacaccgaggccgacggcaccttcagcagcaaccagagaagaatctggggcaccaacgtggagaactggcccaccgtgcagggcaccagcaagagcagctgctacctggaggaggagaaggccaagaccagaagcatccccaacatcgtgaaggacgacctgtacgtgagaaagctgagccccgtgatgcccaaccccggcaacgccttcgaccagttcctgcccaagtgctggacccccgaggacgtgaactggaagagaatcaagagagagacctacaagccctggtacaaggagttccagggcttcagccagttcctgctgctgcaggccctgcagacctacagcgacgacatcctgagcagcgagacccacaccaagatcgaccccaccagcggccccagactgatcaccagaagaaagaacctgagctacgcccccggctacagaagagacgacctggagatggccgccctggaccccgacctggagaacgacgacttcttcgtgagaaagaccggcgccttccacgccaacccctacgtgctgagagccttcgaggacttcagaaagttcagcgagcaggacgacagcgtggagagagacatcatcctgcagtgcagagagggcgagctggtgctgcccgacctggagaaggacgacatgatcgtgagaagaatccccgcccagaagaaggaggtgcccctgagcggcgcccccgacagataccaccccgtgcccttccccgagccctggaccctgccccccgagatccaggccaagttcctgtgcgtgctggagagaacctgccccagcaaggagaagagcaacagctgcagaatcctggtgcccagctacagacagaagaaggacgacatgctgaccagaaagatccagagctggaagctgggcaccaccgtgccccccatcagcttcacccccggcccctgcagcgaggccgacctgaagagatgggaggccatcagagaggccagcagactgagacacaagaagagactgatggtggagagactgttccagaagatctacggcgagaacggcagcaagagcatgagcgacgtgagcgccgaggacgtgcagaacctgagacagctgagatacgaggagatgcagaagatcaagagccagctgaaggagcaggaccagaagtggcaggacgacctggccaagtggaaggacagaagaaagagctacaccagcgacctgcagaagaagaaggaggagagagaggagatcgagaagcaggccctggagaagagcaagagaagcagcaagaccttcaaggagatgctgcaggacagagagagccagaaccagaagagcaccgtgcccagcagaagaagaatgtacagcttcgacgacgtgctggaggagggcaagagaccccccaccatgaccgtgagcgaggccagctaccagagcgagagagtggaggagaagggcgccacctaccccagcgagatccccaaggaggacagcaccaccttcgccaagagagaggacagagtgaccaccgagatccagctgcccagccagagccccgtggaggagcagagccccgccagcctgagcagcctgagaagcagaagcacccagatggagagcaccagagtgagcgccagcctgcccagaagctacagaaagaccgacaccgtgagactgaccagcgtggtgacccccagacccttcggcagccagaccagaggcatcagcagcctgcccagaagctacaccatggacgacgcctggaagtacaacggcgacgtggaggacatcaagagaacccccaacaacgtggtgagcacccccgcccccagccccgacgccagccagctggccagcagcctgagcagccagaaggaggtggccgccaccgaggaggacgtgaccagactgcccagccccaccagccccttcagcagcctgagccaggaccaggccgccaccagcaaggccaccctgagcagcaccagcggcctggacctgatgagcgagagcggcgagggcgagatcagcccccagagagaggtgagcagaagccaggaccagttcagcgacatgagaatcagcatcaaccagacccccggcaagagcctggacttcggcttcaccatcaagtgggacatccccggcatcttcgtggccagcgtggaggccggcagccccgccgagttcagccagctgcaggtggacgacgagatcatcgccatcaacaacaccaagttcagctacaacgacagcaaggagtgggaggaggccatggccaaggcccaggagaccggccacctggtgatggacgtgagaagatacggcaaggccggcagccccgagaccaagtggatcgacgccaccagcggcatctacaacagcgagaagagcagcaacctgagcgtgaccaccgacttcagcgagagcctgcagagcagcaacatcgagagcaaggagatcaacggcatccacgacgagagcaacgccttcgagagcaaggccagcgagagcatcagcctgaagaacctgaagagaagaagccagttcttcgagcagggcagcagcgacagcgtggtgcccgacctgcccgtgcccaccatcagcgcccccagcagatgggtgtgggaccaggaggaggagagaaagagacaggagagatggcagaaggagcaggacagactgctgcaggagaagtaccagagagagcaggagaagctgagagaggagtggcagagagccaagcaggaggccgagagagagaacagcaagtacctggacgaggagctgatggtgctgagcagcaacagcatgagcctgaccaccagagagcccagcctggccacctgggaggccacctggagcgagggcagcaagagcagcgacagagagggcaccagagccggcgaggaggagagaagacagccccaggaggaggtggtgcacgaggaccagggcaagaagccccaggaccagctggtgatcgagagagagagaaagtgggagcagcagctgcaggaggagcaggagcagaagagactgcaggccgaggccgaggagcagaagagacccgccgaggagcagaagagacaggccgagatcgagagagagaccagcgtgagaatctaccagtacagaagacccgtggacagctacgacatccccaagaccgaggaggccagcagcggcttcctgcccggcgacagaaacaagagcagaagcaccaccgagctggacgactacagcaccaacaagaacggcaacaacaagtacctggaccagatcggcaacatgaccagcagccagagaagaagcaagaaggagcaggtgcccagcggcgccgagctggagagacagcagatcctgcaggagatgagaaagagaacccccctgcacaacgacaacagctggatcagacagagaagcgccagcgtgaacaaggagcccgtgagcctgcccggcatcatgagaagaggcgagagcctggacaacctggacagccccagaagcaacagctggagacagcccccctggctgaaccagcccaccggcttctacgccagcagcagcgtgcaggacttcagcagaccccccccccagctggtgagcaccagcaacagagcctacatgagaaaccccagcagcagcgtgcccccccccagcgccggcagcgtgaagaccagcaccaccggcgtggccaccacccagagccccacccccagaagccacagccccagcgccagccagagcggcagccagctgagaaacagcgtgctgcccgtgagcgtgaccagcgaggccctgccccaggagctgaagagcggcagcgagaccaccaactgcaccgccaccaccgccatcagcgacagcaacctggacggccagcccccctgcgacgtgagcctgcacaccaaggccctgctgcagatcgaggaggaggtggtggccgcccacgtggacctgtag

SEQ ID NO: 87099 - DNA, 2280 bp, Artificial Sequence
  Description of Artificial Sequence: Synthetic coding sequence
atggagagcagccccttcaacagaagacagtggaccagcctgagcctgagagtgaccgccaaggagctgagcctggtgaacaagaacaagagcagcgccatcgtggagatcttcagcaagtaccagaaggccgccgaggagaccaacatggagaagaagagaagcaacaccgagaacctgagccagcacttcagaaagggcaccctgaccgtgctgaagaagaagtgggagaaccccggcctgggcgccgagagccacaccgacagcctgagaaacagcagcaccgagatcagacacagagccgaccacccccccgccgaggtgaccagccacgccgccagcggcgccaaggccgaccaggaggagcagatccaccccagaagcagactgagaagcccccccgaggccctggtgcagggcagatacccccacatcaaggacggcgaggacctgaaggaccacagcaccgagagcaagaagatggagaactgcctgggcgagagcagacacgaggtggagaagagcgagatcagcgagaacaccgacgccagcggcaagatcgagaagtacaacgtgcccctgaacagactgaagatgatgttcgagaagggcgagcccacccagaccaagatcctgagagcccagagcagaagcgccagcggcagaaagatcagcgagaacagctacagcctggacgacctggagatcggccccggccagctgagcagcagcaccttcgacagcgagaagaacgagagcagaagaaacctggagctgcccagactgagcgagaccagcatcaaggacagaatggccaagtaccaggccgccgtgagcaagcagagcagcagcaccaactacaccaacgagctgaaggccagcggcggcgagatcaagatccacaagatggagcagaaggagaacgtgccccccggccccgaggtgtgcatcacccaccaggagggcgagaagatcagcgccaacgagaacagcctggccgtgagaagcacccccgccgaggacgacagcagagacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87100 - DNA, 2283 bp, Artificial Sequence
  Description of Artificial Sequence: Synthetic coding sequence
atggagagcagccccttcaacagaagacagtggaccagcctgagcctgagagtgaccgccaaggagctgagcctggtgaacaagaacaagagcagcgccatcgtggagatcttcagcaagtaccagaaggccgccgaggagaccaacatggagaagaagagaagcaacaccgagaacctgagccagcacttcagaaagggcaccctgaccgtgctgaagaagaagtgggagaaccccggcctgggcgccgagagccacaccgacagcctgagaaacagcagcaccgagatcagacacagagccgaccacccccccgccgaggtgaccagccacgccgccagcggcgccaaggccgaccaggaggagcagatccaccccagaagcagactgagaagcccccccgaggccctggtgcagggcagatacccccacatcaaggacggcgaggacctgaaggaccacagcaccgagagcaagaagatggagaactgcctgggcgagagcagacacgaggtggagaagagcgagatcagcgagaacaccgacgccagcggcaagatcgagaagtacaacgtgcccctgaacagactgaagatgatgttcgagaagggcgagcccacccagaccaagatcctgagagcccagagcagaagcgccagcggcagaaagatcagcgagaacagctacagcctggacgacctggagatcggccccggccagctgagcagcagcaccttcgacagcgagaagaacgagagcagaagaaacctggagctgcccagactgagcgagaccagcatcaaggacagaatggccaagtaccaggccgccgtgagcaagcagagcagcagcaccaactacaccaacgagctgaaggccagcggcggcgagatcaagatccacaagatggagcagaaggagaacgtgccccccggccccgaggtgtgcatcacccaccaggagggcgagaagatcagcgccaacgagaacagcctggccgtgagaagcacccccgccgaggacgacagccccggcgacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87101 - DNA, 2037 bp, Artificial Sequence
  Description of Artificial Sequence: Synthetic coding sequence
atgtggcagggctgcaactgcagccagctgagcgagaccgccgtggaccaggagcagctgggcgtgctgaccttcatcctgcagagaaccacctgcctgaacgtgagcgccgaccaggaggagcagatccaccccagaagcagactgagaagcccccccgaggccctggtgcagggcagatacccccacatcaaggacggcgaggacctgaaggaccacagcaccgagagcaagaagatggagaactgcctgggcgagagcagacacgaggtggagaagagcgagatcagcgagaacaccgacgccagcggcaagatcgagaagtacaacgtgcccctgaacagactgaagatgatgttcgagaagggcgagcccacccagaccaagatcctgagagcccagagcagaagcgccagcggcagaaagatcagcgagaacagctacagcctggacgacctggagatcggccccggccagctgagcagcagcaccttcgacagcgagaagaacgagagcagaagaaacctggagctgcccagactgagcgagaccagcatcaaggacagaatggccaagtaccaggccgccgtgagcaagcagagcagcagcaccaactacaccaacgagctgaaggccagcggcggcgagatcaagatccacaagatggagcagaaggagaacgtgccccccggccccgaggtgtgcatcacccaccaggagggcgagaagatcagcgccaacgagaacagcctggccgtgagaagcacccccgccgaggacgacagcagagacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87102 - DNA, 1374 bp, Artificial Sequence
  Description of Artificial Sequence: Synthetic coding sequence
atggagcagaaggagaacgtgccccccggccccgaggtgtgcatcacccaccaggagggcgagaagatcagcgccaacgagaacagcctggccgtgagaagcacccccgccgaggacgacagcagagacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87103 - DNA, 336 bp, Artificial Sequence
  Description of Artificial Sequence: Synthetic coding sequence
atggagagcagccccttcaacagaagacagtggaccagcctgagcctgagagtgaccgccaaggagctgagcctggtgaacaagaacaagagcagcgccatcgtggagatcttcagcaagtaccagaaggccgccgaggagaccaacatggagaagaagagaagcaacaccgagaacctgagccagcacttcagaaagggcaccctgaccgtgctgaagaagaagtgggagaaccccggcctgggcgccgagagccacaccgacagcctgagaaacagcagcaccgagatcagacacagagccgaccacccccccgccgaggtgaccagccactag

SEQ ID NO: 87104 - DNA, 393 bp, Artificial Sequence
  Description of Artificial Sequence: Synthetic coding sequence
atggagagcagccccttcaacagaagacagtggaccagcctgagcctgagagtgaccgccaaggagctgagcctggtgaacaagaacaagagcagcgccatcgtggagatcttcagcaagtaccagaaggccgccgaggagaccaacatggagaagaagagaagcaacaccgagaacctgagccagcacttcagaaagggcaccctgaccgtgctgaagaagaagtgggagaaccccggcctgggcgccgagagccacaccgacagcctgagaaacagcagcaccgagatcagacacagagccgaccacccccccgccgaggtgaccagccacgccgccagcggcgccaaggccgaccaggaggagcagatccaccccagaagcagactgtag

SEQ ID NO: 87105 - DNA, 1371 bp, Artificial Sequence
  Description of Artificial Sequence: Synthetic coding sequence
atggagcagaaggagaacgtgccccccggccccgaggtgtgcatcacccaccaggagggcgagaagatcagcgccaacgagaacagcctggccgtgagaagcacccccgccgaggacgacagcagagacagccaggtgaagagcgaggtgcagcagcccgtgcaccccaagcccctgagccccgacagcagagccagcagcctgagcgagagcagcccccccaaggccatgaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87106 - DNA, 1803 bp, Artificial Sequence
  Description of Artificial Sequence: Synthetic coding sequence
atggagaactgcctgggcgagagcagacacgaggtggagaagagcgagatcagcgagaacaccgacgccagcggcaagatcgagaagtacaacgtgcccctgaacagactgaagatgatgttcgagaagggcgagcccacccagaccaagatcctgagagcccagagcagaagcgccagcggcagaaagatcagcgagaacagctacagcctggacgacctggagatcggccccggccagctgagcagcagcaccttcgacagcgagaagaacgagagcagaagaaacctggagctgcccagactgagcgagaccagcatcaaggacagaatggccaagtaccaggccgccgtgagcaagcagagcagcagcaccaactacaccaacgagctgaaggccagcggcggcgagatcaagatccacaagatggagcagaaggagaacgtgccccccggccccgaggtgtgcatcacccaccaggagggcgagaagatcagcgccaacgagaacagcctggccgtgagaagcacccccgccgaggacgacagccccggcgacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87107 - DNA, 1800 bp, Artificial Sequence
  Description of Artificial Sequence: Synthetic coding sequence
atggagaactgcctgggcgagagcagacacgaggtggagaagagcgagatcagcgagaacaccgacgccagcggcaagatcgagaagtacaacgtgcccctgaacagactgaagatgatgttcgagaagggcgagcccacccagaccaagatcctgagagcccagagcagaagcgccagcggcagaaagatcagcgagaacagctacagcctggacgacctggagatcggccccggccagctgagcagcagcaccttcgacagcgagaagaacgagagcagaagaaacctggagctgcccagactgagcgagaccagcatcaaggacagaatggccaagtaccaggccgccgtgagcaagcagagcagcagcaccaactacaccaacgagctgaaggccagcggcggcgagatcaagatccacaagatggagcagaaggagaacgtgccccccggccccgaggtgtgcatcacccaccaggagggcgagaagatcagcgccaacgagaacagcctggccgtgagaagcacccccgccgaggacgacagcagagacagccaggtgaagagcgaggtgcagcagcccgtgcaccccaagcccctgagccccgacagcagagccagcagcctgagcgagagcagcccccccaaggccatgaagaagttccaggcccccgccagagagacctgcgtggagtgccagaagaccgtgtaccccatggagagactgctggccaaccagcaggtgttccacatcagctgcttcagatgcagctactgcaacaacaagctgagcctgggcacctacgccagcctgcacggcagaatctactgcaagccccacttcaaccagctgttcaagagcaagggcaactacgacgagggcttcggccacagaccccacaaggacctgtgggccagcaagaacgagaacgaggagatcctggagagacccgcccagctggccaacgccagagagaccccccacagccccggcgtggaggacgcccccatcgccaaggtgggcgtgctggccgccagcatggaggccaaggccagcagccagcaggagaaggaggacaagcccgccgagaccaagaagctgagaatcgcctggcccccccccaccgagctgggcagcagcggcagcgccctggaggagggcatcaagatgagcaagcccaagtggccccccgaggacgagatcagcaagcccgaggtgcccgaggacgtggacctggacctgaagaagctgagaagaagcagcagcctgaaggagagaagcagacccttcaccgtggccgccagcttccagagcaccagcgtgaagagccccaagaccgtgagcccccccatcagaaagggctggagcatgagcgagcagagcgaggagagcgtgggcggcagagtggccgagagaaagcaggtggagaacgccaaggccagcaagaagaacggcaacgtgggcaagaccacctggcagaacaaggagagcaagggcgagaccggcaagagaagcaaggagggccacagcctggagatggagaacgagaacctggtggagaacggcgccgacagcgacgaggacgacaacagcttcctgaagcagcagagcccccaggagcccaagagcctgaactggagcagcttcgtggacaacaccttcgccgaggagttcaccacccagaaccagaagagccaggacgtggagctgtgggagggcgaggtggtgaaggagctgagcgtggaggagcagatcaagagaaacagatactacgacgaggacgaggacgaggagtag

SEQ ID NO: 87108 - DNA, 1128 bp, Artificial Sequence
  Description of Artificial Sequence: Synthetic coding sequence
atgctggacagagacgtgggccccacccccatgtacccccccacctacctggagcccggcatcggcagacacaccccctacggcaaccagaccgactacagaatcttcgagctgaacaagagactgcagaactggaccgaggagtgcgacaacctgtggtgggacgccttcaccaccgagttcttcgaggacgacgccatgctgaccatcaccttctgcctggaggacggccccaagagatacaccatcggcagaaccctgatccccagatacttcagaagcatcttcgagggcggcgccaccgagctgtactacgtgctgaagcaccccaaggaggccttccacagcaacttcgtgagcctggactgcgaccagggcagcatggtgacccagcacggcaagcccatgttcacccaggtgtgcgtggagggcagactgtacctggagttcatgttcgacgacatgatgagaatcaagacctggcacttcagcatcagacagcacagagagctgatccccagaagcatcctggccatgcacgcccaggacccccagatgctggaccagctgagcaagaacatcaccagatgcggcctgagcaacagcaccctgaactacctgagactgtgcgtgatcctggagcccatgcaggagctgatgagcagacacaagacctacagcctgagccccagagactgcctgaagacctgcctgttccagaagtggcagagaatggtggccccccccgccgagcccaccagacagcagcccagcaagagaagaaagagaaagatgagcggcggcagcaccatgagcagcggcggcggcaacaccaacaacagcaacagcaagaagaagagccccgccagcaccttcgccctgagcagccaggtgcccgacgtgatggtggtgggcgagcccaccctgatgggcggcgagttcggcgacgaggacgagagactgatcaccagactggagaacacccagttcgacgccgccaacggcatcgacgacgaggacagcttcaacaacagccccgccctgggcgccaacagcccctggaacagcaagccccccagcagccaggagagcaagagcgagaaccccaccagccaggccagccagtag

SEQ ID NO: 87109 - DNA, 1236 bp, Artificial Sequence
  Description of Artificial Sequence: Synthetic coding sequence
atgagcgtgggctgcgcctgccccggctgcagcagcaagagcttcaagctgtacagccccaaggagccccccaacggcaacgccttcccccccttccaccccggcaccatgctggacagagacgtgggccccacccccatgtacccccccacctacctggagcccggcatcggcagacacaccccctacggcaaccagaccgactacagaatcttcgagctgaacaagagactgcagaactggaccgaggagtgcgacaacctgtggtgggacgccttcaccaccgagttcttcgaggacgacgccatgctgaccatcaccttctgcctggaggacggccccaagagatacaccatcggcagaaccctgatccccagatacttcagaagcatcttcgagggcggcgccaccgagctgtactacgtgctgaagcaccccaaggaggccttccacagcaacttcgtgagcctggactgcgaccagggcagcatggtgacccagcacggcaagcccatgttcacccaggtgtgcgtggagggcagactgtacctggagttcatgttcgacgacatgatgagaatcaagacctggcacttcagcatcagacagcacagagagctgatccccagaagcatcctggccatgcacgcccaggacccccagatgctggaccagctgagcaagaacatcaccagatgcggcctgagcaacagcaccctgaactacctgagactgtgcgtgatcctggagcccatgcaggagctgatgagcagacacaagacctacagcctgagccccagagactgcctgaagacctgcctgttccagaagtggcagagaatggtggccccccccgccgagcccaccagacagcagcccagcaagagaagaaagagaaagatgagcggcggcagcaccatgagcagcggcggcggcaacaccaacaacagcaacagcaagaagaagagccccgccagcaccttcgccctgagcagccaggtgcccgacgtgatggtggtgggcgagcccaccctgatgggcggcgagttcggcgacgaggacgagagactgatcaccagactggagaacacccagttcgacgccgccaacggcatcgacgacgaggacagcttcaacaacagccccgccctgggcgccaacagcccctggaacagcaagccccccagcagccaggagagcaagagcgagaaccccaccagccaggccagccagtag

SEQ ID NO: 87110 - DNA, 1122 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacaccatcggcagaaccctgatccccagatacttcagcaccgtgttcgagggcggcgtgaccgacctgtactacatcctgaagcacagcaaggagagctaccacaacagcagcatcaccgtggactgcgaccagtgcaccatggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagcaagaacatcaccagaatgggcctgaccaacttcaccctgaactacctgagactgtgcgtgatcctggagcccatgcaggagctgatgagcagacacaagacctacaacctgagccccagagactgcctgaagacctgcctgttccagaagtggcagagaatggtggccccccccgccgagcccaccagacagcccaccaccaagagaagaaagagaaagaacagcaccagcagcaccagcaacagcagcgccggcaacaacgccaacagcaccggcagcaagaagaagaccaccgccgccaacctgagcctgagcagccaggtgcccgacgtgatggtggtgggcgagcccaccctgatgggcggcgagttcggcgacgaggacgagagactgatcaccagactggagaacacccagtacgacgccgccaacggcatggacgacgaggaggacttcaacaacagccccgccctgggcaacaacagcccctggaacagcaagccccccgccacccaggagaccaagagcgagaacccccccccccaggccagccagtag

SEQ ID NO: 87111 - DNA, 996 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacaccatcggcagaaccctgatccccagatacttcagcaccgtgttcgagggcggcgtgaccgacctgtactacatcctgaagcacagcaaggagagctaccacaacagcagcatcaccgtggactgcgaccagtgcaccatggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagcaagaacatcaccagaatgggcctgaccaacttcaccctgaactacctgagactgtgcgtgatcctggagcccatgcaggagctgatgagcagacacaagacctacaacctgagccccagagactgcctgaagacctgcctgttccagaagtggcagagaatggtggccccccccgccgagcccaccagacagcccaccaccaagagaagaaagagaaagaacagcaccagcagcaccagcaacagcagcgccggcaacaacgccaacagcaccggcagcaagaagaagaccaccgccgccaacctgagcctgagcagccaggtgcccggcctgggcgccatccccaactgcagcctgaaccccggcagagacggcgacctgtgccacagcaccgccgtgacccccagcggccagttcaaggagaagcactag

SEQ ID NO: 87112 - DNA, 942 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacaccatcggcagaaccctgatccccagatacttcagcaccgtgttcgagggcggcgtgaccgacctgtactacatcctgaagcacagcaaggagagctaccacaacagcagcatcaccgtggactgcgaccagtgcaccatggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagcaagaacatcaccagaatgggcctgaccaacttcaccctgaactacctgagactgtgcgtgatcctggagcccatgcaggagctgatgagcagacacaagacctacaacctgagccccagagactgcctgaagacctgcctgttccagaagtggcagagaatggtggccccccccgccgagcccaccagacagcccaccaccaagagaagaaagagaaagaacagcaccagcagcaccagcaacagcagcgccggcaacaacgccaacagcaccggcagcaagaagaagaccaccgccgccaacctgagcctgagcagccaggtgcccatcgccagcatcgccagaagccccgtgagcggctgcgccctgagaacctag

SEQ ID NO: 87113 - DNA, 570 bp, Artificial Sequence
  Description of Artificial Sequence: Synthetic coding sequence
atggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagcaagaacatcaccagaatgggcctgaccaacttcaccctgaactacctgagactgtgcgtgatcctggagcccatgcaggagctgatgagcagacacaagacctacaacctgagccccagagactgcctgaagacctgcctgttccagaagtggcagagaatggtggccccccccgccgagcccaccagacagcccaccaccaagagaagaaagagaaagaacagcaccagcagcaccagcaacagcagcgccggcaacaacgccaacagcaccggcagcaagaagaagaccaccgccgccaacctgagcctgagcagccaggtgcccatcgccagcatcgccagaagccccgtgagcggctgcgccctgagaacctag

SEQ ID NO: 87114 - DNA, 495 bp, Artificial Sequence
  Description of Artificial Sequence: Synthetic coding sequence
atggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacaccatcggcagaaccctgatccccagatacttcagcaccgtgttcgagggcggcgtgaccgacctgtactacatcctgaagcacagcaaggagagctaccacaacagcagcatcaccgtggactgcgaccagtgcaccatggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagctag

SEQ ID NO: 87115 - DNA, 333 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacatcgtgcacagcgccgccgacgccagaggcaactgcaaccagctgggcgacagcgagcccgacgcctgcgacggcctgctgcagttccccatcatgtag

SEQ ID NO: 87116 - DNA, 321 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacagaaccaagaacctgagacccatcggcgagaagatgaacatcaacggcaagtgctacagacaggacccccacccccccctgctgtag

SEQ ID NO: 87117 - DNA, 1116 bp, Artificial Sequence
  Description of Artificial Sequence: Synthetic coding sequence
atgagcagcaccccccacgaccccttctacagcagccccttcggccccttctacagaagacacaccccctacatggtgcagcccgagtacagaatctacgagatgaacaagagactgcagagcagaaccgaggacagcgacaacctgtggtgggacgccttcgccaccgagttcttcgaggacgacgccaccctgaccctgagcttctgcctggaggacggccccaagagatacaccatcggcagaaccctgatccccagatacttcagcaccgtgttcgagggcggcgtgaccgacctgtactacatcctgaagcacagcaaggagagctaccacaacagcagcatcaccgtggactgcgaccagtgcaccatggtgacccagcacggcaagcccatgttcaccaaggtgtgcaccgagggcagactgatcctggagttcaccttcgacgacctgatgagaatcaagacctggcacttcaccatcagacagtacagagagctggtgcccagaagcatcctggccatgcacgcccaggacccccaggtgctggaccagctgagcaagaacatcaccagaatgggcctgaccaacttcaccctgaactacctgagactgtgcgtgatcctggagcccatgcaggagctgatgagcagacacaagacctacaacctgagccccagagactgcctgaagacctgcctgttccagaagtggcagagaatggtggccccccccgccgagcccaccagacagcccaccaccaagagaagaaagagaaagaacagcaccagcagcaccagcaacagcagcgccggcaacaacgccaacagcaccggcagcaagaagaagaccaccgccgccaacctgagcctgagcagccaggacgtgatggtggtgggcgagcccaccctgatgggcggcgagttcggcgacgaggacgagagactgatcaccagactggagaacacccagtacgacgccgccaacggcatggacgacgaggaggacttcaacaacagccccgccctgggcaacaacagcccctggaacagcaagccccccgccacccaggagaccaagagcgagaacccccccccccaggccagccagtag

SEQ ID NO: 87118 - DNA, 1854 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggtggtggtgaacagccccgccaacgccgactaccaggagagattcaaccccagcgccctgaaggacagcgccctgagcacccacaagcccatcgaggtgaagggcctgggcggcaaggccaccatcatccacgcccagtacaacacccccatcagcatgtacagccaggacgccatcatggacgccatcgccggccaggcccaggcccagggcagcgacttcagcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagaccccaggccagcagctacagccccgccgtggccgccagcagcgcccccgccacccacaccagctacagcgagggccccgccgcccccgcccccaagcccagagtggtgaccaccgccagcatcagacccagcgtgtaccagcccgtgcccgccagcacctacagccccagccccggcgccaactacagccccaccccctacacccccagccccgcccccgcctacacccccagccccgcccccgcctacacccccagccccgtgcccacctacacccccagccccgcccccgcctacacccccagccccgcccccaactacaaccccgcccccagcgtggcctacagcggcggccccgccgagcccgccagcagacccccctgggtgaccgacgacagcttcagccagaagttcgcccccggcaagagcaccaccagcatcagcaagcagaccctgcccagaggcggccccgcctacacccccgccggcccccaggtgccccccctggccagaggcaccgtgcagagagccgagagattccccgccagcagcagaacccccctgtgcggccactgcaacaacgtgatcagaggccccttcctggtggccatgggcagaagctggcaccccgaggagttcacctgcgcctactgcaagaccagcctggccgacgtgtgcttcgtggaggagcagaacaacgtgtactgcgagagatgctacgagcagttcttcgcccccctgtgcgccaagtgcaacaccaagatcatgggcgaggtgatgcacgccctgagacagacctggcacaccacctgcttcgtgtgcgccgcctgcaagaagcccttcggcaacagcctgttccacatggaggacggcgagccctactgcgagaaggactacatcaacctgttcagcaccaagtgccacggctgcgacttccccgtggaggccggcgacaagttcatcgaggccctgggccacacctggcacgacacctgcttcatctgcgccgtgtgccacgtgaacctggagggccagcccttctacagcaagaaggacagacccctgtgcaagaagcacgcccacaccatcaacctgtag

SEQ ID NO: 87119 - DNA, 993 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagagagagattcgagaccgagagaaacagccccagattcgccaagctgagaaactggcaccacggcctgagcgcccagatcctgaacgtgaagagctag

SEQ ID NO: 87120 - DNA, 1413 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggccagcagctacagccccgccgtggccgccagcagcgcccccgccacccacaccagctacagcgagggccccgccgcccccgcccccaagcccagagtggtgaccaccgccagcatcagacccagcgtgtaccagcccgtgcccgccagcacctacagccccagccccggcgccaactacagccccaccccctacacccccagccccgcccccgcctacacccccagccccgcccccgcctacacccccagccccgtgcccacctacacccccagccccgcccccgcctacacccccagccccgcccccaactacaaccccgcccccagcgtggcctacagcggcggccccgccgagcccgccagcagacccccctgggtgaccgacgacagcttcagccagaagttcgcccccggcaagagcaccaccagcatcagcaagcagaccctgcccagaggcggccccgcctacacccccgccggcccccaggtgccccccctggccagaggcaccgtgcagagagccgagagattccccgccagcagcagaacccccctgtgcggccactgcaacaacgtgatcagaggccccttcctggtggccatgggcagaagctggcaccccgaggagttcacctgcgcctactgcaagaccagcctggccgacgtgtgcttcgtggaggagcagaacaacgtgtactgcgagagatgctacgagcagttcttcgcccccctgtgcgccaagtgcaacaccaagatcatgggcgaggtgatgcacgccctgagacagacctggcacaccacctgcttcgtgtgcgccgcctgcaagaagcccttcggcaacagcctgttccacatggaggacggcgagccctactgcgagaaggactacatcaacctgttcagcaccaagtgccacggctgcgacttccccgtggaggccggcgacaagttcatcgaggccctgggccacacctggcacgacacctgcttcatctgcgccgtgtgccacgtgaacctggagggccagcccttctacagcaagaaggacagacccctgtgcaagaagcacgcccacaccatcaacctgtag

SEQ ID NO: 87121 - DNA, 2184 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagcacccccatcgagcacgcccccgtgtgcaccagccaggccaccacccccctgctgcccgccagcgcccagccccccgccgccgccagccccagcgccgccagcccccccctggccaccgccgccgcccacaccgccatcgccagcgccagcaccaccgcccccgccagcagccccgccgacagccccagaccccaggccagcagctacagccccgccgtggccgccagcagcgcccccgccacccacaccagctacagcgagggccccgccgcccccgcccccaagcccagagtggtgaccaccgccagcatcagacccagcgtgtaccagcccgtgcccgccagcacctacagccccagccccggcgccaactacagccccaccccctacacccccagccccgcccccgcctacacccccagccccgcccccgcctacacccccagccccgtgcccacctacacccccagccccgcccccgcctacacccccagccccgcccccaactacaaccccgcccccagcgtggcctacagcggcggccccgccgagcccgccagcagacccccctgggtgaccgacgacagcttcagccagaagttcgcccccggcaagagcaccaccagcatcagcaagcagaccctgcccagaggcggccccgcctacacccccgccggcccccaggtgccccccctggccagaggcaccgtgcagagagccgagagattccccgccagcagcagaacccccctgtgcggccactgcaacaacgtgatcagaggccccttcctggtggccatgggcagaagctggcaccccgaggagttcacctgcgcctactgcaagaccagcctggccgacgtgtgcttcgtggaggagcagaacaacgtgtactgcgagagatgctacgagcagttcttcgcccccctgtgcgccaagtgcaacaccaagatcatgggcgaggtgatgcacgccctgagacagacctggcacaccacctgcttcgtgtgcgccgcctgcaagaagcccttcggcaacagcctgttccacatggaggacggcgagccctactgcgagaaggactacatcaacctgttcagcaccaagtgccacggctgcgacttccccgtggaggccggcgacaagttcatcgaggccctgggccacacctggcacgacacctgcttcatctgcgccgtgtgccacgtgaacctggagggccagcccttctacagcaagaaggacagacccctgtgcaagaagcacgcccacaccatcaacctgtag

SEQ ID NO: 87122 - DNA, 1197 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggcgccgactaccaggagagattcaaccccagcgccctgaaggacagcgccctgagcacccacaagcccatcgaggtgaagggcctgggcggcaaggccaccatcatccacgcccagtacaacacccccatcagcatgtacagccaggacgccatcatggacgccatcgccggccaggcccaggcccagggcagcgacttcagcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagagagagattcgagaccgagagaaacagccccagattcgccaagctgagaaactggcaccacggcctgagcgcccagatcctgaacgtgaagagctag

SEQ ID NO: 87123 - DNA, 852 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggtggtggtgaacagccccgccaacgccgactaccaggagagattcaaccccagcgccctgaaggacagcgccctgagcacccacaagcccatcgaggtgaagggcctgggcggcaaggccaccatcatccacgcccagtacaacacccccatcagcatgtacagccaggacgccatcatggacgccatcgccggccaggcccaggcccagggcagcgacttcagcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagagagagattcgagaccgagagaaacagccccagattcgccaagctgagaaactggcaccacggcctgagcgcccagatcctgaacgtgaagagctag

SEQ ID NO: 87124 - DNA, 2199 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggcgccgactaccaggagagattcaaccccagcgccctgaaggacagcgccctgagcacccacaagcccatcgaggtgaagggcctgggcggcaaggccaccatcatccacgcccagtacaacacccccatcagcatgtacagccaggacgccatcatggacgccatcgccggccaggcccaggcccagggcagcgacttcagcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagaccccaggccagcagctacagccccgccgtggccgccagcagcgcccccgccacccacaccagctacagcgagggccccgccgcccccgcccccaagcccagagtggtgaccaccgccagcatcagacccagcgtgtaccagcccgtgcccgccagcacctacagccccagccccggcgccaactacagccccaccccctacacccccagccccgcccccgcctacacccccagccccgcccccgcctacacccccagccccgtgcccacctacacccccagccccgcccccgcctacacccccagccccgcccccaactacaaccccgcccccagcgtggcctacagcggcggccccgccgagcccgccagcagacccccctgggtgaccgacgacagcttcagccagaagttcgcccccggcaagagcaccaccagcatcagcaagcagaccctgcccagaggcggccccgcctacacccccgccggcccccaggtgccccccctggccagaggcaccgtgcagagagccgagagattccccgccagcagcagaacccccctgtgcggccactgcaacaacgtgatcagaggccccttcctggtggccatgggcagaagctggcaccccgaggagttcacctgcgcctactgcaagaccagcctggccgacgtgtgcttcgtggaggagcagaacaacgtgtactgcgagagatgctacgagcagttcttcgcccccctgtgcgccaagtgcaacaccaagatcatgggcgaggtgatgcacgccctgagacagacctggcacaccacctgcttcgtgtgcgccgcctgcaagaagcccttcggcaacagcctgttccacatggaggacggcgagccctactgcgagaaggactacatcaacctgttcagcaccaagtgccacggctgcgacttccccgtggaggccggcgacaagttcatcgaggccctgggccacacctggcacgacacctgcttcatctgcgccgtgtgccacgtgaacctggagggccagcccttctacagcaagaaggacagacccctgtgcaagaagcacgcccacaccatcaacctgtag

SEQ ID NO: 87125 - DNA, 1854 bp, Artificial Sequence; identical to SEQ ID NO: 87118
  Description of Artificial Sequence: Synthetic coding sequence

SEQ ID NO: 87126 - DNA, 1947 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggcagcctgcccatcaaggacctggccgtggacagcgccagccccgtgtaccaggccgtgatcaagagccagaacaagcccgaggacgaggccgacgagtgggccagaagaagcagcaacctgcagagcagaagcttcagaatcctggcccagatgaccggcaccgagttcatgcaggaccccgacgaggaggccctgagaagaagcagaccccaggccagcagctacagccccgccgtggccgccagcagcgcccccgccacccacaccagctacagcgagggccccgccgcccccgcccccaagcccagagtggtgaccaccgccagcatcagacccagcgtgtaccagcccgtgcccgccagcacctacagccccagccccggcgccaactacagccccaccccctacacccccagccccgtgcccacctacacccccagccccgcccccgcctacacccccagccccgcccccaactacaaccccgcccccagcgtggcctacagcggcggccccgccgagcccgccagcagacccccctgggtgaccgacgacagcttcagccagaagttcgcccccggcaagagcaccaccagcatcagcaagcagaccctgcccagaggcggccccgcctacacccccgccggcccccaggtgccccccctggccagaggcaccgtgcagagagccgagagattccccgccagcagcagaacccccctgtgcggccactgcaacaacgtgatcagaggccccttcctggtggccatgggcagaagctggcaccccgaggagttcacctgcgcctactgcaagaccagcctggccgacgtgtgcttcgtggaggagcagaacaacgtgtactgcgagagatgctacgagcagttcttcgcccccctgtgcgccaagtgcaacaccaagatcatgggcgaggtgatgcacgccctgagacagacctggcacaccacctgcttcgtgtgcgccgcctgcaagaagcccttcggcaacagcctgttccacatggaggacggcgagccctactgcgagaaggactacatcaacctgttcagcaccaagtgccacggctgcgacttccccgtggaggccggcgacaagttcatcgaggccctgggccacacctggcacgacacctgcttcatctgcgccgtgtgccacgtgaacctggagggccagcccttctacagcaagaaggacagacccctgtgcaagaagcacgcccacaccatcaacctgtag

SEQ ID NO: 87127 - DNA, 696 bp, Artificial Sequence
  Description of Artificial Sequence: Synthetic coding sequence
atgagctacagcgtgaccctgaccggccccggcccctggggcttcagactgcagggcggcaaggacttcaacatgcccctgaccatcagcagaatcacccccggcagcaaggccgcccagagccagctgagccagggcgacctggtggtggccatcgacggcgtgaacaccgacaccatgacccacctggaggcccagaacaagatcaagagcgccagctacaacctgagcctgaccctgcagaagagcaagagacccatccccatcagcaccaccgccccccccgtgcagacccccctgcccgtgatcccccaccagaaggaccccgccctggacaccaacggcagcctggtggcccccagccccagccccgaggccagagccagccccggcacccccggcacccccgagctgagacccaccttcagccccgccttcagcagacccagcgccttcagcagcctggccgaggccagcgaccccggcccccccagagccagcctgagagccaagaccagccccgagggcgccagagacctgctgggccccaaggccctgcccggcagcagccagcccagacagtacaacaaccccatcggcctgtacagcgccgagaccctgagagagatggcccagatgtaccagatgagcctgagaggcaaggccagcggcgtgggcctgcccggcggctggtag

SEQ ID NO: 87128 - DNA, 1839 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgacttcctgccccccccccccccccccctggacgacagcagcgccctgcccagcatcagcggcaacttccccccccccccccccctggacgaggaggccttcaaggtgcagggcaaccccggcggcaagaccctggaggagagaagaagcagcctggacgccgagatcgacagcctgaccagcatcctggccgacctggagtgcagcagcccctacaagcccagacccccccagagcagcaccggcagcaccgccagcccccccgtgagcacccccgtgaccggccacaagagaatggtgatccccaaccagccccccctgaccgccaccaagaagagcaccctgaagccccagcccgccccccaggccggccccatccccgtggcccccatcggcaccctgaagccccagccccagcccgtgcccgccagctacaccaccgccagcaccagcagcagacccaccttcaacgtgcaggtgaagagcgcccagcccagcccccactacatggccgcccccagcagcggccagatctacggcagcggcccccagggctacaacacccagcccgtgcccgtgagcggccagtgccccccccccagcaccagaggcggcatggactacgcctacatccccccccccggcctgcagcccgagcccggctacggctacgcccccaaccagggcagatactacgagggctactacgccgccggccccggctacggcggcagaaacgacagcgaccccacctacggccagcagggccaccccaacacctggaagagagagcccggctacaccccccccggcgccggcaaccagaacccccccggcatgtaccccgtgaccggccccaagaagacctacatcaccgaccccgtgagcgccccctgcgccccccccctgcagcccaagggcggccacagcggccagctgggccccagcagcgtggcccccagcttcagacccgaggacgagctggagcacctgaccaagaagatgctgtacgacatggagaacccccccgccgacgagtacttcggcagatgcgccagatgcggcgagaacgtggtgggcgagggcaccggctgcaccgccatggaccaggtgttccacgtggactgcttcacctgcatcatctgcaacaacaagctgagaggccagcccttctacgccgtggagaagaaggcctactgcgagccctgctacatcaacaccctggagcagtgcaacgtgtgcagcaagcccatcatggagagaatcctgagagccaccggcaaggcctaccacccccactgcttcacctgcgtgatgtgccacagaagcctggacggcatccccttcaccgtggacgccggcggcctgatccactgcatcgaggacttccacaagaagttcgcccccagatgcagcgtgtgcaaggagcccatcatgcccgcccccggccaggaggagaccgtgagaatcgtggccctggacagagacttccacgtgcactgctacagatgcgaggactgcggcggcctgctgagcgagggcgacaaccagggctgctaccccctggacggccacatcctgtgcaagacctgcaacagcgccagaatcagagtgctgaccgccaaggccagcaccgacctgtag

SEQ ID NO: 87129 - DNA, 282 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgacttcctgccccccccccccccccccctggacgacagcagcgccctgcccagcatcagcggcaacttcccccccccccccccctag

SEQ ID NO: 87130 - DNA, 456 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgacttcctgccccccccccccccccccctggacgacagcagcgccctgcccagcatcagcggcaacttccccccccccccccccctggacgaggaggccttcaaggtgcagggcaaccccggcggcaagaccctggaggagagaagaagcagcctggacgccgagatcgacagcctgaccagcatcctggccgacctggagtgcagcagcccctacaagcccagacccccccagagcagcaccggcagcaccgccagctag

SEQ ID NO: 87131 - DNA, 336 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgacttcctgccccccccccccccccccctggacgacagcagcgccctgcccagcatcagcggcaacttccccccccccccccccctggacgaggaggccttcaaggtgcagggcaaccccggcggcaagaccctggagtag

SEQ ID NO: 87132 - DNA, 201 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgactag

SEQ ID NO: 87133 - DNA, 162 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagccctag

SEQ ID NO: 87134 - DNA, 144 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgccccctag

SEQ ID NO: 87135 - DNA, 1287 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggcgacttcctgccccccccccccccccccctggacgacagcagcgccctgcccagcatcagcggcaacttccccccccccccccccctggacgaggaggccttcaaggtgcagggcaaccccggcggcaagaccctggaggagagaagaagcagcctggacgccgagatcgacagcctgaccagcatcctggccgacctggagtgcagcagcccctacaagcccagacccccccagagcagcaccggcagcaccgccagcccccccgtgagcacccccgtgaccggccacaagagaatggtgatccccaaccagccccccctgaccgccaccaagaagagcaccctgaagccccagcccgccccccaggccggccccatccccgtggcccccatcggcaccctgaagccccagccccagcccgtgcccgccagctacaccaccgccagcaccagcagcagacccaccttcaacgtgcaggtgaagagcgcccagcccagcccccactacatggccgcccccagcagcggccagatctacggcagcggcccccagggctacaacacccagcccgtgcccgtgagcggccagtgccccccccccagcaccagaggcggcatggactacgcctacatccccccccccggcctgcagcccgagcccggctacggctacgcccccaaccagggcagatactacgagggctactacgccgccggccccggctacggcggcagaaacgacagcgaccccacctacggccagcagggccaccccaacacctggaagagagagcccggctacaccccccccggcgccggcaaccagaacccccccggcatgtaccccgtgaccggccccaagaagacctacatcaccgaccccgtgagcgccccctgcgccccccccctgcagcccaagggcggccacagcggccagctgggccccagcagcgtggcccccagcttcagacccgaggacgagctggagcacctgaccaagaagatgctgtacgacatggagaacccccccgccgacgagtacttcggcgagtggggcctggagctgaccagcgaggtgaccatcctgctgtag

SEQ ID NO: 87136 - DNA, 198 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctacaagcagcccggcggcgagggctag

SEQ ID NO: 87137 - DNA, 174 bp, Artificial Sequence
  Description of Artificial Sequence: Synthetic coding sequence
atgagccaccccagctggctgccccccaagagcaccggcgagcccctgggccacgtgcccgccagaatggagaccacccacagcttcggcaaccccagcatcagcgtgagcacccagcagccccccaagaagttcgcccccgtggtggcccccaagcccaagtacaacccctag

SEQ ID NO: 87138 - DNA, 1839 bp, Artificial Sequence; identical to SEQ ID NO: 87128
  Description of Artificial Sequence: Synthetic coding sequence

SEQ ID NO: 87139 - DNA, 471 bp, Artificial Sequence
  Description of Artificial Sequence: Synthetic coding sequence
atgcagaagaaggagaagagcttcggcatccagatgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtaccacctggactgcttcgcctgccagctgtgcaaccagagattctgcgtgggcgacaagttcttcctgaagaacaacatgatcctgtgccagaccgactacgaggagggcctgatgaaggagggctacgccccccaggtgagatag

SEQ ID NO: 87140 - DNA, 438 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtaccacctggactgcttcgcctgccagctgtgcaaccagagattctgcgtgggcgacaagttcttcctgaagaacaacatgatcctgtgccagaccgactacgaggagggcctgatgaaggagggctacgccccccaggtgagatag

SEQ ID NO: 87141 - DNA, 438 bp, Artificial Sequence; identical to SEQ ID NO: 87140
  Description of Artificial Sequence: Synthetic coding sequence

SEQ ID NO: 87142 - DNA, 438 bp, Artificial Sequence; identical to SEQ ID NO: 87140
  Description of Artificial Sequence: Synthetic coding sequence

SEQ ID NO: 87143 - DNA, 438 bp, Artificial Sequence; identical to SEQ ID NO: 87140
  Description of Artificial Sequence: Synthetic coding sequence

SEQ ID NO: 87144 - DNA, 438 bp, Artificial Sequence; identical to SEQ ID NO: 87140
  Description of Artificial Sequence: Synthetic coding sequence

SEQ ID NO: 87145 - DNA, 438 bp, Artificial Sequence; identical to SEQ ID NO: 87140
  Description of Artificial Sequence: Synthetic coding sequence

SEQ ID NO: 87146 - DNA, 438 bp, Artificial Sequence; identical to SEQ ID NO: 87140
  Description of Artificial Sequence: Synthetic coding sequence

SEQ ID NO: 87147 - DNA, 357 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtaccacctggactgcttcgcctgccagctgtgcaaccagagattctgcgtgggcgacaagttctag

SEQ ID NO: 87148 - DNA, 177 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggcctag

SEQ ID NO: 87149 - DNA, 294 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtag

SEQ ID NO: 87150 - DNA, 357 bp, Artificial Sequence; identical to SEQ ID NO: 87147
  Description of Artificial Sequence: Synthetic coding sequence

SEQ ID NO: 87151 - DNA, 255 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatctag

SEQ ID NO: 87152 - DNA, 438 bp, Artificial Sequence; identical to SEQ ID NO: 87140
  Description of Artificial Sequence: Synthetic coding sequence

SEQ ID NO: 87153 - DNA, 492 bp, Artificial Sequence
  Description of Artificial Sequence: Synthetic coding sequence
atgctgatggagggcggcagagccgccgccgccagaaacgtgagcagcatccagatgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtaccacctggactgcttcgcctgccagctgtgcaaccagagattctgcgtgggcgacaagttcttcctgaagaacaacatgatcctgtgccagaccgactacgaggagggcctgatgaaggagggctacgccccccaggtgagatag

SEQ ID NO: 87154 - DNA, 438 bp, Artificial Sequence; identical to SEQ ID NO: 87140
  Description of Artificial Sequence: Synthetic coding sequence

SEQ ID NO: 87155 - DNA, 378 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagatgggagagactgttcggcgtgaccggcaactgcgccgcctgcagcaagctgatccccgccttcgagatggtgatgagagccaaggacaacgtgtaccacctggactgcttcgcctgccagctgtgcaaccagagattctgcgtgggcgacaagttcttcctgaagaacaacatgatcctgtgccagaccgactacgaggagggcctgatgaaggagggctacgccccccaggtgagatag

SEQ ID NO: 87156 - DNA, 267 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagtag

SEQ ID NO: 87157 - DNA, 333 bp, Artificial Sequence
  Description of Artificial Sequence: Synthetic coding sequence
atgctgagcgtgcagcccgacaccaagcccaagggctgcgccggctgcaacagaaagatcaaggacagatacctgctgaaggccctggacaagtactggcacgaggactgcctgaagtgcgcctgctgcgactgcagactgggcgaggtgggcagcaccctgtacaccaaggccaacctgatcctgtgcagaagagactacctgagactgttcggcgtgaccggcaactgcgccgcctgcagcaagctgatccccgccttcgagatggtgatgagagccaaggacaacgtgtaccacctggactgcttcgcctgccagctgtgcaaccagtag

SEQ ID NO: 87158 - DNA, 357 bp, Artificial Sequence; identical to SEQ ID NO: 87147
  Description of Artificial Sequence: Synthetic coding sequence

SEQ ID NO: 87159 - DNA, 498 bp, Artificial Sequence
  Description of Artificial Sequence: Synthetic coding sequence
atggtgaaccccggcagcagcagccagcccccccccgtgaccgccggcagcctgagctggaagagatgcgccggctgcggcggcaagatcgccgacagattcctgctgtacgccatggacagctactggcacagcagatgcctgaagtgcagctgctgccaggcccagctgggcgacatcggcaccagctgctacaccaagagcggcatgatcctgtgcagaaacgactacatcagactgttcggcaacagcggcgcctgcagcgcctgcggccagagcatccccgccagcgagctggtgatgagagcccagggcaacgtgtaccacctgaagtgcttcacctgcagcacctgcagaaacagactggtgcccggcgacagattccactacatcaacggcagcctgttctgcgagcacgacagacccaccgccctgatcaacggccacctgaacagcctgcagagcaaccccctgctgcccgaccagaaggtgtgctag

SEQ ID NO: 87160 - DNA, 498 bp, Artificial Sequence; identical to SEQ ID NO: 87159
  Description of Artificial Sequence: Synthetic coding sequence

SEQ ID NO: 87161 - DNA, 2031 bp, Artificial Sequence
  Description of Artificial Sequence: Synthetic coding sequence
atggacaagtacgacgacctgggcctggaggccagcaagttcatcgaggacctgaacatgtacgaggccagcaaggacggcctgttcagagtggacaagggcgccggcaacaaccccgagttcgaggagaccagaagagtgttcgccaccaagatggccaagatccacctgcagcagcagcagcagcagctgctgcaggaggagaccctgcccagaggcagcagaggccccgtgaacggcggcggcagactgggcccccaggccagatgggaggtggtgggcagcaagctgaccgtggacggcgccgccaagccccccctggccgccagcaccggcgcccccggcgccgtgaccaccctggccgccggccagcccccctaccccccccaggagcagagaagcagaccctacctgcacggcaccagacacggcagccaggactgcggcagcagagagagcctggccaccagcgagatgagcgccttccaccagcccggcccctgcgaggaccccagctgcctgacccacggcgactactacgacaacctgagcctggccagccccaagtggggcgacaagcccggcgtgagccccagcatcggcctgagcgtgggcagcggctggcccagcagccccggcagcgacccccccctgcccaagccctgcggcgaccaccccctgaaccacagacagctgagcctgagcagcagcagaagcagcgagggcagcctgggcggccagaacagcggcatcggcggcagaagcagcgagaagcccaccggcctgtggagcaccgccagcagccagagagtgagccccggcctgcccagccccaacctggagaacggcgcccccgccgtgggccccgtgcagcccagaacccccagcgtgagcgcccccctggccctgagctgccccagacagggcggcctgcccagaagcaacagcggcctgggcggcgaggtgagcggcgtgatgagcaagcccaacgtggacccccagccctggttccaggacggccccaagagctacctgagcagcagcgcccccagcagcagccccgccggcctggacggcagccagcagggcgccgtgcccggcctgggccccaagcccggctgcaccgacctgggcaccggccccaagctgagccccaccagcctggtgcaccccgtgatgagcaccctgcccgagctgagctgcaaggagggccccctgggctggagcagcgacggcagcctgggcagcgtgctgctggacagccccagcagccccagagtgagactgccctgccagcccctggtgcccggccccgagctgagacccagcgccgccgagctgaagctggaggccctgacccagagactggagagagagatggacgcccaccccaaggccgactacttcggcgcctgcgtgaagtgcagcaagggcgtgttcggcgccggccaggcctgccaggccatgggcaacctgtaccacgacacctgcttcacctgcgccgcctgcagcagaaagctgagaggcaaggccttctacttcgtgaacggcaaggtgttctgcgaggaggacttcctgtacagcggcttccagcagagcgccgacagatgcttcctgtgcggccacctgatcatggacatgatcctgcaggccctgggcaagagctaccaccccggctgcttcagatgcgtgatctgcaacgagtgcctggacggcgtgcccttcaccgtggacagcgagaacaagatctactgcgtgagagactaccacaaggtgctggcccccaagtgcgccgcctgcggcctgcccatcctgccccccgagggcagcgacgagaccatcagagtggtgagcatggacagagactaccacgtggagtgctaccactgcgaggactgcggcctggagctgaacgacgaggacggccacagatgctaccccctggaggaccacctgttctgccacagctgccacgtgaagagactggagaagagacccagcagcaccgccctgcaccagcaccacttctag

SEQ ID NO: 87162 - DNA, 1221 bp, Artificial Sequence
  Description of Artificial Sequence: Synthetic coding sequence
atggtgcactgcgccggctgcaagagacccatcctggacagattcctgctgaacgtgctggacagagcctggcacgtgaagtgcgtgcagtgctgcgagtgcaagtgcaacctgaccgagaagtgcttcagcagagagggcaagctgtactgcaagaacgacttcttcagatgcttcggcaccaagtgcgccggctgcgcccagggcatcagccccagcgacctggtgagaagagccagaagcaaggtgttccacctgaactgcttcacctgcatgatgtgcaacaagcagctgagcaccggcgaggagctgtacatcatcgacgagaacaagttcgtgtgcaaggaggactacctgagcaacagcagcgtggccaaggagaacagcctgcacagcgccaccaccggcagcgaccccagcctgagccccgacagccaggaccccagccaggacgacgccaaggacagcgagagcgccaacgtgagcgacaaggaggccggcagcaacgagaacgacgaccagaacctgggcgccaagagaagaggccccagaaccaccatcaaggccaagcagctggagaccctgaaggccgccttcgccgccacccccaagcccaccagacacatcagagagcagctggcccaggagaccggcctgaacatgagagtgatccaggtgtggttccagaacagaagaagcaaggagagaagaatgaagcagctgagcgccctgggcgccagaagacacgccttcttcagaagccccagaagaatgagacccctggtggacagactggagcccggcgagctgatccccaacggccccttcagcttctacggcgactaccagagcgagtactacggccccggcggcaactacgacttcttcccccagggcccccccagcagccaggcccagacccccgtggacctgcccttcgtgcccagcagcggccccagcggcacccccctgggcggcctggagcaccccctgcccggccaccaccccagcagcgaggcccagagattcaccgacatcctggcccacccccccggcgacagccccagccccgagcccagcctgcccggccccctgcacagcatgagcgccgaggtgttcggccccagcccccccttcagcagcctgagcgtgaacggcggcgccagctacggcaaccacctgagccacccccccgagatgaacgaggccgccgtgtggtag

SEQ ID NO: 87163 - DNA, 1221 bp, Artificial Sequence
  Description of Artificial Sequence: Synthetic coding sequence
atgctgttccacagcctgagcggccccgaggtgcacggcgtgatcgacgagatggacagaagagccaagagcgaggcccccgccatcagcagcgccatcgacagaggcgacaccgagaccaccatgcccagcatcagcagcgacagagccgccctgtgcgccggctgcggcggcaagatcagcgacagatactacctgctggccgtggacaagcagtggcacatgagatgcctgaagtgctgcgagtgcaagctgaacctggagagcgagctgacctgcttcagcaaggacggcagcatctactgcaaggaggactactacagaagattcagcgtgcagagatgcgccagatgccacctgggcatcagcgccagcgagatggtgatgagagccagagacctggtgtaccacctgaactgcttcacctgcaccacctgcaacaagatgctgaccaccggcgaccacttcggcatgaaggacagcctggtgtactgcagactgcacttcgaggccctgctgcagggcgagtaccccgcccacttcaaccacgccgacgtggccgccgccgccgccgccgccgccgccgccaagagcgccggcctgggcgccgccggcgccaaccccctgggcctgccctactacaacggcgtgggcaccgtgcagaagggcagacccagaaagagaaagagccccggccccggcgccgacctggccgcctacaacgccgccctgagctgcaacgagaacgacgccgagcacctggacagagaccagccctaccccagcagccagaagaccaagagaatgagaaccagcttcaagcaccaccagctgagaaccatgaagagctacttcgccatcaaccacaaccccgacgccaaggacctgaagcagctggcccagaagaccggcctgaccaagagagtgctgcaggtgtggttccagaacgccagagccaagttcagaagaaacctgctgagacaggagaacaccggcgtggacaagagcaccgacgccgccctgcagaccggcacccccagcggccccgccagcgagctgagcaacgccagcctgagccccagcagcacccccaccaccctgaccgacctgaccagccccaccctgcccaccgtgaccagcgtgctgaccagcgtgcccggcaacctggagggccacgagccccacagccccagccagaccaccctgaccaacctgttctag

SEQ ID NO: 87164 - DNA, 1194 bp, Artificial Sequence
  Description of Artificial Sequence: Synthetic coding sequence
atggaggccagaggcgagctgggccccgccagagagagcgccggcggcgacctgctgctggccctgctggccagaagagccgacctgagaagagagatccccctgtgcgccggctgcgaccagcacatcctggacagattcatcctgaaggccaccgccaccggcaccgccagcgtgagcagcgccgccaccgccacccccctggccgagagatgcttcagcagaggcgagagcgtgtactgcaaggacgacttcttcaagagattcggcaccaagtgcgccgcctgccagctgggcatcccccccacccaggtggtgagaagagcccaggacttcgtgtaccacctgcactgcttcgcctgcgtggtgtgcaagagacagctggccaccggcgacgagttctacctgatggaggacagcagactggtgtgcaaggccgactacgagaccgccaagcagagagaggccgaggccaccgccaagagacccagaaccaccatcaccgccaagcagctggagaccctgaagagcgcctacaacaccagccccaagcccgccagacacgtgagagagcagctgagcagcgagaccggcctggacatgagagtggtgcaggtgtggttccagaacagaagagccaaggagaagagactgaagaaggacgccggcagacagagatggggccagtacttcagaaacatgaagagaagcagaggcggcagcaagagcgacaaggacagcgtgcaggagggccaggacagcgacgccgaggtgagcttccccgtgagcctgccctggagaaagtgggccagacccatggccagcaccggcgcctggggccaccccggcctgggccccgccctgggcagccccggccagctgctgcccggcgcctggagacccggcagacccagagccgtgcccagagccgccagcagacagcccctgagatgcccccccatccccagaagacccgccgagcccccctggccccccctgctgagcagcctggtgtaccccgacaccagcctgggcctggtgcccagcggcgcccccggcggccccccccccatgagagtgctggccggcaacggccccagcagcgacctgagcaccggcagcagcggcggctaccccgacttccccgccagccccgccagctggctggacgaggtggaccacgcccagttctag

SEQ ID NO: 87165 - DNA, 1209 bp, Artificial Sequence
  Description of Artificial Sequence: Synthetic coding sequence
atggaggccagaggcgagctgggccccgccagagagagcgccggcggcgacctgctgctggccctgctggccagaagagccgacctgagaagagagatccccctgtgcgccggctgcgaccagcacatcctggacagattcatcctgaaggccctggacagacactggcacagcaagtgcctgaagtgcagcgactgccacacccccctggccgagagatgcttcagcagaggcgagagcgtgtactgcaaggacgacttcttcaagagattcggcaccaagtgcgccgcctgccagctgggcatcccccccacccaggtggtgagaagagcccaggacttcgtgtaccacctgcactgcttcgcctgcgtggtgtgcaagagacagctggccaccggcgacgagttctacctgatggaggacagcagactggtgtgcaaggccgactacgagaccgccaagcagagagaggccgaggccaccgccaagagacccagaaccaccatcaccgccaagcagctggagaccctgaagagcgcctacaacaccagccccaagcccgccagacacgtgagagagcagctgagcagcgagaccggcctggacatgagagtggtgcaggtgtggttccagaacagaagagccaaggagaagagactgaagaaggacgccggcagacagagatggggccagtacttcagaaacatgaagagaagcagaggcggcagcaagagcgacaaggacagcgtgcaggagggccaggacagcgacgccgaggtgagcttccccgacgagcccagcctggccgagatgggccccgccaacggcctgtacggcagcctgggcgagcccacccaggccctgggcagacccagcggcgccctgggcaacttcagcctggagcacggcggcctggccggccccgagcagtacagagagctgagacccggcagcccctacggcgtgccccccagccccgccgccccccagagcctgcccggcccccagcccctgctgagcagcctggtgtaccccgacaccagcctgggcctggtgcccagcggcgcccccggcggccccccccccatgagagtgctggccggcaacggccccagcagcgacctgagcaccggcagcagcggcggctaccccgacttccccgccagccccgccagctggctggacgaggtggaccacgcccagttctag

SEQ ID NO: 87166 - DNA, 1194 bp, Artificial Sequence
  Description of Artificial Sequence: Synthetic coding sequence
atgctgctggagaccggcctggagagagacagagccagacccggcgccgccgccgtgtgcaccctgggcggcaccagagagatccccctgtgcgccggctgcgaccagcacatcctggacagattcatcctgaaggccctggacagacactggcacagcaagtgcctgaagtgcagcgactgccacacccccctggccgagagatgcttcagcagaggcgagagcgtgtactgcaaggacgacttcttcaagagattcggcaccaagtgcgccgcctgccagctgggcatcccccccacccaggtggtgagaagagcccaggacttcgtgtaccacctgcactgcttcgcctgcgtggtgtgcaagagacagctggccaccggcgacgagttctacctgatggaggacagcagactggtgtgcaaggccgactacgagaccgccaagcagagagaggccgaggccaccgccaagagacccagaaccaccatcaccgccaagcagctggagaccctgaagagcgcctacaacaccagccccaagcccgccagacacgtgagagagcagctgagcagcgagaccggcctggacatgagagtggtgcaggtgtggttccagaacagaagagccaaggagaagagactgaagaaggacgccggcagacagagatggggccagtacttcagaaacatgaagagaagcagaggcggcagcaagagcgacaaggacagcgtgcaggagggccaggacagcgacgccgaggtgagcttccccgacgagcccagcctggccgagatgggccccgccaacggcctgtacggcagcctgggcgagcccacccaggccctgggcagacccagcggcgccctgggcaacttcagcctggagcacggcggcctggccggccccgagcagtacagagagctgagacccggcagcccctacggcgtgccccccagccccgccgccccccagagcctgcccggcccccagcccctgctgagcagcctggtgtaccccgacaccagcctgggcctggtgcccagcggcgcccccggcggccccccccccatgagagtgctggccggcaacggccccagcagcgacctgagcaccggcagcagcggcggctaccccgacttccccgccagccccgccagctggctggacgaggtggaccacgcccagttctag

SEQ ID NO: 87167 - DNA, 1173 bp, Artificial Sequence
  Description of Artificial Sequence: Synthetic coding sequence
atgatgcagagcgccaccgtgcccgccgagggcgccgtgaagggcctgcccgagatgctgggcgtgcccatgcagcagatcccccagtgcgccggctgcaaccagcacatcctggacaagttcatcctgaaggtgctggacagacactggcacagcagctgcctgaagtgcgccgactgccagatgcagctggccgacagatgcttcagcagagccggcagcgtgtactgcaaggaggacttcttcaagagattcggcaccaagtgcaccgcctgccagcagggcatcccccccacccaggtggtgagaaaggcccaggacttcgtgtaccacctgcactgcttcgcctgcatcatctgcaacagacagctggccaccggcgacgagttctacctgatggaggacggcagactggtgtgcaaggaggactacgagaccgccaagcagaacgacgacagcgaggccggcgccaagagacccagaaccaccatcaccgccaagcagctggagaccctgaagaacgcctacaagaacagccccaagcccgccagacacgtgagagagcagctgagcagcgagaccggcctggacatgagagtggtgcaggtgtggttccagaacagaagagccaaggagaagagactgaagaaggacgccggcagacacagatggggccagttctacaagagcgtgaagagaagcagaggcagcagcaagcaggagaaggagagcagcgccgaggactgcggcgtgagcgacagcgagctgagcttcagagaggaccagatcctgagcgagctgggccacaccaacagaatctacggcaacgtgggcgacgtgaccggcggccagctgatgaacggcagcttcagcatggacggcaccggccagagctaccaggacctgagagacggcagcccctacggcatcccccagagccccagcagcatcagcagcctgcccagccacgcccccctgctgaacggcctggactacaccgtggacagcaacctgggcatcatcgcccacgccggccagggcgtgagccagaccctgagagccatggccggcggccccaccagcgacatcagcaccggcagcagcgtgggctaccccgacttccccaccagccccggcagctggctggacgagatggaccacccccccttctag

SEQ ID NO: 87168 - DNA, 1209 bp, Artificial Sequence
  Description of Artificial Sequence: Synthetic coding sequence
atgatggtgcactgcgccggctgcgagagacccatcctggacagattcctgctgaacgtgctggacagagcctggcacatcaagtgcgtgcagtgctgcgagtgcaagaccaacctgagcgagaagtgcttcagcagagagggcaagctgtactgcaagaacgacttcttcagaagattcggcaccaagtgcgccggctgcgcccagggcatcagccccagcgacctggtgagaaaggccagaagcaaggtgttccacctgaactgcttcacctgcatggtgtgcaacaagcagctgagcaccggcgaggagctgtacgtgatcgacgagaacaagttcgtgtgcaaggacgactacctgagcagcagcagcctgaaggagggcagcctgaacagcgtgagcagctgcaccgacagaagcctgagccccgacctgcaggacgccctgcaggacgaccccaaggagaccgacaacagcaccagcagcgacaaggagaccgccaacaacgagaacgaggagcagaacagcggcaccaagagaagaggccccagaaccaccatcaaggccaagcagctggagaccctgaaggccgccttcgccgccacccccaagcccaccagacacatcagagagcagctggcccaggagaccggcctgaacatgagagtgatccaggtgtggttccagaacagaagaagcaaggagagaagaatgaagcagctgagcgccctgggcgccagaagacacgccttcttcagaagccccagaagaatgagacccctgggcggcagactggacgagagcgagatgctgggcagcaccccctacacctactacggcgactaccagggcgactactacgcccccggcagcaactacgacttcttcgcccacggcccccccagccaggcccagagccccgccgacagcagcttcctggccgccagcggccccggcagcacccccctgggcgccctggagccccccctggccggcccccacgccgccgacaaccccagattcaccgacatgatcagccaccccgacacccccagccccgagcccggcctgcccggcaccctgcaccccatgcccggcgaggtgttcagcggcggccccagcccccccttccccatgagcggcaccagcggctacagcggccccctgagccaccccaaccccgagctgaacgaggccgccgtgtggtag

SEQ ID NO: 87169 - DNA, 1071 bp, Artificial Sequence
  Description of Artificial Sequence: Synthetic coding sequence
atgcagatcctgagcagatgccagggcctgatgagcgaggagtgcggcagaaccaccgccctggccgccggcagaaccagaaagggcgccggcgaggagggcctggtgagccccgagggcgccggcgacgaggacagctgcagcagcagcgcccccctgagccccagcagcagccccagaagcatggccagcggcagcggctgcccccccggcaagtgcgtgtgcaacagctgcggcctggagatcgtggacaagtacctgctgaaggtgaacgacctgtgctggcacgtgagatgcctgagctgcagcgtgtgcagaaccagcctgggcagacacaccagctgctacatcaaggacaaggacatcttctgcaagctggactacttcagaagatacggcaccagatgcagcagatgcggcagacacatccacagcaccgactgggtgagaagagccaagggcaacgtgtaccacctggcctgcttcgcctgcttcagctgcaagagacagctgagcaccggcgaggagttcgccctggtggaggagaaggtgctgtgcagagtgcactacgactgcatgctggacaacctgaagagagaggtggagaacggcaacggcatcagcgtggagggcgccctgctgaccgagcaggacgtgaaccaccccaagcccgccaagagagccagaaccagcttcaccgccgaccagctgcaggtgatgcaggcccagttcgcccaggacaacaaccccgacgcccagaccctgcagaagctggccgagagaaccggcctgagcagaagagtgatccaggtgtggttccagaactgcagagccagacacaagaagcacgtgagccccaaccacagcagcagcacccccgtgaccgccgtgccccccagcagactgagcccccccatgctggaggagatggcctacagcgcctacgtgccccaggacggcaccatgctgaccgccctgcacagctacatggacgcccacagccccaccaccctgggcctgcagcccctgctgccccacagcatgacccagctgcccatcagccacacctag

SEQ ID NO: 87170 - DNA, 1041 bp, Artificial Sequence
  Description of Artificial Sequence: Synthetic coding sequence
atgagcgaggagtgcggcagaaccaccgccctggccgccggcagaaccagaaagggcgccggcgaggagggcctggtgagccccgagggcgccggcgacgaggacagctgcagcagcagcgcccccctgagccccagcagcagccccagaagcatggccagcggcagcggctgcccccccggcaagtgcgtgtgcaacagctgcggcctggagatcgtggacaagtacctgctgaaggtgaacgacctgtgctggcacgtgagatgcctgagctgcagcgtgtgcagaaccagcctgggcagacacaccagctgctacatcaaggacaaggacatcttctgcaagctggactacttcagaagatacggcaccagatgcagcagatgcggcagacacatccacagcaccgactgggtgagaagagccaagggcaacgtgtaccacctggcctgcttcgcctgcttcagctgcaagagacagctgagcaccggcgaggagttcgccctggtggaggagaaggtgctgtgcagagtgcactacgactgcatgctggacaacctgaagagagaggtggagaacggcaacggcatcagcgtggagggcgccctgctgaccgagcaggacgtgaaccaccccaagcccgccaagagagccagaaccagcttcaccgccgaccagctgcaggtgatgcaggcccagttcgcccaggacaacaaccccgacgcccagaccctgcagaagctggccgagagaaccggcctgagcagaagagtgatccaggtgtggttccagaactgcagagccagacacaagaagcacgtgagccccaaccacagcagcagcacccccgtgaccgccgtgccccccagcagactgagcccccccatgctggaggagatggcctacagcgcctacgtgccccaggacggcaccatgctgaccgccctgcacagctacatggacgcccacagccccaccaccctgggcctgcagcccctgctgccccacagcatgacccagctgcccatcagccacacctag

SEQ ID NO: 87171 - DNA, 1194 bp, Artificial Sequence
  Description of Artificial Sequence: Synthetic coding sequence
atggagatcgtgggctgcagagccgaggacaacagctgccccttcagaccccccgccatgctgttccacggcatcagcggcggccacatccagggcatcatggaggagatggagagaagaagcaagaccgaggccagactggccaagggcgcccagctgaacggcagagacgccggcatgccccccctgagccccgagaagcccgccctgtgcgccggctgcggcggcaagatcagcgacagatactacctgctggccgtggacaagcagtggcacctgagatgcctgaagtgctgcgagtgcaagctggccctggagagcgagctgacctgcttcgccaaggacggcagcatctactgcaaggaggactactacagaagattcagcgtgcagagatgcgccagatgccacctgggcatcagcgccagcgagatggtgatgagagccagagacagcgtgtaccacctgagctgcttcacctgcagcacctgcaacaagaccctgaccaccggcgaccacttcggcatgaaggacagcctggtgtactgcagagcccacttcgagaccctgctgcagggcgagtaccccccccagctgagctacaccgagctggccgccaagagcggcggcctggccctgccctacttcaacggcaccggcaccgtgcagaagggcagacccagaaagagaaagagccccgccctgggcgtggacatcgtgaactacaacagcggctgcaacgagaacgaggccgaccacctggacagagaccagcagccctacccccccagccagaagaccaagagaatgagaaccagcttcaagcaccaccagctgagaaccatgaagagctacttcgccatcaaccacaaccccgacgccaaggacctgaagcagctggcccagaagaccggcctgaccaagagagtgctgcaggtgtggttccagaacgccagagccaagttcagaagaaacctgctgagacaggagaacggcggcgtggacaaggccgacggcaccagcctgcccgccccccccagcgccgacagcggcgccctgaccccccccggcaccgccaccaccctgaccgacctgaccaaccccaccatcaccgtggtgaccagcgtgaccagcaacatggacagccacgagagcggcagccccagccagaccaccctgaccaacctgttctag

SEQ ID NO: 87172 - DNA, 1167 bp, Artificial Sequence
  Description of Artificial Sequence: Synthetic coding sequence
atgctgaacggcaccaccctggaggccgccatgctgttccacggcatcagcggcggccacatccagggcatcatggaggagatggagagaagaagcaagaccgaggccagactggccaagggcgcccagctgaacggcagagacgccggcatgccccccctgagccccgagaagcccgccctgtgcgccggctgcggcggcaagatcagcgacagatactacctgctggccgtggacaagcagtggcacctgagatgcctgaagtgctgcgagtgcaagctggccctggagagcgagctgacctgcttcgccaaggacggcagcatctactgcaaggaggactactacagaagattcagcgtgcagagatgcgccagatgccacctgggcatcagcgccagcgagatggtgatgagagccagagacagcgtgtaccacctgagctgcttcacctgcagcacctgcaacaagaccctgaccaccggcgaccacttcggcatgaaggacagcctggtgtactgcagagcccacttcgagaccctgctgcagggcgagtaccccccccagctgagctacaccgagctggccgccaagagcggcggcctggccctgccctacttcaacggcaccggcaccgtgcagaagggcagacccagaaagagaaagagccccgccctgggcgtggacatcgtgaactacaacagcggctgcaacgagaacgaggccgaccacctggacagagaccagcagccctacccccccagccagaagaccaagagaatgagaaccagcttcaagcaccaccagctgagaaccatgaagagctacttcgccatcaaccacaaccccgacgccaaggacctgaagcagctggcccagaagaccggcctgaccaagagagtgctgcaggtgtggttccagaacgccagagccaagttcagaagaaacctgctgagacaggagaacggcggcgtggacaaggccgacggcaccagcctgcccgccccccccagcgccgacagcggcgccctgaccccccccggcaccgccaccaccctgaccgacctgaccaaccccaccatcaccgtggtgaccagcgtgaccagcaacatggacagccacgagagcggcagccccagccagaccaccctgaccaacctgttctag

SEQ ID NO: 87173 - DNA, 1149 bp, Artificial Sequence
  Description of Artificial Sequence: Synthetic coding sequence
atgctggacggcctgaagatggaggagaacttccagagcgccatcgacaccagcgccagcttcagcagcctgctgggcagagccgtgagccccaagagcgtgtgcgagggctgccagagagtgatcctggacagattcctgctgagactgaacgacagcttctggcacgagcagtgcgtgcagtgcgccagctgcaaggagcccctggagaccacctgcttctacagagacaagaagctgtactgcaagtacgactacgagaagctgttcgccgtgaagtgcggcggctgcttcgaggccatcgcccccaacgagttcgtgatgagagcccagaagagcgtgtaccacctgagctgcttctgctgctgcgtgtgcgagagacagctgcagaagggcgacgagttcgtgctgaaggagggccagctgctgtgcaagggcgactacgagaaggagagagagctgctgagcctggtgagccccgccgccagcgacagcggcaagagcgacgacgaggagagcctgtgcaagagcgcccacggcgccggcaagggcaccgccgaggagggcaaggaccacaagagacccaagagacccagaaccatcctgaccacccagcagagaagagccttcaaggccagcttcgaggtgagcagcaagccctgcagaaaggtgagagagaccctggccgccgagaccggcctgagcgtgagagtggtgcaggtgtggttccagaaccagagagccaagatgaagaagctggccagaagacagcagcagcagcagcaggaccagcagaacacccagagactgagcagcgcccagaccaacggcggcggcagcgccggcatggagggcatcatgaacccctacaccgccctgcccaccccccagcagctgctggccatcgagcagagcgtgtacagcagcgaccccttcagacagggcctgacccccccccagatgcccggcgaccacatgcacccctacggcgccgagcccctgttccacgacctggacagcgacgacaccagcctgagcaacctgggcgactgcttcctggccaccagcgaggccggccccctgcagagcagagtgggcaaccccatcgaccacctgtacagcatgcagaacagctacttcaccagctag

SEQ ID NO: 87174 - DNA, 1149 bp, Artificial Sequence; identical to SEQ ID NO: 87173
  Description of Artificial Sequence: Synthetic coding sequence

SEQ ID NO: 87175 - DNA, 1149 bp, Artificial Sequence; identical to SEQ ID NO: 87173
  Description of Artificial Sequence: Synthetic coding sequence

SEQ ID NO: 87176 - DNA, 1221 bp, Artificial Sequence
  Description of Artificial Sequence: Synthetic coding sequence
atggacatcgccaccggccccgagagcctggagagatgcttccccagaggccagaccgactgcgccaagatgctggacggcatcaagatggaggagcacgccctgagacccggccccgccaccctgggcgtgctgctgggcagcgactgcccccaccccgccgtgtgcgagggctgccagagacccatcagcgacagattcctgatgagagtgaacgagagcagctggcacgaggagtgcctgcagtgcgccgcctgccagcaggccctgaccaccagctgctacttcagagacagaaagctgtactgcaagcaggactaccagcagctgttcgccgccaagtgcagcggctgcatggagaagatcgcccccaccgagttcgtgatgagagccctggagtgcgtgtaccacctgggctgcttctgctgctgcgtgtgcgagagacagctgagaaagggcgacgagttcgtgctgaaggagggccagctgctgtgcaagggcgactacgagaaggagaaggacctgctgagcagcgtgagccccgacgagagcgacagcgtgaagagcgaggacgaggacggcgacatgaagcccgccaagggccagggcagccagagcaagggcagcggcgacgacggcaaggaccccagaagacccaagagacccagaaccatcctgaccacccagcagagaagagccttcaaggccagcttcgaggtgagcagcaagccctgcagaaaggtgagagagaccctggccgccgagaccggcctgagcgtgagagtggtgcaggtgtggttccagaaccagagagccaagatgaagaagctggccagaagacaccagcagcagcaggagcagcagaacagccagagactgggccagggcgagcccggccccggccagggcctgggccaggaggtgctgagcagcagaatggagggcatgatggccagctacacccccctggcccccccccagcagcagatcgtggccatggagcagagcccctacggcagcagcgaccccttccagcagggcctgacccccccccagatgcccggcaacgacagcatcttccacgacatcgacagcgacaccagcctgaccagcctgagcgactgcttcctgggcagcagcgacgtgggcagcctgcaggccagagtgggcaaccccatcgacagactgtacagcatgcagagcagctacttcgccagctag

SEQ ID NO: 87177 - DNA, 1209 bp, Artificial Sequence
  Description of Artificial Sequence: Synthetic coding sequence
atggacatcgccaccggccccgagagcctggagagatgcttccccagaggccagaccgactgcgccaagatgctggacggcatcaagatggaggagcacgccctgagacccggccccgccaccctgggcgtgctgctgggcagcgactgcccccaccccgccgtgtgcgagggctgccagagacccatcagcgacagattcctgatgagagtgaacgagagcagctggcacgaggagtgcctgcagtgcgccgcctgccagcaggccctgaccaccagctgctacttcagagacagaaagctgtactgcaagcaggactaccagcagctgttcgccgccaagtgcagcggctgcatggagaagatcgcccccaccgagttcgtgatgagagccctggagtgcgtgtaccacctgggctgcttctgctgctgcgtgtgcgagagacagctgagaaagggcgacgagttcgtgctgaaggagggccagctgctgtgcaagggcgactacgagaaggagaaggacctgctgagcagcgtgagccccgacgagagcgacagcgtgaagagcgaggacgaggacggcgacatgaagcccgccaagggccagggcagccagagcaagggcagcggcgacgacggcaaggaccccagaagacccaagagacccagaaccatcctgaccacccagcagagaagagccttcaaggccagcttcgaggtgagcagcaagccctgcagaaaggtgagagagaccctggccgccgagaccggcctgagcgtgagagtggtgcaggtgtggttccagaaccagagagccaagatgaagaagctggccagaagacaccagcagcagcaggagcagcagaacagccagagactgggccaggaggtgctgagcagcagaatggagggcatgatggccagctacacccccctggcccccccccagcagcagatcgtggccatggagcagagcccctacggcagcagcgaccccttccagcagggcctgacccccccccagatgcccggcgaccacatgaacccctacggcaacgacagcatcttccacgacatcgacagcgacaccagcctgaccagcctgagcgactgcttcctgggcagcagcgacgtgggcagcctgcaggccagagtgggcaaccccatcgacagactgtacagcatgcagagcagctacttcgccagctag

SEQ ID NO: 87178 - DNA, 1119 bp, Artificial Sequence
  Description of Artificial Sequence: Synthetic coding sequence
atgctggacggcatcaagatggaggagcacgccctgagacccggccccgccaccctgggcgtgctgctgggcagcgactgcccccaccccgccgtgtgcgagggctgccagagacccatcagcgacagattcctgatgagagtgaacgagagcagctggcacgaggagtgcctgcagtgcgccgcctgccagcaggccctgaccaccagctgctacttcagagacagaaagctgtactgcaagcaggactaccagcagctgttcgccgccaagtgcagcggctgcatggagaagatcgcccccaccgagttcgtgatgagagccctggagtgcgtgtaccacctgggctgcttctgctgctgcgtgtgcgagagacagctgagaaagggcgacgagttcgtgctgaaggagggccagctgctgtgcaagggcgactacgagaaggagaaggacctgctgagcagcgtgagccccgacgagagcgacagcgtgaagagcgaggacgaggacggcgacatgaagcccgccaagggccagggcagccagagcaagggcagcggcgacgacggcaaggaccccagaagacccaagagacccagaaccatcctgaccacccagcagagaagagccttcaaggccagcttcgaggtgagcagcaagccctgcagaaaggtgagagagaccctggccgccgagaccggcctgagcgtgagagtggtgcaggtgtggttccagaaccagagagccaagatgaagaagctggccagaagacaccagcagcagcaggagcagcagaacagccagagactgggccaggaggtgctgagcagcagaatggagggcatgatggccagctacacccccctggcccccccccagcagcagatcgtggccatggagcagagcccctacggcagcagcgaccccttccagcagggcctgacccccccccagatgcccggcaacgacagcatcttccacgacatcgacagcgacaccagcctgaccagcctgagcgactgcttcctgggcagcagcgacgtgggcagcctgcaggccagagtgggcaaccccatcgacagactgtacagcatgcagagcagctacttcgccagctag

SEQ ID NO: 87179 - DNA, 1188 bp, Artificial Sequence
  Description of Artificial Sequence: Synthetic coding sequence
atggacatcgccaccggccccgagagcctggagagatgcttccccagaggccagaccgactgcgccaagatgctggacggcatcaagatggaggagcacgccctgagacccggccccgccaccctgggcgtgctgctgggcagcgactgcccccaccccgccgtgtgcgagggctgccagagacccatcagcgacagattcctgatgagagtgaacgagagcagctggcacgaggagtgcctgcagtgcgccgcctgccagcaggccctgaccaccagctgctacttcagagacagaaagctgtactgcaagcaggactaccagcagctgttcgccgccaagtgcagcggctgcatggagaagatcgcccccaccgagttcgtgatgagagccctggagtgcgtgtaccacctgggctgcttctgctgctgcgtgtgcgagagacagctgagaaagggcgacgagttcgtgctgaaggagggccagctgctgtgcaagggcgactacgagaaggagaaggacctgctgagcagcgtgagccccgacgagagcgacagcgtgaagagcgaggacgaggacggcgacatgaagcccgccaagggccagggcagccagagcaagggcagcggcgacgacggcaaggaccccagaagacccaagagacccagaaccatcctgaccacccagcagagaagagccttcaaggccagcttcgaggtgagcagcaagccctgcagaaaggtgagagagaccctggccgccgagaccggcctgagcgtgagagtggtgcaggtgtggttccagaaccagagagccaagatgaagaagctggccagaagacaccagcagcagcaggagcagcagaacagccagagactgggccaggaggtgctgagcagcagaatggagggcatgatggccagctacacccccctggcccccccccagcagcagatcgtggccatggagcagagcccctacggcagcagcgaccccttccagcagggcctgacccccccccagatgcccggcaacgacagcatcttccacgacatcgacagcgacaccagcctgaccagcctgagcgactgcttcctgggcagcagcgacgtgggcagcctgcaggccagagtgggcaaccccatcgacagactgtacagcatgcagagcagctacttcgccagctag

SEQ ID NO: 87180 - DNA, 318 bp, Artificial Sequence
  Description of Artificial Sequence: Synthetic coding sequence
atgagcatctacttccccatccactgccccgactacctgagaagcgccaagatgaccgaggtgatgatgaacacccagcccatggaggagatcggcctgagccccagaaaggacggcctgagctaccagatcttccccgaccccagcgacttcgacagatgctgcaagctgaaggacagactgcccagcatcgtggtggagcccaccgagggcgaggtggagagcggcgagctgagatggccccccgaggagttcctggtgcaggaggacgagcaggacaactgcgaggagaccgccaaggagaacaaggagcagtag

SEQ ID NO: 87181 - DNA, 264 bp, Artificial Sequence
  Description of Artificial Sequence: Synthetic coding sequence
atggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcctgcacaagctgcacctgcccaacaccagcagagacagcgagaccgccagcgtgatgaccagcagcgccagagacaccggcttccaccacctgcaggccctgatgtgctag

SEQ ID NO: 87182 - DNA, 687 bp, Artificial Sequence
  Description of Artificial Sequence: Synthetic coding sequence
atggagggccaggacgaggtgagcgccagagagcagcacttccacagccaggtgagagagagcaccatctgcttcctgctgttcgccatcctgtacgtggtgagctacttcatcatcaccagatacaagagaaagagcgacgagcaggaggacgaggacgccatcgtgaacagaatcagcctgttcctgagcaccttcaccctggccgtgagcgccggcgccgtgctgctgctgcccttcagcatcatcagcaacgagatcctgctgagcttcccccagaactactacatccagtggctgaacggcagcctgatccacggcctgtggaacctggccagcctgttcagcaacctgtgcctgttcgtgctgatgcccttcgccttcttcttcctggagagcgagggcttcgccggcctgaagaagggcatcagagccagaatcctggagaccctggtgatgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgcacctgcccaacaccagcagagacagcgagaccgccaagcccagcgtgaacggccaccagaaggccctgtag

SEQ ID NO: 87183 - DNA, 1473 bp, Artificial Sequence
  Description of Artificial Sequence: Synthetic coding sequence
atggagggccaggacgaggtgagcgccagagagcagcacttccacagccaggtgagagagagcaccatctgcttcctgctgttcgccatcctgtacgtggtgagctacttcatcatcaccagatacaagagaaagagcgacgagcaggaggacgaggacgccatcgtgaacagaatcagcctgttcctgagcaccttcaccctggccgtgagcgccggcgccgtgctgctgctgcccttcagcatcatcagcaacgagatcctgctgagcttcccccagaactactacatccagtggctgaacggcagcctgatccacggcctgtggaacctggccagcctgttcagcaacctgtgcctgttcgtgctgatgcccttcgccttcttcttcctggagagcgagggcttcgccggcctgaagaagggcatcagagccagaatcctggagaccctggtgatgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgctgctgtgcacccccgtgggcctgagcagaatgttcaccgtgatgggccagctgctggtgaagcccaccatcctggaggacctggacgagcagatctacatcatcaccctggaggaggaggccctgcagagaagactgaacggcctgagcagcagcgtggagtacaacatcatggagctggagcaggagctggagaacgtgaagaccctgaagaccaagctggagagaagaaagaaggccagcgcctgggagagaaacctggtgtaccccgccgtgatggtgctgctgctgatcgagaccagcatcagcgtgctgctggtggcctgcaacatcctgtgcctgctggtggacgagaccgccatgcccaagggcaccagaggccccggcatcggcaacgccagcctgagcaccttcggcttcgtgggcgccgccctggagatcatcctgatcttctacctgatggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcatcaccagattcgacctgctgggcgacttcggcagattcaactggctgggcaacttctacatcgtgctgagctacaacctgctgttcgccatcgtgaccaccctgtgcctggtgagaaagttcaccagcgccgtgagagaggagctgttcaaggccctgggcctgcacaagctgcacctgcccaacaccagcagagacagcgagaccgccaagcccagcgtgaacggccaccagaaggccctgtag

SEQ ID NO: 87184 - DNA, 1596 bp, Artificial Sequence
  Description of Artificial Sequence: Synthetic coding sequence
atggagggccaggacgaggtgagcgccagagagcagcacttccacagccaggtgagagagagcaccatctgcttcctgctgttcgccatcctgtacgtggtgagctacttcatcatcaccagatacaagagaaagagcgacgagcaggaggacgaggacgccatcgtgaacagaatcagcctgttcctgagcaccttcaccctggccgtgagcgccggcgccgtgctgctgctgcccttcagcatcatcagcaacgagatcctgctgagcttcccccagaactactacatccagtggctgaacggcagcctgatccacggcctgtggaacctggccagcctgttcagcaacctgtgcctgttcgtgctgatgcccttcgccttcttcttcctggagagcgagggcttcgccggcctgaagaagggcatcagagccagaatcctggagaccctggtgatgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgctgctgtgcacccccgtgggcctgagcagaatgttcaccgtgatgggccagctgctggtgaagcccaccatcctggaggacctggacgagcagatctacatcatcaccctggaggaggaggccctgcagagaagactgaacgtgggcatgctgtgcgccggcaaccccgaggtggccaccggcagacaggtgcccgaggagcaggccggccagctgctgctgggcaagtggatccaggagggcggcgacatgatcgccaaccccagactgagcagcagcgtggagtacaacatcatggagctggagcaggagctggagaacgtgaagaccctgaagaccaagctggagagaagaaagaaggccagcgcctgggagagaaacctggtgtaccccgccgtgatggtgctgctgctgatcgagaccagcatcagcgtgctgctggtggcctgcaacatcctgtgcctgctggtggacgagaccgccatgcccaagggcaccagaggccccggcatcggcaacgccagcctgagcaccttcggcttcgtgggcgccgccctggagatcatcctgatcttctacctgatggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcatcaccagattcgacctgctgggcgacttcggcagattcaactggctgggcaacttctacatcgtgctgagctacaacctgctgttcgccatcgtgaccaccctgtgcctggtgagaaagttcaccagcgccgtgagagaggagctgttcaaggccctgggcctgcacaagctgcacctgcccaacaccagcagagacagcgagaccgccaagcccagcgtgaacggccaccagaaggccctgtag

SEQ ID NO: 87185 - DNA, 855 bp, Artificial Sequence
  Description of Artificial Sequence: Synthetic coding sequence
atgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgctgctgtgcacccccgtgggcctgagcagaatgttcaccgtgatgggccagctgctggtgaagcccaccatcctggaggacctggacgagcagatctacatcatcaccctggaggaggaggccctgcagagaagactgaacggcctgagcagcagcgtggagtacaacatcatggagctggagcaggagctggagaacgtgaagaccctgaagaccaagctggagagaagaaagaaggccagcgcctgggagagaaacctggtgtaccccgccgtgatggtgctgctgctgatcgagaccagcatcagcgtgctgctggtggcctgcaacatcctgtgcctgctggtggacgagaccgccatgcccaagggcaccagaggccccggcatcggcaacgccagcctgagcaccttcggcttcgtgggcgccgccctggagatcatcctgatcttctacctgatggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcctgcacaagctgcacctgcccaacaccagcagagacagcgagaccgccaagcccagcgtgaacggccaccagaaggccctgtag

SEQ ID NO: 87186 - DNA, 1590 bp, Artificial Sequence
  Description of Artificial Sequence: Synthetic coding sequence
ggccaggacgaggtgagcgccagagagcagcacttccacagccaggtgagagagagcaccatctgcttcctgctgttcgccatcctgtacgtggtgagctacttcatcatcaccagatacaagagaaagagcgacgagcaggaggacgaggacgccatcgtgaacagaatcagcctgttcctgagcaccttcaccctggccgtgagcgccggcgccgtgctgctgctgcccttcagcatcatcagcaacgagatcctgctgagcttcccccagaactactacatccagtggctgaacggcagcctgatccacggcctgtggaacctggccagcctgttcagcaacctgtgcctgttcgtgctgatgcccttcgccttcttcttcctggagagcgagggcttcgccggcctgaagaagggcatcagagccagaatcctggagaccctggtgatgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgctgctgtgcacccccgtgggcctgagcagaatgttcaccgtgatgggccagctgctggtgaagcccaccatcctggaggacctggacgagcagatctacatcatcaccctggaggaggaggccctgcagagaagactgaacgtgggcatgctgtgcgccggcaaccccgaggtggccaccggcagacaggtgcccgaggagcaggccggccagctgctgctgggcaagtggatccaggagggcggcgacatgatcgccaaccccagactgagcagcagcgtggagtacaacatcatggagctggagcaggagctggagaacgtgaagaccctgaagaccaagctggagagaagaaagaaggccagcgcctgggagagaaacctggtgtaccccgccgtgatggtgctgctgctgatcgagaccagcatcagcgtgctgctggtggcctgcaacatcctgtgcctgctggtggacgagaccgccatgcccaagggcaccagaggccccggcatcggcaacgccagcctgagcaccttcggcttcgtgggcgccgccctggagatcatcctgatcttctacctgatggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcatcaccagattcgacctgctgggcgacttcggcagattcaactggctgggcaacttctacatcgtgctgagctacaacctgctgttcgccatcgtgaccaccctgtgcctggtgagaaagttcaccagcgccgtgagagaggagctgttcaaggccctgggcctgcacaagctgcacctgcccaacaccagcagagacagcgagaccgccaagcccagcgtgaacggccaccagaaggccctgtag

SEQ ID NO: 87187 - DNA, 1248 bp, Artificial Sequence
  Description of Artificial Sequence: Synthetic coding sequence
atgaaggaggacggcagagccggcagaggcgtgggcgccggcgccgccctgccccagcccagcgccggcgtgcacgacgagcaggaggacgaggacgccatcgtgaacagaatcagcctgttcctgagcaccttcaccctggccgtgagcgccggcgccgtgctgctgctgcccttcagcatcatcagcaacgagatcctgctgagcttcccccagaactactacatccagtggctgaacggcagcctgatccacggcctgtggaacctggccagcctgttcagcaacctgtgcctgttcgtgctgatgcccttcgccttcttcttcctggagagcgagggcttcgccggcctgaagaagggcatcagagccagaatcctggagaccctggtgatgctgctgctgctggccctgctgatcctgggcatcgtgtgggtggccagcgccctgatcgacaacgacgccgccagcatggagagcctgtacgacctgtgggagttctacctgccctacctgtacagctgcatcagcctgatgggctgcctgctgctgctgctgtgcacccccgtgggcctgagcagaatgttcaccgtgatgggccagctgctggtgaagcccaccatcctggaggacctggacgagcagatctacatcatcaccctggaggaggaggccctgcagagaagactgaacggcctgagcagcagcgtggagtacaacatcatggagctggagcaggagctggagaacgtgaagaccctgaagaccaagctggagagaagaaagaaggccagcgcctgggagagaaacctggtgtaccccgccgtgatggtgctgctgctgatcgagaccagcatcagcgtgctgctggtggcctgcaacatcctgtgcctgctggtggacgagaccgccatgcccaagggcaccagaggccccggcatcggcaacgccagcctgagcaccttcggcttcgtgggcgccgccctggagatcatcctgatcttctacctgatggtgagcagcgtggtgggcttctacagcctgagattcttcggcaacttcacccccaagaaggacgacaccaccatgaccaagatcatcggcaactgcgtgagcatcctggtgctgagcagcgccctgcccgtgatgagcagaaccctgggcctgcacaagctgcacctgcccaacaccagcagagacagcgagaccgccaagcccagcgtgaacggccaccagaaggccctgtag

SEQ ID NO: 87188 - DNA, 1470 bp, Artificial Sequence
  Description of Artificial Sequence: Synthetic coding sequence
atggaggcccccgactacgaggtgctgagcgtgagagagcagctgttccacgagagaatcagagagtgcatcatcagcaccctgctgttcgccaccctgtacatcctgtgccacatcttcctgaccagattcaagaagcccgccgagttcaccaccgtggacgacgaggacgccaccgtgaacaagatcgccctggagctgtgcaccttcaccctggccatcgccctgggcgccgtgctgctgctgcccttcagcatcatcagcaacgaggtgctgctgagcctgcccagaaactactacatccagtggctgaacggcagcctgatccacggcctgtggaacctggtgttcctgttcagcaacctgagcctgatcttcctgatgcccttcgcctacttcttcaccgagagcgagggcttcgccggcagcagaaagggcgtgctgggcagagtgtacgagaccgtggtgatgctgatgctgctgaccctgctggtgctgggcatggtgtgggtggccagcgccatcgtggacaagaacaaggccaacagagagagcctgtacgacttctgggagtactacctgccctacctgtacagctgcatcagcttcctgggcgtgctgctgctgctggtgtgcacccccctgggcctggccagaatgttcagcgtgaccggcaagctgctggtgaagcccagactgctggaggacctggaggagcagctgtactgcagcgccttcgaggaggccgccctgaccagaagaatctgcaaccccaccagctgctggctgcccctggacatggagctgctgcacagacaggtgctggccctgcagacccagagagtgctgctggagaagagaagaaaggccagcgcctggcagagaaacctgggctaccccctggccatgctgtgcctgctggtgctgaccggcctgagcgtgctgatcgtggccatccacatcctggagctgctgatcgacgaggccgccatgcccagaggcatgcagggcaccagcctgggccaggtgagcttcagcaagctgggcagcttcggcgccgtgatccaggtggtgctgatcttctacctgatggtgagcagcgtggtgggcttctacagcagccccctgttcagaagcctgagacccagatggcacgacaccgccatgacccagatcatcggcaactgcgtgtgcctgctggtgctgagcagcgccctgcccgtgttcagcagaaccctgggcctgaccagattcgacctgctgggcgacttcggcagattcaactggctgggcaacttctacatcgtgttcctgtacaacgccgccttcgccggcctgaccaccctgtgcctggtgaagaccttcaccgccgccgtgagagccgagctgatcagagccttcggcctggacagactgcccctgcccgtgagcggcttcccccaggccagcagaaagacccagcaccagtag

SEQ ID NO: 87189 - DNA, 1455 bp, Artificial Sequence
  Description of Artificial Sequence: Synthetic coding sequence
atggtgaacgtgaaggccctgtgcgagcccgaggtgagcaactgctggatgaacgtgatcaccggcaccggcagcgtgagcagccccctgctggtgctgccccagcccggccccgagaccagcctgatgaccggcgagcccgtggacgacgaggacgccaccgtgaacaagatcgccctggagctgtgcaccttcaccctggccatcgccctgggcgccgtgctgctgctgcccttcagcatcatcagcaacgaggtgctgctgagcctgcccagaaactactacatccagtggctgaacggcagcctgatccacggcctgtggaacctggtgttcctgttcagcaacctgagcctgatcttcctgatgcccttcgcctacttcttcaccgagagcgagggcttcgccggcagcagaaagggcgtgctgggcagagtgtacgagaccgtggtgatgctgatgctgctgaccctgctggtgctgggcatggtgtgggtggccagcgccatcgtggacaagaacaaggccaacagagagagcctgtacgacttctgggagtactacctgccctacctgtacagctgcatcagcttcctgggcgtgctgctgctgctggtgtgcacccccctgggcctggccagaatgttcagcgtgaccggcaagctgctggtgaagcccagactgctggaggacctggaggagcagctgtactgcagcgccttcgaggaggccgccctgaccagaagaatctgcaaccccaccagctgctggctgcccctggacatggagctgctgcacagacaggtgctggccctgcagacccagagagtgctgctggagaagagaagaaaggccagcgcctggcagagaaacctgggctaccccctggccatgctgtgcctgctggtgctgaccggcctgagcgtgctgatcgtggccatccacatcctggagctgctgatcgacgaggccgccatgcccagaggcatgcagggcaccagcctgggccaggtgagcttcagcaagctgggcagcttcggcgccgtgatccaggtggtgctgatcttctacctgatggtgagcagcgtggtgggcttctacagcagccccctgttcagaagcctgagacccagatggcacgacaccgccatgacccagatcatcggcaactgcgtgtgcctgctggtgctgagcagcgccctgcccgtgttcagcagaaccctgggcctgaccagattcgacctgctgggcgacttcggcagattcaactggctgggcaacttctacatcgtgttcctgtacaacgccgccttcgccggcctgaccaccctgtgcctggtgaagaccttcaccgccgccgtgagagccgagctgatcagagccttcggcctggacagactgcccctgcccgtgagcggcttcccccaggccagcagaaagacccagcaccagtag

SEQ ID NO: 87190 - DNA, 1410 bp, Artificial Sequence
  Description of Artificial Sequence: Synthetic coding sequence
atggaggcccccgactacgaggtgctgagcgtgagagagcagctgttccacgagagaatcagagagtgcatcatcagcaccctgctgttcgccaccctgtacatcctgtgccacatcttcctgaccagattcaagaagcccgccgagttcaccaccgtggacgacgaggacgccaccgtgaacaagatcgccctggagctgtgcaccttcaccctggccatcgccctgggcgccgtgctgctgctgcccttcagcatcatcagcaacgaggtgctgctgagcctgcccagaaactactacatccagtggctgaacggcagcctgatccacggcctgtggaacctggtgttcctgttcagcaacctgagcctgatcttcctgatgcccttcgcctacttcttcaccgagagcgagggcttcgccggcagcagaaagggcgtgctgggcagagtgtacgagaccgtggtgatgctgatgctgctgaccctgctggtgctgggcatggtgtgggtggccagcgccatcgtggacaagaacaaggccaacagagagagcctgtacgacttctgggagtactacctgccctacctgtacagctgcatcagcttcctgggcgtgctgctgctgctggtgtgcacccccctgggcctggccagaatgttcagcgtgaccggcaagctgctggtgaagcccagactgctggaggacctggaggagcagctgtactgcagcgccttcgaggaggccgccctgaccagaagaatctgcaaccccaccagctgctggctgcccctggacatggagctgctgcacagacaggtgctggccctgcagacccagagagtgctgctggagaagagaagaaaggccagcgcctggcagagaaacctgggctaccccctggccatgctgtgcctgctggtgctgaccggcctgagcgtgctgatcgtggccatccacatcctggagctgctgatcgacgaggccgccatgcccagaggcatgcaggtggtgctgatcttctacctgatggtgagcagcgtggtgggcttctacagcagccccctgttcagaagcctgagacccagatggcacgacaccgccatgacccagatcatcggcaactgcgtgtgcctgctggtgctgagcagcgccctgcccgtgttcagcagaaccctgggcctgaccagattcgacctgctgggcgacttcggcagattcaactggctgggcaacttctacatcgtgttcctgtacaacgccgccttcgccggcctgaccaccctgtgcctggtgaagaccttcaccgccgccgtgagagccgagctgatcagagccttcggcctggacagactgcccctgcccgtgagcggcttcccccaggccagcagaaagacccagcaccagtag

SEQ ID NO: 87191 - DNA, 384 bp, Artificial Sequence
  Description of Artificial Sequence: Synthetic coding sequence
atggaggcccccgactacgaggtgctgagcgtgagagagcagctgttccacgagagaatcagagagtgcatcatcagcaccctgctgttcgccaccctgtacatcctgtgccacatcttcctgaccagattcaagaagcccgccgagttcaccaccgtggacgacgaggacgccaccgtgaacaagatcgccctggagctgtgcaccttcaccctggccatcgccctgggcgccgtgctgctgctgcccttcagcatcatcagcaacgaggtgctgctgagcctgcccagaaactactacatccagtggctgaacggcagcctgatccacggcctgtggaacctggtgttcctgttcagcaacctgagcctgatcttcctgtag

SEQ ID NO: 87192 - DNA, 1017 bp, Artificial Sequence
  Description of Artificial Sequence: Synthetic coding sequence
atggtgagaagagtgcagcccgacagaaagcagctgcccctggtgctgctgagactgctgtgcctgctgcccaccggcctgcccgtgagaagcgtggacttcaacagaggcaccgacaacatcaccgtgagacagggcgacaccgccatcctgagatgcgtggtggaggacaagaacagcaaggtggcctggctgaacagaagcggcatcatcttcgccggccacgacaagtggagcctggaccccagagtggagctggagaagagacacagcctggagtacagcctgagaatccagaaggtggacgtgtacgacgagggcagctacacctgcagcgtgcagacccagcacgagcccaagaccagccaggtgtacctgatcgtgcaggtgccccccaagatcagcaacatcagcagcgacgtgaccgtgaacgagggcagcaacgtgaccctggtgtgcatggccaacggcagacccgagcccgtgatcacctggagacacctgacccccaccggcagagagttcgagggcgaggaggagtacctggagatcctgggcatcaccagagagcagagcggcaagtacgagtgcaaggccgccaacgaggtgagcagcgccgacgtgaagcaggtgaaggtgaccgtgaactacccccccaccatcaccgagagcaagagcaacgaggccaccaccggcagacaggccagcctgaagtgcgaggccagcgccgtgcccgcccccgacttcgagtggtacagagacgacaccagaatcaacagcgccaacggcctggagatcaagagcaccgagggccagagcagcctgaccgtgaccaacgtgaccgaggagcactacggcaactacacctgcgtggccgccaacaagctgggcgtgaccaacgccagcctggtgctgttcagacccggcagcgtgagaggcatcaacggcagcatcagcctggccgtgcccctgtggctgctggccgccagcctgctgtgcctgctgagcaagtgctag

SEQ ID NO: 87193 - DNA, 1077 bp, Artificial Sequence
  Description of Artificial Sequence: Synthetic coding sequence
atgagaacctactggctgcacagcgtgtgggtgctgggcttcttcctgagcctgttcagcctgcagggcctgcccgtgagaagcgtggacttcaacagaggcaccgacaacatcaccgtgagacagggcgacaccgccatcctgagatgcgtggtggaggacaagaacagcaaggtggcctggctgaacagaagcggcatcatcttcgccggccacgacaagtggagcctggaccccagagtggagctggagaagagacacagcctggagtacagcctgagaatccagaaggtggacgtgtacgacgagggcagctacacctgcagcgtgcagacccagcacgagcccaagaccagccaggtgtacctgatcgtgcaggtgccccccaagatcagcaacatcagcagcgacgtgaccgtgaacgagggcagcaacgtgaccctggtgtgcatggccaacggcagacccgagcccgtgatcacctggagacacctgacccccaccggcagagagttcgagggcgaggaggagtacctggagatcctgggcatcaccagagagcagagcggcaagtacgagtgcaaggccgccaacgaggtgagcagcgccgacgtgaagcaggtgaaggtgaccgtgaactacccccccaccatcaccgagagcaagagcaacgaggccaccaccggcagacaggccagcctgaagtgcgaggccagcgccgtgcccgcccccgacttcgagtggtacagagacgacaccagaatcaacagcgccaacggcctggagatcaagagcaccgagggccagagcagcctgaccgtgaccaacgtgaccgaggagcactacggcaactacacctgcgtggccgccaacaagctgggcgtgaccaacgccagcctggtgctgttcaagagagtgctgcccaccatcccccaccccatccaggagatcggcaccaccgtgcacttcaagcagaagggccccggcagcgtgagaggcatcaacggcagcatcagcctggccgtgcccctgtggctgctggccgccagcctgctgtgcctgctgagcaagtgctag

SEQ ID NO: 87194 - DNA, 753 bp, Artificial Sequence
  Description of Artificial Sequence: Synthetic coding sequence
atggccgagggcggcgccagcaagggcggcggcgaggagcccggcaagctgcccgagcccgccgaggaggagagccaggtgctgagaggcaccggccactgcaagtggttcaacgtgagaatgggcttcggcttcatcagcatgatcaacagagagggcagccccctggacatccccgtggacgtgttcgtgcaccagagcaagctgttcatggagggcttcagaagcctgaaggagggcgagcccgtggagttcaccttcaagaagagcagcaagggcctggagagcatcagagtgaccggccccggcggcagcccctgcctgggcagcgagagaagacccaagggcaagaccctgcagaagagaaagcccaagggcgacagatgctacaactgcggcggcctggaccaccacgccaaggagtgcagcctgcccccccagcccaagaagtgccactactgccagagcatcatgcacatggtggccaactgcccccacaagaacgtggcccagccccccgccagcagccagggcagacaggaggccgagagccagccctgcaccagcaccctgcccagagaggtgggcggcggccacggctgcaccagcccccccttcccccaggaggccagagccgagatcagcgagagaagcggcagaagcccccaggaggccagcagcaccaagagcagcatcgcccccgaggagcagagcaagaagggccccagcgtgcagaagagaaagaagacctag

SEQ ID NO: 87195 - DNA, 2250 bp, Artificial Sequence
  Description of Artificial Sequence: Synthetic coding sequence
atggaggtggtgcccgccgaggtgaacagcctgctgcccgaggagatcatggacaccggcatcaccctggtggacgacgacagcatcgaggccgtgatcgtgagcagccccatccccatggagaccgagctggaggagatcgtgaacatcaacagcaccggcgacagcaccgccacccccatcagcaccgagcccatcaccgtgtacagcaaccacaccaaccaggtggccgtgaacaccaccatcaccaaggccgacagcaacaccaccgtgaagcccgccttccccagcggcctgcagaagctgggcgcccagacccccgtgaccatcagcgccaaccagatcatcctgaacaaggtgagccagaccagcgacctgaagctgggcaaccagaccctgaagcccgacggccagaagctgatcctgaccaccctgggcaagagcggcagccccatcgtgctggccctgccccacagccagctgccccaggcccagaaggtgaccacccaggcccagagcggcgacgccaagctgcccccccagcagatcaaggtggtgaccatcggcggcagacccgaggtgaagcccgtgatcggcgtgagcgccctgacccccggcagccagctgatcaacaccaccacccagcccagcgtgctgcagacccagcagctgaagaccgtgcagatcgccaagaagcccagaacccccaccagcggccccgtgatcaccaagctgatcttcgccaagcccatcaacagcaaggccgtgaccggccagaccacccaggtgagcccccccgtgatcgccggcagagtgctgagccagagcacccccggcacccccagcaagaccatcaccatcagcgagagcggcgtgatcggcagcaccctgaacagcaccacccagacccccaacaagatcgccatcagccccctgaagagccccaacaaggccgtgaagagcaccgtgcagaccatcaccgtgggcggcgtgagcaccagccagttcaagaccatcatccccctggccaccgcccccaacgtgcagcagatccaggtgcccggcagcaagttccactacgtgagactggtgaccgccaccagcgccagcagcagcacccagcccgtgagccagaaccccagcaccaacacccagcccctgcagcaggccaagcccgtggtggtgaacaccacccccgtgagaatgagcgtgcccatcgtgagcgcccaggccgtgaagcaggtggtgcccaagcccatcaaccccaccagccagatcgtgaccaccagccagccccagcagagactgatcatgcccgccacccccctgccccagatccagcccaacctgaccaacctgccccccggcaccgtgctggcccccgcccccggcaccggcaacgtgggctacgccgtgctgcccgcccagtacgtgacccagctgcagcagagcagctacgtgagcatcgccagcaacagcaccttcaccggcaccagcggcatccagacccaggccagactgcccttcaacggcatcatccccagcgagagcgccagcagacccagaaagccctgcaactgcaccaagagcctgtgcctgaagctgtactgcgactgcttcgccaacggcgagttctgcaacaactgcaactgcaccaactgctacaacaacctggagcacgagaacgagagacagaaggccatcaaggcctgcctggacagaaaccccgaggccttcaagcccaagatcggcaagggcaaggagggcgagagcgacagaagacacagcaagggctgcaactgcaagagaagcggctgcctgaagaactactgcgagtgctacgaggccaagatcatgtgcagcagcatctgcaagtgcatcggctgcaagaacttcgaggagagccccgagagaaagaccctgatgcacctggccgacgccgccgaggtgagagtgcagcagcagaccgccgccaagaccaagctgagcagccagatcagcgacctgctgaccagacccacccccgccctgaacagcggcggcggcaagctgcccttcaccttcgtgaccaaggaggtggccgaggccacctgcaactgcctgctggcccaggccgagcaggccgacaagaagggcaagagcaaggccgccgccgagagaatgatcctggaggagttcggcagatgcctgatgagcgtgatcaacagcgccggcaaggccaagagcgacccctgcgccatgaactgctag

SEQ ID NO: 87196 - DNA, 732 bp, Artificial Sequence
  Description of Artificial Sequence: Synthetic coding sequence
atggaggtggtgcccgccgaggtgaacagcctgctgcccgaggagatcatggacaccggcatcaccctggtggacgacgacagcatcgaggccgtgatcgtgagcagccccatccccatggagaccgagctggaggagatcgtgaacatcaacagcaccggcgacagcaccgccacccccatcagcaccgagcccatcaccgtgtacagcaaccacaccaaccaggtggccgtgaacaccaccatcaccaaggccgacagcaacaccaccgtgaagcccgccttccccagcggcctgcagaagctgggcgcccagacccccgtgaccatcagcgccaaccagatcatcctgaacaaggtgagccagaccagcgacctgaagctgggcaaccagaccctgaagcccgacggccagaagctgatcctgaccaccctgggcaagagcggcagccccatcgtgctggccctgccccacagccagctgccccaggcccagaaggtgaccacccaggcccagagcggcgacgccaagctgcccccccagcagatcaaggtggtgaccatcggcggcagacccgaggtgaagcccgtgatcggcgtgagcgccctgacccccggcagccagctgatcaacaccaccacccagcccagcgtgctgcagacccagcagctgaagaccgtgcaggtgggcttcttccacagcctgctgcccgagctgcaccagagaccctag

SEQ ID NO: 87197 - DNA, 1983 bp, Artificial Sequence
  Description of Artificial Sequence: Synthetic coding sequence
atggaggtggtgcccgccgaggtgaacagcctgctgcccgaggagatcatggacaccggcatcaccctggtggacgacgacagcatcgaggccgtgatcgtgagcagccccatccccatggagaccgagctggaggagatcgtgaacatcaacagcaccggcgacagcaccgccacccccatcagcaccgagcccatcaccgtgtacagcaaccacaccaaccaggtggccgtgaacaccaccatcaccaaggccgacagcaacaccaccgtgaagcccgccttccccagcggcctgcagaagctgggcgcccagacccccgtgaccatcagcgccaaccagatcatcctgaacaaggtgagccagaccagcgacctgaagctgggcaaccagaccctgaagcccgacggccagaagctgatcctgaccaccctgggcaagagcggcagccccatcgtgctggccctgccccacagccagctgccccaggcccagaaggtgaccacccaggcccagagcggcgacgccaagctgcccccccagcagatcaaggtggtgaccatcggcggcagacccgaggtgaagcccgtgatcggcgtgagcgccctgacccccggcagccagctgatcaacaccaccacccagcccagcgtgctgcagacccagcagctgaagaccgtgcaggccgtgaagagcaccgtgcagaccatcaccgtgggcggcgtgagcaccagccagttcaagaccatcatccccctggccaccgcccccaacgtgcagcagatccaggtgcccggcagcaagttccactacgtgagactggtgaccgccaccagcgccagcagcagcacccagcccgtgagccagaaccccagcaccaacacccagcccctgcagcaggccaagcccgtggtggtgaacaccacccccgtgagaatgagcgtgcccatcgtgagcgcccaggccgtgaagcaggtggtgcccaagcccatcaaccccaccagccagatcgtgaccaccagccagccccagcagagactgatcatgcccgccacccccctgccccagatccagcccaacctgaccaacctgccccccggcaccgtgctggcccccgcccccggcaccggcaacgtgggctacgccgtgctgcccgcccagtacgtgacccagctgcagcagagcagctacgtgagcatcgccagcaacagcaccttcaccggcaccagcggcatccagacccaggccagactgcccttcaacggcatcatccccagcgagagcgccagcagacccagaaagccctgcaactgcaccaagagcctgtgcctgaagctgtactgcgactgcttcgccaacggcgagttctgcaacaactgcaactgcaccaactgctacaacaacctggagcacgagaacgagagacagaaggccatcaaggcctgcctggacagaaaccccgaggccttcaagcccaagatcggcaagggcaaggagggcgagagcgacagaagacacagcaagggctgcaactgcaagagaagcggctgcctgaagaactactgcgagtgctacgaggccaagatcatgtgcagcagcatctgcaagtgcatcggctgcaagaacttcgaggagagccccgagagaaagaccctgatgcacctggccgacgccgccgaggtgagagtgcagcagcagaccgccgccaagaccaagctgagcagccagatcagcgacctgctgaccagacccacccccgccctgaacagcggcggcggcaagctgcccttcaccttcgtgaccaaggaggtggccgaggccacctgcaactgcctgctggcccaggccgagcaggccgacaagaagggcaagagcaaggccgccgccgagagaatgatcctggaggagttcggcagatgcctgatgagcgtgatcaacagcgccggcaaggccaagagcgacccctgcgccatgaactgctag

SEQ ID NO: 87198 - DNA, 1587 bp, Artificial Sequence
  Description of Artificial Sequence: Synthetic coding sequence
atggaggtggtgcccgccgagatcgccaagaagcccagaacccccaccagcggccccgtgatcaccaagctgatcttcgccaagcccatcaacagcaaggccgtgaccggccagaccacccaggtgagcccccccgtgatcgccggcagagtgctgagccagagcacccccggcacccccagcaagaccatcaccatcagcgagagcggcgtgatcggcagcaccctgaacagcaccacccagacccccaacaagatcgccatcagccccctgaagagccccaacaaggccgtgaagagcaccgtgcagaccatcaccgtgggcggcgtgagcaccagccagttcaagaccatcatccccctggccaccgcccccaacgtgcagcagatccaggtgcccggcagcaagttccactacgtgagactggtgaccgccaccagcgccagcagcagcacccagcccgtgagccagaaccccagcaccaacacccagcccctgcagcaggccaagcccgtggtggtgaacaccacccccgtgagaatgagcgtgcccatcgtgagcgcccaggccgtgaagcaggtggtgcccaagcccatcaaccccaccagccagatcgtgaccaccagccagccccagcagagactgatcatgcccgccacccccctgccccagatccagcccaacctgaccaacctgccccccggcaccgtgctggcccccgcccccggcaccggcaacgtgggctacgccgtgctgcccgcccagtacgtgacccagctgcagcagagcagctacgtgagcatcgccagcaacagcaccttcaccggcaccagcggcatccagacccaggccagactgcccttcaacggcatcatccccagcgagagcgccagcagacccagaaagccctgcaactgcaccaagagcctgtgcctgaagctgtactgcgactgcttcgccaacggcgagttctgcaacaactgcaactgcaccaactgctacaacaacctggagcacgagaacgagagacagaaggccatcaaggcctgcctggacagaaaccccgaggccttcaagcccaagatcggcaagggcaaggagggcgagagcgacagaagacacagcaagggctgcaactgcaagagaagcggctgcctgaagaactactgcgagtgctacgaggccaagatcatgtgcagcagcatctgcaagtgcatcggctgcaagaacttcgaggagagccccgagagaaagaccctgatgcacctggccgacgccgccgaggtgagagtgcagcagcagaccgccgccaagaccaagctgagcagccagatcagcgacctgctgaccagacccacccccgccctgaacagcggcggcggcaagctgcccttcaccttcgtgaccaaggaggtggccgaggccacctgcaactgcctgctggcccaggccgagcaggccgacaagaagggcaagagcaaggccgccgccgagagaatgatcctggaggagttcggcagatgcctgatgagcgtgatcaacagcgccggcaaggccaagagcgacccctgcgccatgaactgctag

SEQ ID NO: 87199 - DNA, 1587 bp, Artificial Sequence; identical to SEQ ID NO: 87198
  Description of Artificial Sequence: Synthetic coding sequence

SEQ ID NO: 87200 - DNA, 2250 bp, Artificial Sequence; identical to SEQ ID NO: 87195
  Description of Artificial Sequence: Synthetic coding sequence

SEQ ID NO: 87201 - DNA, 1587 bp, Artificial Sequence; identical to SEQ ID NO: 87198
  Description of Artificial Sequence: Synthetic coding sequence

SEQ ID NO: 87202 - DNA, 2025 bp, Artificial Sequence
  Description of Artificial Sequence: Synthetic coding sequence
atgtggcacgaggccagaaagcacgagagaaagctgagaggcatgatggtggactacaagaagagagccgagagaagaagagagtactacgagaagatcaagaaggaccccgcccagttcctgcaggtgcacggcagagcctgcaaggtgcacctggacagcgccgtggccctggccgccgagagccccgtgaacatgatgccctggcagggcgacaccaacaacatgatcgacagattcgacgtgagagcccacctggaccacatccccgactacaccccccccctgctgaccaccatcagccccgagcaggagagcgacgagagaaagtgcaactacgagagatacagaggcctggtgcagaacgacttcgccggcatcagcgaggagcagtgcctgtaccagatctacatcgacgagctgtacggcggcctgcagagacccagcgaggacgagaagaagaagctggccgagaagaaggccagcatcggctacacctacgaggacagcaccgtggccaaggtggagaaggccgccgagaagcccgaggaggaggagagcgccgccgaggaggagagcaacagcgacgaggacgaggtgatccccgacatcgacgtggaggtggacgtggacgagctgaaccaggagcaggtggccgacctgaacaagcaggccaccacctacggcatggccgacggcgacttcgtgagaatgctgagaaaggacaaggaggaggccgaggccatcaagcacgccaaggccctggaggaggagaaggccatgtacagcggcagaagaagcagaagacagagaagagagttcagagagaagagactgagaggcagaaagatcagcccccccagctacgccagaagagacagccccacctacgacccctacaagagaagccccagcgagagcagcagcgagagcagaagcagaagcagaagccccacccccggcagagaggagaagatcaccttcatcaccagcttcggcggcagcgacgaggaggccgccgccgccgccgccgccgccgccgccagcggcgtgaccaccggcaagccccccgcccccccccagcccggcggccccgcccccggcagaaacgccagcgccagaagaagaagcagcagcagcagcagcagcagcagcgccagcagaaccagcagcagcagaagcagcagcagaagcagcagcagaagcagaagaggcggcggctactacagaagcggcagacacgccagaagcagaagcagaagctggagcagaagcagaagcagaagcagaagatacagcagaagcagaagcagaggcagaagacacagcggcggcggcagcagagacggccacagatacagcagaagccccgccagaagaggcggctacggccccagaagaagaagcagaagcagaagccacagcggcgacagatacagaagaggcggcagaggcctgagacaccacagcagcagcagaagcagaagcagctggagcctgagccccagcagaagcagaagcctgaccagaagcagaagccacagccccagccccagccagagcagaagcagaagcagaagcagaagccagagccccagccccagccccgccagagagaagctgaccagacccgccgccagccccgccgtgggcgagaagctgaagaagaccgagcccgccgccggcaaggagaccggcgccgccaagcccaagctgaccccccaggagaagctgaagctgagaatgcagaaggccctgaacagacagttcaaggccgacaagaaggccgcccaggagaagatgatccagcaggagcacgagagacaggagagagaggacgagctgagagccatggccagaaagatcagaatgaaggagagagagagaagagagaaggagagagaggagtgggagagacagtacagcagacagagcagaagccccagccccagatacagcagagagtacagcagcagcagaagaagaagcagaagcagaagcagaagcccccactacagacactag

SEQ ID NO: 87203 - DNA, 594 bp, Artificial Sequence
  Description of Artificial Sequence: Synthetic coding sequence
atggccgccctgggcgagcccgtgagactggagagagacatctgcagagccatcgagctgctggagaagctgcagagaagcggcgaggtgcccccccagaagctgcaggccctgcagagagtgctgcagagcgagttctgcaacgccgtgagagaggtgtacgagcacgtgtacgagaccgtggacatcagcagcagccccgaggtgagagccaacgccaccgccaaggccaccgtggccgccttcgccgccagcgagggccacagccaccccagagtggtggagctgcccaagaccgaggagggcctgggcttcaacatcatgggcggcaaggagcagaacagccccatctacatcagcagaatcatccccggcggcatcgccgacagacacggcggcctgaagagaggcgaccagctgctgagcgtgaacggcgtgagcgtggagggcgagcaccacgagaaggccgtggagctgctgaaggccgcccagggcaaggtgaagctggtggtgagatacacccccaaggtgctggaggagatggagagcagattcgagaagatgagaagcgccaagagaagacagcagacctag

SEQ ID NO: 87204 - DNA, 759 bp, Artificial Sequence
  Description of Artificial Sequence: Synthetic coding sequence
atggaggaggccatcctggtgccctgcgtgctgggcctgctgctgctgcccatcctggccatgctgatggccctgtgcgtgcactgccacagactgcccggcagctacgacagcaccagcagcgacagcctgtaccccagaggcatccagttcaagagaccccacaccgtggccccctggccccccgcctacccccccgtgaccagctacccccccctgagccagcccgacctgctgcccatccccagaagcccccagcccagaagagacagcgacggcgccaacagcgtggccagctacgagaacgagggcgccagcggcatcagaggcgcccaggccggctggggcgtgtggggccccagctggaccagactgacccccgtgagcctgccccccgagcccgcctgcgaggacgccgacgaggacgaggacgactaccacaaccccggctacctggtggtgctgcccgacagcacccccgccaccagcaccgccgcccccagcgcccccgccctgagcacccccggcatcagagacagcgccttcagcatggagagcatcgacgactacgtgaacgtgcccgagagcggcgagagcgccgaggccagcctggacggcagcagagagtacgtgaacgtgagccaggagctgcaccccggcgccgccaagaccgagcccgccgccctgagcagccaggaggccgaggaggtggaggaggagggcgcccccgactacgagaacctgcaggagctgaactag

SEQ ID NO: 87205 - DNA, 789 bp, Artificial Sequence
  Description of Artificial Sequence: Synthetic coding sequence
atggaggaggccatcctggtgccctgcgtgctgggcctgctgctgctgcccatcctggccatgctgatggccctgtgcgtgcactgccacagactgcccggcagctacgacagcaccagcagcgacagcctgtaccccagaggcatccagttcaagagaccccacaccgtggccccctggccccccgcctacccccccgtgaccagctacccccccctgagccagcccgacctgctgcccatccccagaagcccccagcccctgggcggcagccacagaacccccagcagcagaagagacagcgacggcgccaacagcgtggccagctacgagaacgagggcgccagcggcatcagaggcgcccaggccggctggggcgtgtggggccccagctggaccagactgacccccgtgagcctgccccccgagcccgcctgcgaggacgccgacgaggacgaggacgactaccacaaccccggctacctggtggtgctgcccgacagcacccccgccaccagcaccgccgcccccagcgcccccgccctgagcacccccggcatcagagacagcgccttcagcatggagagcatcgacgactacgtgaacgtgcccgagagcggcgagagcgccgaggccagcctggacggcagcagagagtacgtgaacgtgagccaggagctgcaccccggcgccgccaagaccgagcccgccgccctgagcagccaggaggccgaggaggtggaggaggagggcgcccccgactacgagaacctgcaggagctgaactag

SEQ ID NO: 87206 - DNA, 702 bp, Artificial Sequence
  Description of Artificial Sequence: Synthetic coding sequence
atggaggaggccatcctggtgccctgcgtgctgggcctgctgctgctgcccatcctggccatgctgatggccctgtgcgtgcactgccacagactgcccggcagctacgacagcaccagcagcgacagcctgtaccccagaggcatccagttcaagagaccccacaccgtggccccctggccccccgcctacccccccgtgaccagctacccccccctgagccagcccgacctgctgcccatccccagaagcccccagcccctgggcggcagccacagaacccccagcagcagaagagacagcgacggcgccaacagcgtggccagctacgagaacgaggagcccgcctgcgaggacgccgacgaggacgaggacgactaccacaaccccggctacctggtggtgctgcccgacagcacccccgccaccagcaccgccgcccccagcgcccccgccctgagcacccccggcatcagagacagcgccttcagcatggagagcatcgacgactacgtgaacgtgcccgagagcggcgagagcgccgaggccagcctggacggcagcagagagtacgtgaacgtgagccaggagctgcaccccggcgccgccaagaccgagcccgccgccctgagcagccaggaggccgaggaggtggaggaggagggcgcccccgactacgagaacctgcaggagctgaactag

SEQ ID NO: 87207 - DNA, 810 bp, Artificial Sequence
  Description of Artificial Sequence: Synthetic coding sequence
atggaggccaccgccgccagctggcaggtggccgtgcccgtgctgggcggcgccagcagacccctgggccccagaggcgccgccagcctgctgagagcccccctgcagatggaggaggccatcctggtgccctgcgtgctgggcctgctgctgctgcccatcctggccatgctgatggccctgtgcgtgcactgccacagactgcccggcagctacgacagcaccagcagcgacagcctgtaccccagaggcatccagttcaagagaccccacaccgtggccccctggccccccgcctacccccccgtgaccagctacccccccctgagccagcccgacctgctgcccatccccagaagcccccagcccctgggcggcagccacagaacccccagcagcagaagagacagcgacggcgccaacagcgtggccagctacgagaacgaggagcccgcctgcgaggacgccgacgaggacgaggacgactaccacaaccccggctacctggtggtgctgcccgacagcacccccgccaccagcaccgccgcccccagcgcccccgccctgagcacccccggcatcagagacagcgccttcagcatggagagcatcgacgactacgtgaacgtgcccgagagcggcgagagcgccgaggccagcctggacggcagcagagagtacgtgaacgtgagccaggagctgcaccccggcgccgccaagaccgagcccgccgccctgagcagccaggaggccgaggaggtggaggaggagggcgcccccgactacgagaacctgcaggagctgaactag

SEQ ID NO: 87208 - DNA, 699 bp, Artificial Sequence
  Description of Artificial Sequence: Synthetic coding sequence
atggaggaggccatcctggtgccctgcgtgctgggcctgctgctgctgcccatcctggccatgctgatggccctgtgcgtgcactgccacagactgcccggcagctacgacagcaccagcagcgacagcctgtaccccagaggcatccagttcaagagaccccacaccgtggccccctggccccccgcctacccccccgtgaccagctacccccccctgagccagcccgacctgctgcccatccccagcccccagcccctgggcggcagccacagaacccccagcagcagaagagacagcgacggcgccaacagcgtggccagctacgagaacgaggagcccgcctgcgaggacgccgacgaggacgaggacgactaccacaaccccggctacctggtggtgctgcccgacagcacccccgccaccagcaccgccgcccccagcgcccccgccctgagcacccccggcatcagagacagcgccttcagcatggagagcatcgacgactacgtgaacgtgcccgagagcggcgagagcgccgaggccagcctggacggcagcagagagtacgtgaacgtgagccaggagctgcaccccggcgccgccaagaccgagcccgccgccctgagcagccaggaggccgaggaggtggaggaggagggcgcccccgactacgagaacctgcaggagctgaactag

SEQ ID NO: 87209 - DNA, 732 bp, Artificial Sequence
  Description of Artificial Sequence: Synthetic coding sequence
atgagcagcggcaccgagctgctgtggcccggcgccgccctgctggtgctgctgggcgtggccgccagcctgtgcgtgagatgcagcagacccggcgccaagagaagcgagaagatctaccagcagagaagcctgagagaggaccagcagagcttcaccggcagcagaacctacagcctggtgggccaggcctggcccggccccctggccgacatggcccccaccagaaaggacaagctgctgcagttctaccccagcctggaggaccccgccagcagcagataccagaacttcagcaagggcagcagacacggcagcgaggaggcctacatcgaccccatcgccatggagtactacaactggggcagattcagcaagccccccgaggacgacgacgccaacagctacgagaacgtgctgatctgcaagcagaagaccaccgagaccggcgcccagcaggagggcatcggcggcctgtgcagaggcgacctgagcctgagcctggccctgaagaccggccccaccagcggcctgtgccccagcgccagccccgaggaggacgaggagagcgaggactaccagaacagcgccagcatccaccagtggagagagagcagaaaggtgatgggccagctgcagagagaggccagccccggccccgtgggcagccccgacgaggaggacggcgagcccgactacgtgaacggcgaggtggccgccaccgaggcctag

SEQ ID NO: 87210 - DNA, 732 bp, Artificial Sequence; identical to SEQ ID NO: 87209
  Description of Artificial Sequence: Synthetic coding sequence

SEQ ID NO: 87211 - DNA, 195 bp, Artificial Sequence
  Description of Artificial Sequence: Synthetic coding sequence
atgagcagcggcaccgagctgctgtggcccggcgccgccctgctggtgctgctgggcgtggccgccagcctgtgcgtgagatgcagcagacccggcgccaagagaagcgagaagatctaccagcagagaagcctgagagaggaccagcagagcttcaccggcagcagaacctacagcctggtgggccaggcctag

SEQ ID NO: 87212 - DNA, 732 bp, Artificial Sequence; identical to SEQ ID NO: 87209
  Description of Artificial Sequence: Synthetic coding sequence

SEQ ID NO: 87213 - DNA, 732 bp, Artificial Sequence; identical to SEQ ID NO: 87209
  Description of Artificial Sequence: Synthetic coding sequence

SEQ ID NO: 87214 - DNA, 177 bp, Artificial Sequence
  Description of Artificial Sequence: Synthetic coding sequence
atgagcagcggcaccgagctgctgtggcccggcgccgccctgctggtgctgctgggcgtggccgccagcctgtgcgtgagatgcagcagacccggcgccaagagaagcgagaagatctaccagcagagaagcctgagagaggaccagcagagcttcaccggcagcagaacctactag

SEQ ID NO: 87215 - DNA, 303 bp, Artificial Sequence
  Description of Artificial Sequence: Synthetic coding sequence
atgagcagcggcaccgagctgctgtggcccggcgccgccctgctggtgctgctgggcgtggccgccagcctgtgcgtgagatgcagcagacccggcgccaagagaagcgagaagatctaccagcagagaagcctgagagaggaccagcagagcttcaccggcagcagaacctacagcctggtgggccaggcctggcccggccccctggccgacatggcccccaccagaaaggacaagctgctgcagttctaccccagcctggaggaccccgccagcagcagataccagaacttcagcaagtag

SEQ ID NO: 87216 - DNA, 1704 bp, Artificial Sequence
  Description of Artificial Sequence: Synthetic coding sequence
atgagacccgacagccccaccatggccgcccccgccgagagcctgagaagaagaaagaccggctacagcgaccccgagcccgagagcccccccgcccccggcagaggccccgccggcagccccgcccacctgcacaccggcaccttctggctgaccagaatcgtgctgctgaaggccctggccttcgtgtacttcgtggccttcctggtggccttccaccagaacaagcagctgatcggcgacagaggcctgctgccctgcagagtgttcctgaagaacttccagcagtacttccaggacagaaccagctgggaggtgttcagctacatgcccaccatcctgtggctgatggactggagcgacatgaacagcaacctggacctgctggccctgctgggcctgggcatcagcagcttcgtgctgatcaccggctgcgccaacatgctgctgatggccgccctgtggggcctgtacatgagcctggtgaacgtgggccacgtgtggtacagcttcggctgggagagccagctgctggagaccggcttcctgggcatcttcctgtgccccctgtggaccctgagcagactgccccagcacacccccaccagcagaatcgtgctgtggggcttcagatggctgatcttcagaatcatgctgggcgccggcctgatcaagatcagaggcgacagatgctggagagacctgacctgcatggacttccactacgagacccagcccatgcccaaccccgtggcctactacctgcaccacagcccctggtggttccacagattcgagaccctgagcaaccacttcatcgagctgctggtgcccttcttcctgttcctgggcagaagagcctgcatcatccacggcgtgctgcagatcctgttccaggccgtgctgatcgtgagcggcaacctgagcttcctgaactggctgaccatggtgcccagcctggcctgcttcgacgacgccaccctgggcttcctgttccccagcggccccggcagcctgaaggacagagtgctgcagatgcagagagacatcagaggcgccagacccgagcccagattcggcagcgtggtgagaagagccgccaacgtgagcctgggcgtgctgctggcctggctgagcgtgcccgtggtgctgaacctgctgagcagcagacaggtgatgaacacccacttcaacagcctgcacatcgtgaacacctacggcgccttcggcagcatcaccaaggagagagccgaggtgatcctgcagggcaccgccagcagcaacgccagcgcccccgacgccatgtgggaggactacgagttcaagtgcaagcccggcgaccccagcagaagaccctgcctgatcagcccctaccactacagactggactggctgatgtggttcgccgccttccagacctacgagcacaacgactggatcatccacctggccggcaagctgctggccagcgacgccgaggccctgagcctgctggcccacaaccccttcgccggcagacccccccccagatgggtgagaggcgagcactacagatacaagttcagcagacccggcggcagacacgccgccgagggcaagtggtgggtgagaaagagaatcggcgcctacttcccccccctgagcctggaggagctgagaccctacttcagagacagaggctggcccctgcccggccccctgtag

SEQ ID NO: 87217 - DNA, 1704 bp, Artificial Sequence
  Description of Artificial Sequence: Synthetic coding sequence
atgagacccgacagccccaccatggccgcccccgccgagagcctgagaagaagaaagaccggctacagcgaccccgagcccgagagcccccccgcccccggcagaggccccgccggcagccccgcccacctgcacaccggcaccttctggctgaccagaatcgtgctgctgaaggccctggccttcgtgtacttcgtggccttcctggtggccttccaccagaacaagcagctgatcggcgacagaggcctgctgccctgcagagtgttcctgaagaacttccagcagtacttccaggacagaaccagctgggaggtgttcagctacatgcccaccatcctgtggctgatggactggagcgacatgaacagcaacctggacctgctggccctgctgggcctgggcatcagcagcttcgtgctgatcaccggctgcgccaacatgctgctgatggccgccctgtggggcctgtacatgagcctggtgaacgtgggccacgtgtggtacagcttcagatgggagagccagctgctggagaccggcttcctgggcatcttcctgtgccccctgtggaccctgagcagactgccccagcacacccccaccagcagaatcgtgctgtggggcttcagatggctgatcttcagaatcatgctgggcgccggcctgatcaagatcagaggcgacagatgctggagagacctgacctgcatggacttccactacgagacccagcccatgcccaaccccgtggcctactacctgcaccacagcccctggtggttccacagattcgagaccctgagcaaccacttcatcgagctgctggtgcccttcttcctgttcctgggcagaagagcctgcatcatccacggcgtgctgcagatcctgttccaggccgtgctgatcgtgagcggcaacctgagcttcctgaactggctgaccatggtgcccagcctggcctgcttcgacgacgccaccctgggcttcctgttccccagcggccccggcagcctgaaggacagagtgctgcagatgcagagagacatcagaggcgccagacccgagcccagattcggcagcgtggtgagaagagccgccaacgtgagcctgggcgtgctgctggcctggctgagcgtgcccgtggtgctgaacctgctgagcagcagacaggtgatgaacacccacttcaacagcctgcacatcgtgaacacctacggcgccttcggcagcatcaccaaggagagagccgaggtgatcctgcagggcaccgccagcagcaacgccagcgcccccgacgccatgtgggaggactacgagttcaagtgcaagcccggcgaccccagcagaagaccctgcctgatcagcccctaccactacagactggactggctgatgtggttcgccgccttccagacctacgagcacaacgactggatcatccacctggccggcaagctgctggccagcgacgccgaggccctgagcctgctggcccacaaccccttcgccggcagacccccccccagatgggtgagaggcgagcactacagatacaagttcagcagacccggcggcagacacgccgccgagggcaagtggtgggtgagaaagagaatcggcgcctacttcccccccctgagcctggaggagctgagaccctacttcagagacagaggctggcccctgcccggccccctgtag

SEQ ID NO: 87218 - DNA, 558 bp, Artificial Sequence
  Description of Artificial Sequence: Synthetic coding sequence
atgagacccgacagccccaccatggccgcccccgccgagagcctgagaagaagaaagaccggctacagcgaccccgagcccgagagcccccccgcccccggcagaggccccgccggcagccccgcccacctgcacaccggcaccttctggctgaccagaatcgtgctgctgaaggccctggccttcgtgtacttcgtggccttcctggtggccttccaccagaacaagcagctgatcggcgacagaggcctgctgccctgcagagtgttcctgaagaacttccagcagtacttccaggacagaaccagctgggaggtgttcagctacatgcccaccatcctgtggctgatggactggagcgacatgaacagcaacctggacctgctggccctgctgggcctgggcatcagcagcttcgtgctgatcaccggctgcgccaacatgctgctgatggccgccctgtggggcctgtacatgagcctggtgaacgtgggccacgtgtggtgccccagcctggccagcgccatcagcctgcccagcatgcacggcggccagtag

SEQ ID NO: 87219 - DNA, 501 bp, Artificial Sequence
  Description of Artificial Sequence: Synthetic coding sequence
atggccgcccccgccgagagcctgagaagaagaaagaccggctacagcgaccccgagcccgagagcccccccgcccccggcagaggccccgccggcagccccgcccacctgcacaccggcaccttctggctgaccagaatcgtgctgctgaaggccctggccttcgtgtacttcgtggccttcctggtggccttccaccagaacaagcagctgatcggcgacagaggcctgctgccctgcagagtgttcctgaagaacttccagcagtacttccaggacagaaccagctgggaggtgttcagctacatgcccaccatcctgtggctgatggactggagcgacatgaacagcaacctggacctgctggccctgctgggcctgggcatcagcagcttcgtgctgatcaccggctgcgccaacatgctgctgatggccgccctgtggggcctgtacatgagcctggtgaacgtgggccacgtgtggtacagcttcggcaagtag

SEQ ID NO: 87220 - DNA, 1053 bp, Artificial Sequence
  Description of Artificial Sequence: Synthetic coding sequence
atgagaggcgccggcctgatcaagatcagaggcgacagatgctggagagacctgacctgcatggacttccactacgagacccagcccatgcccaaccccgtggcctactacctgcaccacagcccctggtggttccacagattcgagaccctgagcaaccacttcatcgagctgctggtgcccttcttcctgttcctgggcagaagagcctgcatcatccacggcgtgctgcagatcctgttccaggccgtgctgatcgtgagcggcaacctgagcttcctgaactggctgaccatggtgcccagcctggcctgcttcgacgacgccaccctgggcttcctgttccccagcggccccggcagcctgaaggacagagtgctgcagatgcagagagacatcagaggcgccagacccgagcccagattcggcagcgtggtgagaagagccgccaacgtgagcctgggcgtgctgctggcctggctgagcgtgcccgtggtgctgaacctgctgagcagcagacaggtgatgaacacccacttcaacagcctgcacatcgtgaacacctacggcgccttcggcagcatcaccaaggagagagccgaggtgatcctgcagggcaccgccagcagcaacgccagcgcccccgacgccatgtgggaggactacgagttcaagtgcaagcccggcgaccccagcagaagaccctgcctgatcagcccctaccactacagactggactggctgatgtggttcgccgccttccagacctacgagcacaacgactggatcatccacctggccggcaagctgctggccagcgacgccgaggccctgagcctgctggcccacaaccccttcgccggcagacccccccccagatgggtgagaggcgagcactacagatacaagttcagcagacccggcggcagacacgccgccgagggcaagtggtgggtgagaaagagaatcggcgcctacttcccccccctgagcctggaggagctgagaccctacttcagagacagaggctggcccctgcccggccccctgtag

SEQ ID NO: 87221 - DNA, 993 bp, Artificial Sequence
  Description of Artificial Sequence: Synthetic coding sequence
atggacttccactacgagacccagcccatgcccaaccccgtggcctactacctgcaccacagcccctggtggttccacagattcgagaccctgagcaaccacttcatcgagctgctggtgcccttcttcctgttcctgggcagaagagcctgcatcatccacggcgtgctgcagatcctgttccaggccgtgctgatcgtgagcggcaacctgagcttcctgaactggctgaccatggtgcccagcctggcctgcttcgacgacgccaccctgggcttcctgttccccagcggccccggcagcctgaaggacagagtgctgcagatgcagagagacatcagaggcgccagacccgagcccagattcggcagcgtggtgagaagagccgccaacgtgagcctgggcgtgctgctggcctggctgagcgtgcccgtggtgctgaacctgctgagcagcagacaggtgatgaacacccacttcaacagcctgcacatcgtgaacacctacggcgccttcggcagcatcaccaaggagagagccgaggtgatcctgcagggcaccgccagcagcaacgccagcgcccccgacgccatgtgggaggactacgagttcaagtgcaagcccggcgaccccagcagaagaccctgcctgatcagcccctaccactacagactggactggctgatgtggttcgccgccttccagacctacgagcacaacgactggatcatccacctggccggcaagctgctggccagcgacgccgaggccctgagcctgctggcccacaaccccttcgccggcagacccccccccagatgggtgagaggcgagcactacagatacaagttcagcagacccggcggcagacacgccgccgagggcaagtggtgggtgagaaagagaatcggcgcctacttcccccccctgagcctggaggagctgagaccctacttcagagacagaggctggcccctgcccggccccctgtag

SEQ ID NO: 87222 - DNA, 792 bp, Artificial Sequence
  Description of Artificial Sequence: Synthetic coding sequence
atgcccaaccccgtggcctactacctgcaccacagcccctggtggttccacagattcgagaccctgagcaaccacttcatcgagctgctggtgcccttcttcctgttcctgggcagaagagcctgcatcatccacggcgtgctgcagatcctgttccaggccgtgctgatcgtgagcggcaacctgagcttcctgaactggctgaccatggtgcccagcctggcctgcttcgacgacgccaccctgggcttcctgttccccagcggccccggcagcctgaaggacagagtgctgcagatgcagagagacatcagaggcgccagacccgagcccagattcggcagcgtggtgagaagagccgccaacgtgagcctgggcgtgctgctggcctggctgagcgtgcccgtggtgctgaacctgctgagcagcagacaggtgatgaacacccacttcaacagcctgcacatcgtgaacacctacggcgccttcggcagcatcaccaaggagagagccgaggtgatcctgcagggcaccgccagcagcaacgccagcgcccccgacgccatgtgggaggactacgagttcaagtgcaagcccggcgaccccagcagaagaccctgcctgatcagcccctaccactacagactggactggctgatgtggttcgccgccttccagacctacgagcacaacgactggatcatccacctggccggcaagctgctggccagcgacgccgaggccctgagcctgctggcccacaaccccttcgccggcagaccccccccctag

SEQ ID NO: 87223 - DNA, 1503 bp, Artificial Sequence
  Description of Artificial Sequence: Synthetic coding sequence
atgagcaacagcgtgcccctgctgtgcttctggagcctgtgctactgcttcgccgccggcagccccgtgcccttcggccccgagggcagactggaggacaagctgcacaagcccaaggccacccagaccgaggtgaagcccagcgtgagattcaacctgagaaccagcaaggaccccgagcacgagggctgctacctgagcgtgggccacagccagcccctggaggactgcagcttcaacatgaccgccaagaccttcttcatcatccacggctggaccatgagcggcatcttcgagaactggctgcacaagctggtgagcgccctgcacaccagagagaaggacgccaacgtggtggtggtggactggctgcccctggcccaccagctgtacaccgacgccgtgaacaacaccagagtggtgggccacagcatcgccagaatgctggactggctgcaggagaaggacgacttcagcctgggcaacgtgcacctgatcggctacagcctgggcgcccacgtggccggctacgccggcaacttcgtgaagggcaccgtgggcagaatcaccggcctggaccccgccggccccatgttcgagggcgccgacatccacaagagactgagccccgacgacgccgacttcgtggacgtgctgcacacctacaccagaagcttcggcctgagcatcggcatccagatgcccgtgggccacatcgacatctaccccaacggcggcgacttccagcccggctgcggcctgaacgacgtgctgggcagcatcgcctacggcaccatcaccgaggtggtgaagtgcgagcacgagagagccgtgcacctgttcgtggacagcctggtgaaccaggacaagcccagcttcgccttccagtgcaccgacagcaacagattcaagaagggcatctgcctgagctgcagaaagaacagatgcaacagcatcggctacaacgccaagaagatgagaaacaagagaaacagcaagatgtacctgaagaccagagccggcatgcccttcagagtgtaccactaccagatgaagatccacgtgttcagctacaagaacatgggcgagatcgagcccaccttctacgtgaccctgtacggcaccaacgccgacagccagaccctgcccctggagatcgtggagagaatcgagcagaacgccaccaacaccttcctggtgtacaccgaggaggacctgggcgacctgctgaagatccagctgacctgggagggcgccagccagagctggtacaacctgtggaaggagttcagaagctacctgagccagcccagaaaccccggcagagagctgaacatcagaagaatcagagtgaagagcggcgagacccagagaaagctgaccttctgcaccgaggaccccgagaacaccagcatcagccccggcagagagctgtggttcagaaagtgcagagacggctggagaatgaagaacgagaccagccccaccgtggagctgccctag

SEQ ID NO: 87224 - DNA, 1281 bp, Artificial Sequence
  Description of Artificial Sequence: Synthetic coding sequence
atgagcaacagcgtgcccctgctgtgcttctggagcctgtgctactgcttcgccgccggcagccccgtgcccttcggccccgagggcagactggaggacaagctgcacaagcccaaggccacccagaccgaggtgaagcccagcgtgagattcaacctgagaaccagcaaggaccccgagcacgagggctgctacctgagcgtgggccacagccagcccctggaggactgcagcttcaacatgaccgccaagaccttcttcatcatccacggctggaccatgagcggcatcttcgagaactggctgcacaagctggtgagcgccctgcacaccagagagaaggacgccaacgtggtggtggtggactggctgcccctggcccaccagctgtacaccgacgccgtgaacaacaccagagtggtgggccacagcatcgccagaatgctggactggctgcaggagaaggacgacttcagcctgggcaacgtgcacctgatcggctacagcctgggcgcccacgtggccggctacgccggcaacttcgtgaagggcaccgtgggcagaatcaccgccatcaccgaggtggtgaagtgcgagcacgagagagccgtgcacctgttcgtggacagcctggtgaaccaggacaagcccagcttcgccttccagtgcaccgacagcaacagattcaagaagggcatctgcctgagctgcagaaagaacagatgcaacagcatcggctacaacgccaagaagatgagaaacaagagaaacagcaagatgtacctgaagaccagagccggcatgcccttcagagtgtaccactaccagatgaagatccacgtgttcagctacaagaacatgggcgagatcgagcccaccttctacgtgaccctgtacggcaccaacgccgacagccagaccctgcccctggagatcgtggagagaatcgagcagaacgccaccaacaccttcctggtgtacaccgaggaggacctgggcgacctgctgaagatccagctgacctgggagggcgccagccagagctggtacaacctgtggaaggagttcagaagctacctgagccagcccagaaaccccggcagagagctgaacatcagaagaatcagagtgaagagcggcgagacccagagaaagctgaccttctgcaccgaggaccccgagaacaccagcatcagccccggcagagagctgtggttcagaaagtgcagagacggctggagaatgaagaacgagaccagccccaccgtggagctgccctag

SEQ ID NO: 87225 - DNA, 1101 bp, Artificial Sequence
  Description of Artificial Sequence: Synthetic coding sequence
atgaacatcagccagatcatcagctactggggctaccccgacgaggagtacgacatcgtgaccgaggacggctacatcctgggcctgtacagaatcccctactggagaaccgacaacaacaagaacctggcccagagagtggtggtgtacctgcagcacggcctgctgaccagcgccagcagctggatcagcaacctgcccaacaacagcctgggcttcatcctggccgacgccggctacgacgtgtggatgggcaacagcagaggcaacacctggagcagaaagcacctgtacctggagaccagcagcaaggagttctgggccttcagcttcgacgagatggccaagtacgacctgcccgccagcatcgacttcaccgtgaagcagaccagacaggaggagatcttctacgtgggccacagccagggcaccaccatcggcttcatcaccttcagcaccatcagcaagatcgccgagagaatcaagatcttcttcgccctggcccccgtgttcagcaccaagtacctgaagagccccctgatcagaatgacctacaagtggaagagcatcgtgatggccttcagcggcaacaaggacttcctgcccaagaccagcttcaagaagttcatcggcagcaagctgtgccccctgcagatcttcgacaagatctgcctgaacatcctgttcatgatgttcggctacgaccccaagaacctgaacatgagcagactggacgtgtacttcagccacaaccccgccggcaccagcgtgcagaacatgctgcactggagccagctgctgaacagcacccacctgaaggcctacgactggggcagccccgacctgaacctggtgcactacaaccagaccaccagccccctgtacaacatgaccaacatgaacgtggccaccgccatctggaacggcaagagcgacctgctggccgaccccgaggacgtgaacatcctgcacagcgagatcaccaaccacatctactacaagaccatcagctactacaaccacatcgacagcctgttcggcctggacgtgtacgaccaggtgtaccacgagatcatcgacatcatccaggacaacctgtag

SEQ ID NO: 87226 - DNA, 1200 bp, Artificial Sequence
  Description of Artificial Sequence: Synthetic coding sequence
atgtggcagctgctggccgccgcctgctggatgctgctgctgggcagcatgtacggctacgacaagaagggcaacaacgccaaccccgaggccaacatgaacatcagccagatcatcagctactggggctacccctacgaggagtacgacgtgaccaccaaggacggctacatcctgggcatctacagaatcccccacggcagaggctgccccggcagaaccgcccccaagcccgccgtgtacctgcagcacggcctgatcgccagcgccagcaactggatctgcaacctgcccaacaacagcctggccttcctgctggccgacagcggctacgacgtgtggctgggcaacagcagaggcaacacctggagcagaaagcacctgaagctgagccccaagagccccgagtactgggccttcagcctggacgagatggccaagtacgacctgcccgccaccatcaacttcatcatcgagaagaccggccagaagagactgtactacgtgggccacagccagggcaccaccatcgccttcatcgccttcagcaccaaccccgagctggccaagaagatcaagatcttcttcgccctggcccccgtggtgaccgtgaagtacacccagagccccatgaagaagctgaccaccctgagcagaagagtggtgaaggtgctgttcggcgacaagatgttccacccccacaccctgttcgaccagttcatcgccaccaaggtgtgcaacagaaagctgttcagaagaatctgcagcaacttcctgttcaccctgagcggcttcgacccccagaacctgaacatgagcagactggacgtgtacctgagccacaaccccgccggcaccagcgtgcagaacatgctgcactgggcccaggccgtgaacagcggccagctgcaggccttcgactggggcaacagcgaccagaacatgatgcacttccaccagctgaccccccccctgtacaacatcaccaagatggaggtgcccaccgccatctggaacggcggccaggacatcgtggccgaccccaaggacgtggagaacctgctgccccagatcgccaacctgatctactacaagctgatcccccactacaaccacgtggacttctacctgggcgaggacgccccccaggagatctaccaggacctgatcatcctgatggaggagtacctgcagaactag

SEQ ID NO: 87227 - DNA, 1272 bp, Artificial Sequence
  Description of Artificial Sequence: Synthetic coding sequence
atgctggagaccctgagcagacagtggatcgtgagccacagaatggagatgtggctgctgatcctggtggcctacatgttccagagaaacgtgaacagcgtgcacatgcccaccaaggccgtggaccccgaggccttcatgaacatcagcgagatcatccagcaccagggctacccctgcgaggagtacgaggtggccaccgaggacggctacatcctgagcgtgaacagaatccccagaggcctggtgcagcccaagaagaccggcagcagacccgtggtgctgctgcagcacggcctggtgggcggcgccagcaactggatcagcaacctgcccaacaacagcctgggcttcatcctggccgacgccggcttcgacgtgtggatgggcaacagcagaggcaacgcctggagcagaaagcacaagaccctgagcatcgaccaggacgagttctgggccttcagctacgacgagatggccagattcgacctgcccgccgtgatcaacttcatcctgcagaagaccggccaggagaagatctactacgtgggctacagccagggcaccaccatgggcttcatcgccttcagcaccatgcccgagctggcccagaagatcaagatgtacttcgccctggcccccatcgccaccgtgaagcacgccaagagccccggcaccaagttcctgctgctgcccgacatgatgatcaagggcctgttcggcaagaaggagttcctgtaccagaccagattcctgagacagctggtgatctacctgtgcggccaggtgatcctggaccagatctgcagcaacatcatgctgctgctgggcggcttcaacaccaacaacatgaacatgagcagagccagcgtgtacgccgcccacaccctggccggcaccagcgtgcagaacatcctgcactggagccaggccgtgaacagcggcgagctgagagccttcgactggggcagcgagaccaagaacctggagaagtgcaaccagcccacccccgtgagatacagagtgagagacatgaccgtgcccaccgccatgtggaccggcggccaggactggctgagcaaccccgaggacgtgaagatgctgctgagcgaggtgaccaacctgatctaccacaagaacatccccgagtgggcccacgtggacttcatctggggcctggacgccccccacagaatgtacaacgagatcatccacctgatgcagcaggaggagaccaacctgagccagggcagatgcgaggccgtgctgtag

SEQ ID NO: 87228 - DNA, 1152 bp, Artificial Sequence
  Description of Artificial Sequence: Synthetic coding sequence
atgaccagacccctggacagaaagcagagcgagatcatccagcaccagggctacccctgcgaggagtacgaggtggccaccgaggacggctacatcctgagcgtgaacagaatccccagaggcctggtgcagcccaagaagaccggcagcagacccgtggtgctgctgcagcacggcctggtgggcggcgccagcaactggatcagcaacctgcccaacaacagcctgggcttcatcctggccgacgccggcttcgacgtgtggatgggcaacagcagaggcaacgcctggagcagaaagcacaagaccctgagcatcgaccaggacgagttctgggccttcagctacgacgagatggccagattcgacctgcccgccgtgatcaacttcatcctgcagaagaccggccaggagaagatctactacgtgggctacagccagggcaccaccatgggcttcatcgccttcagcaccatgcccgagctggcccagaagatcaagatgtacttcgccctggcccccatcgccaccgtgaagcacgccaagagccccggcaccaagttcctgctgctgcccgacatgatgatcaagggcctgttcggcaagaaggagttcctgtaccagaccagattcctgagacagctggtgatctacctgtgcggccaggtgatcctggaccagatctgcagcaacatcatgctgctgctgggcggcttcaacaccaacaacatgaacatgagcagagccagcgtgtacgccgcccacaccctggccggcaccagcgtgcagaacatcctgcactggagccaggccgtgaacagcggcgagctgagagccttcgactggggcagcgagaccaagaacctggagaagtgcaaccagcccacccccgtgagatacagagtgagagacatgaccgtgcccaccgccatgtggaccggcggccaggactggctgagcaaccccgaggacgtgaagatgctgctgagcgaggtgaccaacctgatctaccacaagaacatccccgagtgggcccacgtggacttcatctggggcctggacgccccccacagaatgtacaacgagatcatccacctgatgcagcaggaggagaccaacctgagccagggcagatgcgaggccgtgctgtag

SEQ ID NO: 87229 - DNA, 1197 bp, Artificial Sequence
  Description of Artificial Sequence: Synthetic coding sequence
atgatgtggctgctgctgaccaccacctgcctgatctgcggcaccctgaacgccggcggcttcctggacctggagaacgaggtgaaccccgaggtgtggatgaacaccagcgagatcatcatctacaacggctaccccagcgaggagtacgaggtgaccaccgaggacggctacatcctgctggtgaacagaatcccctacggcagaacccacgccagaagcaccggccccagacccgtggtgtacatgcagcacgccctgttcgccgacaacgcctactggctggagaactacgccaacggcagcctgggcttcctgctggccgacgccggctacgacgtgtggatgggcaacagcagaggcaacacctggagcagaagacacaagaccctgagcgagaccgacgagaagttctgggccttcagcttcgacgagatggccaagtacgacctgcccggcgtgatcgacttcatcgtgaacaagaccggccaggagaagctgtacttcatcggccacagcctgggcaccaccatcggcttcgtggccttcagcaccatgcccgagctggcccagagaatcaagatgaacttcgccctgggccccaccatcagcttcaagtaccccaccggcatcttcaccagattcttcctgctgcccaacagcatcatcaaggccgtgttcggcaccaagggcttcttcctggaggacaagaagaccaagatcgccagcaccaagatctgcaacaacaagatcctgtggctgatctgcagcgagttcatgagcctgtgggccggcagcaacaagaagaacatgaaccagagcagaatggacgtgtacatgagccacgcccccaccggcagcagcgtgcacaacatcctgcacatcaagcagctgtaccacagcgacgagttcagagcctacgactggggcaacgacgccgacaacatgaagcactacaaccagagccacccccccatctacgacctgaccgccatgaaggtgcccaccgccatctgggccggcggccacgacgtgctggtgaccccccaggacgtggccagaatcctgccccagatcaagagcctgcactacttcaagctgctgcccgactggaaccacttcgacttcgtgtggggcctggacgccccccagagaatgtacagcgagatcatcgccctgatgaaggcctacagctag

SEQ ID NO: 87230 - DNA, 1500 bp, Artificial Sequence
  Description of Artificial Sequence: Synthetic coding sequence
atggacaccagccccctgtgcttcagcatcctgctggtgctgtgcatcttcatccagagcagcgccctgggccagagcctgaagcccgagcccttcggcagaagagcccaggccgtggagaccaacaagaccctgcacgagatgaagaccagattcctgctgttcggcgagaccaaccagggctgccagatcagaatcaaccaccccgacaccctgcaggagtgcggcttcaacagcagcctgcccctggtgatgatcatccacggctggagcgtggacggcgtgctggagaactggatctggcagatggtggccgccctgaagagccagcccgcccagcccgtgaacgtgggcctggtggactggatcaccctggcccacgaccactacaccatcgccgtgagaaacaccagactggtgggcaaggaggtggccgccctgctgagatggctggaggagagcgtgcagctgagcagaagccacgtgcacctgatcggctacagcctgggcgcccacgtgagcggcttcgccggcagcagcatcggcggcacccacaagatcggcagaatcaccggcctggacgccgccggccccctgttcgagggcagcgcccccagcaacagactgagccccgacgacgccaacttcgtggacgccatccacaccttcaccagagagcacatgggcctgagcgtgggcatcaagcagcccatcggccactacgacttctaccccaacggcggcagcttccagcccggctgccacttcctggagctgtacagacacatcgcccagcacggcttcaacgccatcacccagaccatcaagtgcagccacgagagaagcgtgcacctgttcatcgacagcctgctgcacgccggcacccagagcatggcctacccctgcggcgacatgaacagcttcagccagggcctgtgcctgagctgcaagaagggcagatgcaacaccctgggctaccacgtgagacaggagcccagaagcaagagcaagagactgttcctggtgaccagagcccagagccccttcaaggtgtaccactaccagttcaagatccagttcatcaaccagaccgagacccccatccagaccaccttcaccatgagcctgctgggcaccaaggagaagatgcagaagatccccatcaccctgggcaagggcatcgccagcaacaagacctacagcttcctgatcaccctggacgtggacatcggcgagctgatcatgatcaagttcaagtgggagaacagcgccgtgtgggccaacgtgtgggacaccgtgcagaccatcatcccctggagcaccggccccagacacagcggcctggtgctgaagaccatcagagtgaaggccggcgagacccagcagagaatgaccttctgcagcgagaacaccgacgacctgctgctgagacccacccaggagaagatcttcgtgaagtgcgagatcaagagcaagaccagcaagagaaagatcagatag

SEQ ID NO: 87231 - DNA, 1500 bp, Artificial Sequence; identical to SEQ ID NO: 87230
  Description of Artificial Sequence: Synthetic coding sequence

SEQ ID NO: 87232 - DNA, 3231 bp, Artificial Sequence
  Description of Artificial Sequence: Synthetic coding sequence
atggagcccggcagcaagagcgtgagcagaagcgactggcagcccgagccccaccagagacccatcacccccctggagcccggccccgagaagacccccatcgcccagcccgagagcaagaccctgcagggcagcaacacccagcagaagcccgccagcaaccagagacccctgacccagcaggagacccccgcccagcacgacgccgagagccagaaggagcccagagcccagcagaagagcgccagccaggaggagttcctggccccccagaagcccgccccccagcagagcccctacatccagagagtgctgctgacccagcaggaggccgccagccagcagggccccggcctgggcaaggagagcatcacccagcaggagcccgccctgagacagagacacgtggcccagcccggccccggccccggcgagcccccccccgcccagcaggaggccgagagcacccccgccgcccaggccaagcccggcgccaagagagagcccagcgcccccaccgagagcaccagccaggagacccccgagcagagcgacaagcagaccacccccgtgcagggcgccaagagcaagcagggcagcctgaccgagctgggcttcctgaccaagctgcaggagctgagcatccagagaagcgccctggagtggaaggccctgagcgagtgggtgaccgacagcgagagcgagagcgacgtgggcagcagcagcgacaccgacagccccgccaccatgggcggcatggtggcccagggcgtgaagctgggcttcaagggcaagagcggctacaaggtgatgagcggctacagcggcaccagcccccacgagaagaccagcgccagaaaccacagacactaccaggacaccgccagcagactgatccacaacatggacctgagaaccatgacccagagcctggtgaccctggccgaggacaacatcgccttcttcagcagccagggccccggcgagaccgcccagagactgagcggcgtgttcgccggcgtgagagagcaggccctgggcctggagcccgccctgggcagactgctgggcgtggcccacctgttcgacctggaccccgagacccccgccaacggctacagaagcctggtgcacaccgccagatgctgcctggcccacctgctgcacaagagcagatacgtggccagcaacagaagaagcatcttcttcagaaccagccacaacctggccgagctggaggcctacctggccgccctgacccagctgagagccctggtgtactacgcccagagactgctggtgaccaacagacccggcgtgctgttcttcgagggcgacgagggcctgaccgccgacttcctgagagagtacgtgaccctgcacaagggctgcttctacggcagatgcctgggcttccagttcacccccgccatcagacccttcctgcagaccatcagcatcggcctggtgagcttcggcgagcactacaagagaaacgagaccggcctgagcgtggccgccagcagcctgttcaccagcggcagattcgccatcgaccccgagctgagaggcgccgagttcgagagaatcacccagaacctggacgtgcacttctggaaggccttctggaacatcaccgagatggaggtgctgagcagcctggccaacatggccagcgccaccgtgagagtgagcagactgctgagcctgccccccgaggccttcgagatgcccctgaccgccgaccccaccctgaccgtgaccatcagcccccccctggcccacaccggccccggccccgtgctggtgagactgatcagctacgacctgagagagggccaggacagcgaggagctgagcagcctgatcaagagcaacggccagagaagcctggagctgtggcccagaccccagcaggcccccagaagcagaagcctgatcgtgcacttccacggcggcggcttcgtggcccagaccagcagaagccacgagccctacctgaagagctgggcccaggagctgggcgcccccatcatcagcatcgactacagcctggcccccgaggcccccttccccagagccctggaggagtgcttcttcgcctactgctgggccatcaagcactgcgccctgctgggcagcaccggcgagagaatctgcctggccggcgacagcgccggcggcaacctgtgcttcaccgtggccctgagagccgccgcctacggcgtgagagtgcccgacggcatcatggccgcctaccccgccaccatgctgcagcccgccgccagccccagcagactgctgagcctgatggaccccctgctgcccctgagcgtgctgagcaagtgcgtgagcgcctacgccggcgccaagaccgaggaccacagcaacagcgaccagaaggccctgggcatgatgggcctggtgagaagagacaccgccctgctgctgagagacttcagactgggcgccagcagctggctgaacagcttcctggagctgagcggcagaaagagccagaagatgagcgagcccatcgccgagcccatgagaagaagcgtgagcgaggccgccctggcccagccccagggccccctgggcaccgacagcctgaagaacctgaccctgagagacctgagcctgagaggcaacagcgagaccagcagcgacacccccgagatgagcctgagcgccgagaccctgagccccagcacccccagcgacgtgaacttcctgctgccccccgaggacgccggcgaggaggccgaggccaagaacgagctgagccccatggacagaggcctgggcgtgagagccgccttccccgagggcttccaccccagaagaagcagccagggcgccacccagatgcccctgtacagcagccccatcgtgaagaaccccttcatgagccccctgctggcccccgacagcatgctgaagagcctgccccccgtgcacatcgtggcctgcgccctggaccccatgctggacgacagcgtgatgctggccagaagactgagaaacctgggccagcccgtgaccctgagagtggtggaggacctgccccacggcttcctgaccctggccgccctgtgcagagagaccagacaggccgccgagctgtgcgtggagagaatcagactggtgctgaccccccccgccggcgccggccccagcggcgagaccggcgccgccggcgtggacggcggctgcggcggcagacactag

SEQ ID NO: 87233 - DNA, 1356 bp, Artificial Sequence
  Description of Artificial Sequence: Synthetic coding sequence
atgctgagattctacctgttcatcagcctgctgtgcctgagcagaagcgacgccgaggagacctgccccagcttcaccagactgagcttccacagcgccgtggtgggcaccggcctgaacgtgagactgatgctgtacaccagaaagaacctgacctgcgcccagaccatcaacagcagcgccttcggcaacctgaacgtgaccaagaagaccaccttcatcgtgcacggcttcagacccaccggcagcccccccgtgtggatggacgacctggtgaagggcctgctgagcgtggaggacatgaacgtggtggtggtggactggaacagaggcgccaccaccctgatctacacccacgccagcagcaagaccagaaaggtggccatggtgctgaaggagttcatcgaccagatgctggccgagggcgccagcctggacgacatctacatgatcggcgtgagcctgggcgcccacatcagcggcttcgtgggcgagatgtacgacggctggctgggcagaatcaccggcctggaccccgccggccccctgttcaacggcaagccccaccaggacagactggaccccagcgacgcccagttcgtggacgtgatccacagcgacaccgacgccctgggctacaaggagcccctgggcaacatcgacttctaccccaacggcggcctggaccagcccggctgccccaagaccatcctgggcggcttccagtacttcaagtgcgaccaccagagaagcgtgtacctgtacctgagcagcctgagagagagctgcaccatcaccgcctacccctgcgacagctaccaggactacagaaacggcaagtgcgtgagctgcggcaccagccagaaggagagctgccccctgctgggctactacgccgacaactggaaggaccacctgagaggcaaggacccccccatgaccaaggccttcttcgacaccgccgaggagagccccttctgcatgtaccactacttcgtggacatcatcacctggaacaagaacgtgagaagaggcgacatcaccatcaagctgagagacaaggccggcaacaccaccgagagcaagatcaaccacgagcccaccaccttccagaagtaccaccaggtgagcctgctggccagattcaaccaggacctggacaaggtggccgccatcagcctgatgttcagcaccggcagcctgatcggccccagatacaagctgagaatcctgagaatgaagctgagaagcctggcccaccccgagagaccccagctgtgcagatacgacctggtgctgatggagaacgtggagaccgtgttccagcccatcctgtgccccgagctgcagctgtag

SEQ ID NO: 87234 - DNA, 1446 bp, Artificial Sequence
  Description of Artificial Sequence: Synthetic coding sequence
atgctgctgaagtgcctgcacaacaacctgtgccagaagtacagcgcccacgccttccagttcagccccagaaacgtgctgtggctgctggtggtgtgcctgagaagcgacaacaagagaccctgcctggagttcagccagctgagcgtgaaggacagcttcagagacctgttcatccccagaatcgagaccatcctgatgatgtacaccagaaacaacctgaactgcgccgagcccctgttcgagcagaacaacagcctgaacgtgaacttcaacacccagaagaagaccgtgtggctgatccacggctacagacccgtgggcagcatccccctgtggctgcagaacttcgtgagaatcctgctgaacgaggaggacatgaacgtgatcgtggtggactggagcagaggcgccaccaccttcatctacaacagagccgtgaagaacaccagaaaggtggccgtgagcctgagcgtgcacatcaagaacctgctgaagcacggcgccagcctggacaacttccacttcatcggcgtgagcctgggcgcccacatcagcggcttcgtgggcaagatcttccacggccagctgggcagaatcaccggcctggaccccgccggccccagattcagcagaaagcccccctacagcagactggactacaccgacgccaagttcgtggacgtgatccacagcgacagcaacggcctgggcatccaggagcccctgggccacatcgacttctaccccaacggcggcaacaagcagcccggctgccccaagagcatcttcagcggcatccagttcatcaagtgcaaccaccagagagccgtgcacctgttcatggccagcctggagaccaactgcaacttcatcagcttcccctgcagaagctacaaggactacaagaccagcctgtgcgtggactgcgactgcttcaaggagaagagctgccccagactgggctaccaggccaagctgttcaagggcgtgctgaaggagagaatggagggcagacccctgagaaccaccgtgttcctggacaccagcggcacctaccccttctgcacctactacttcgtgctgagcatcatcgtgcccgacaagaccatgatggacggcagcttcagcttcaagctgctgaaccagctgggcatgatcgaggagcccagactgtacgagaagaacaagcccttctacaagctgcaggaggtgaagatcctggcccagttctacaacgacttcgtgaacatcagcagcatcggcctgacctacttccagagcagcaacctgcagtgcagcacctgcacctacaagatccagagactgatgctgaagagcctgacctaccccgagagaccccccctgtgcagatacaacatcgtgctgaaggacagagaggaggtgttcctgaaccccaacacctgcacccccaagaacacctag

SEQ ID NO: 87235 - DNA, 471 bp, Artificial Sequence
  Description of Artificial Sequence: Synthetic coding sequence
atgaacgtgatcgtggtggactggagcagaggcgccaccaccttcatctacaacagagccgtgaagaacaccagaaaggtggccgtgagcctgagcgtgcacatcaagaacctgctgaagcacggcgccagcctggacaacttccacttcatcggcgtgagcctgggcgcccacatcagcggcttcgtgggcaagatcttccacggccagctgggcagaatcaccggcctggaccccgccggccccagattcagcagaaagcccccctacagcagactggactacaccgacgccaagttcgtggacgtgatccacagcgacagcaacggcatccagttcatcaagtgcaaccaccagagagccgtgcacctgttcatggccagcctggagaccaactgcaacttcatcagcttcccctgcagaagctacaaggactacaagaccagcctgtgcgtggactgcgactgctag

SEQ ID NO: 87236 - DNA, 426 bp, Artificial Sequence
  Description of Artificial Sequence: Synthetic coding sequence
tgatacaacagagccgtgaagaacaccagaaaggtggccgtgagcctgagcgtgcacatcaagaacctgctgaagcacggcgccagcctggacaacttccacttcatcggcgtgagcctgggcgcccacatcagcggcttcgtgggcaagatcttccacggccagctgggcagaatcaccggcctggaccccgccggccccagattcagcagaaagcccccctacagcagactggactacaccgacgccaagttcgtggacgtgatccacagcgacagcaacggcatccagttcatcaagtgcaaccaccagagagccgtgcacctgttcatggccagcctggagaccaactgcaacttcatcagcttcccctgcagaagctacaaggactacaagaccagcctgtgcgtggactgcgactgctag

SEQ ID NO: 87237 - DNA, 1383 bp, Artificial Sequence
  Description of Artificial Sequence: Synthetic coding sequence
atgagagtgtacatcttcctgtgcctgatgtgctgggtgagaagcgacaacaagagaccctgcctggagttcagccagctgagcgtgaaggacagcttcagagacctgttcatccccagaatcgagaccatcctgatgatgtacaccagaaacaacctgaactgcgccgagcccctgttcgagcagaacaacagcctgaacgtgaacttcaacacccagaagaagaccgtgtggctgatccacggctacagacccgtgggcagcatccccctgtggctgcagaacttcgtgagaatcctgctgaacgaggaggacatgaacgtgatcgtggtggactggagcagaggcgccaccaccttcatctacaacagagccgtgaagaacaccagaaaggtggccgtgagcctgagcgtgcacatcaagaacctgctgaagcacggcgccagcctggacaacttccacttcatcggcgtgagcctgggcgcccacatcagcggcttcgtgggcaagatcttccacggccagctgggcagaatcaccggcctggaccccgccggccccagattcagcagaaagcccccctacagcagactggactacaccgacgccaagttcgtggacgtgatccacagcgacagcaacggcctgggcatccaggagcccctgggccacatcgacttctaccccaacggcggcaacaagcagcccggctgccccaagagcatcttcagcggcatccagttcatcaagtgcaaccaccagagagccgtgcacctgttcatggccagcctggagaccaactgcaacttcatcagcttcccctgcagaagctacaaggactacaagaccagcctgtgcgtggactgcgactgcttcaaggagaagagctgccccagactgggctaccaggccaagctgttcaagggcgtgctgaaggagagaatggagggcagacccctgagaaccaccgtgttcctggacaccagcggcacctaccccttctgcacctactacttcgtgctgagcatcatcgtgcccgacaagaccatgatggacggcagcttcagcttcaagctgctgaaccagctgggcatgatcgaggagcccagactgtacgagaagaacaagcccttctacaagctgcaggaggtgaagatcctggcccagttctacaacgacttcgtgaacatcagcagcatcggcctgacctacttccagagcagcaacctgcagtgcagcacctgcacctacaagatccagagactgatgctgaagagcctgacctaccccgagagaccccccctgtgcagatacaacatcgtgctgaaggacagagaggaggtgttcctgaaccccaacacctgcacccccaagaacacctag

SEQ ID NO: 87238 - DNA, 2673 bp, Artificial Sequence
  Description of Artificial Sequence: Synthetic coding sequence
atgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccaggaggtgatccccatgcacctggccaccagccccatcctgagcgagggcgccagcagaatggagtgccagctgaagagaggcagcgtggacagaatgagaggcctggaccccagcacccccgcccaggtgatcgcccccagcgagacccccagcagcagcagcgtggtgaagaagagaagaaagagaagaagaaagagccagctggacagcctgaagagagacgacaacatgaacaccagcgaggacgaggacatgttccccatcgagatgagcagcgacgaggccatggagctgctggagagcagcagaaccctgcccaacgacatcccccccttccaggacgacatccccgaggagaacctgagcctggccgtgatctacccccagagcgccagctaccccaacagcgacagagagtggagccccacccccagccccagcggcagcagacccagcacccccaagagcgacagcgagctggtgagcaagagcaccgagagaaccggccagaagaaccccgagatgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaacggcgaccccagcggcctggccaagcacgccagcgacaacggcgccagaagcgccaaccagagcccccagagcgtgggcagcagcggcgtggacagcggcgtggagagcaccagcgacggcctgagagacctgcccagcatcgccatcagcctgtgcggcggcctgagcgaccacagagagatcaccaaggacgccttcctggagcaggccgtgagctaccagcagttcgtggacaaccccgccatcatcgacgaccccaacctggtggtgaagatcggcagcaagtactacaactggaccaccgccgcccccctgctgctggccatgcaggccttccagaagcccctgcccaaggccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87239 - DNA, 1863 bp, Artificial Sequence
  Description of Artificial Sequence: Synthetic coding sequence
atgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaacggcgaccccagcggcctggccaagcacgccagcgacaacggcgccagaagcgccaaccagagcccccagagcgtgggcagcagcggcgtggacagcggcgtggagagcaccagcgacggcctgagagacctgcccagcatcgccatcagcctgtgcggcggcctgagcgaccacagagagatcaccaaggacgccttcctggagcaggccgtgagctaccagcagttcgtggacaaccccgccatcatcgacgaccccaacctggtggtgaagatcggcagcaagtactacaactggaccaccgccgcccccctgctgctggccatgcaggccttccagaagcccctgcccaaggccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87240 - DNA, 2799 bp, Artificial Sequence
  Description of Artificial Sequence: Synthetic coding sequence
atgagcagagtgcagaccatgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccaggaggtgatccccatgcacctggccaccagccccatcctgagcgagggcgccagcagaatggagtgccagctgaagagaggcagcgtggacagaatgagaggcctggaccccagcacccccgcccaggtgatcgcccccagcgagacccccagcagcagcagcgtggtgaagaagagaagaaagagaagaagaaagagccagctggacagcctgaagagagacgacaacatgaacaccagcgaggacgaggacatgttccccatcgagatgagcagcgacgaggccatggagctgctggagagcagcagaaccctgcccaacgacatcccccccttccaggacgacatccccgaggagaacctgagcctggccgtgatctacccccagagcgccagctaccccaacagcgacagagagtggagccccacccccagcagcctggtggactgcaagagaaccgccccccacctggccgtggccgccgagggcggcctgagcagcagctgccccccccagagcagcctgttccaccccagcgagagccccagcggcagcagacccagcacccccaagagcgacagcgagctggtgagcaagagcaccgagagaaccggccagaagaaccccgagatgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaacggcgaccccagcggcctggccaagcacgccagcgacaacggcgccagaagcgccaaccagagcccccagagcgtgggcagcagcggcgtggacagcggcgtggagagcaccagcgacggcctgagagacctgcccagcatcgccatcagcctgtgcggcggcctgagcgaccacagagagatcaccaaggacgccttcctggagcaggccgtgagctaccagcagttcgtggacaaccccgccatcatcgacgaccccaacctggtggtgaagatcggcagcaagtactacaactggaccaccgccgcccccctgctgctggccatgcaggccttccagaagcccctgcccaaggccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87241 - DNA, 1176 bp, Artificial Sequence
  Description of Artificial Sequence: Synthetic coding sequence
atgcaggccttccagaagcccctgcccaagagcagctgcctgagctacctgcacgtgatcctggacgccatcagattctgcttcagcaagatcttcaacgcccagatcgccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87242 - DNA, 87 bp, Artificial Sequence
  Description of Artificial Sequence: Synthetic coding sequence
atgaactacgtgggccagctggccggccaggtgttcgtgaccgtgaaggagctgtacaagggcctgaaccccgccaccctgagctag

SEQ ID NO: 87243 - DNA, 2691 bp, Artificial Sequence
  Description of Artificial Sequence: Synthetic coding sequence
atgagcagagtgcagaccatgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccaggaggtgatccccatgcacctggccaccagccccatcctgagcgagggcgccagcagaatggagtgccagctgaagagaggcagcgtggacagaatgagaggcctggaccccagcacccccgcccaggtgatcgcccccagcgagacccccagcagcagcagcgtggtgaagaagagaagaaagagaagaagaaagagccagctggacagcctgaagagagacgacaacatgaacaccagcgaggacgaggacatgttccccatcgagatgagcagcgacgaggccatggagctgctggagagcagcagaaccctgcccaacgacatcccccccttccaggacgacatccccgaggagaacctgagcctggccgtgatctacccccagagcgccagctaccccaacagcgacagagagtggagccccacccccagccccagcggcagcagacccagcacccccaagagcgacagcgagctggtgagcaagagcaccgagagaaccggccagaagaaccccgagatgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaacggcgaccccagcggcctggccaagcacgccagcgacaacggcgccagaagcgccaaccagagcccccagagcgtgggcagcagcggcgtggacagcggcgtggagagcaccagcgacggcctgagagacctgcccagcatcgccatcagcctgtgcggcggcctgagcgaccacagagagatcaccaaggacgccttcctggagcaggccgtgagctaccagcagttcgtggacaaccccgccatcatcgacgaccccaacctggtggtgaagatcggcagcaagtactacaactggaccaccgccgcccccctgctgctggccatgcaggccttccagaagcccctgcccaaggccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87244 - DNA, 291 bp, Artificial Sequence
  Description of Artificial Sequence: Synthetic coding sequence
atgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccagtag

SEQ ID NO: 87245 - DNA, 2928 bp, Artificial Sequence
  Description of Artificial Sequence: Synthetic coding sequence
atgggcgagcaggacggcatcagaagcagcagctgggagaccagccagggcaagagcagccccgacagcgcctggagctggatccccatcatgagagaccccggctggatcagaaacgtgtggagcagcaacatcaacgtgcagaccatgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccaggaggtgatccccatgcacctggccaccagccccatcctgagcgagggcgccagcagaatggagtgccagctgaagagaggcagcgtggacagaatgagaggcctggaccccagcacccccgcccaggtgatcgcccccagcgagacccccagcagcagcagcgtggtgaagaagagaagaaagagaagaagaaagagccagctggacagcctgaagagagacgacaacatgaacaccagcgaggacgaggacatgttccccatcgagatgagcagcgacgaggccatggagctgctggagagcagcagaaccctgcccaacgacatcccccccttccaggacgacatccccgaggagaacctgagcctggccgtgatctacccccagagcgccagctaccccaacagcgacagagagtggagccccacccccagcagcctggtggactgcaagagaaccgccccccacctggccgtggccgccgagggcggcctgagcagcagctgccccccccagagcagcctgttccaccccagcgagagccccagcggcagcagacccagcacccccaagagcgacagcgagctggtgagcaagagcaccgagagaaccggccagaagaaccccgagatgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaacggcgaccccagcggcctggccaagcacgccagcgacaacggcgccagaagcgccaaccagagcccccagagcgtgggcagcagcggcgtggacagcggcgtggagagcaccagcgacggcctgagagacctgcccagcatcgccatcagcctgtgcggcggcctgagcgaccacagagagatcaccaaggacgccttcctggagcaggccgtgagctaccagcagttcgtggacaaccccgccatcatcgacgaccccaacctggtggtgaagatcggcagcaagtactacaactggaccaccgccgcccccctgctgctggccatgcaggccttccagaagcccctgcccaaggccaccgtggagagcatcatgagagacaagatgcccaagaagggcggcagatggtggttcagctggagaggcagaaacaccaccatcaaggaggagagcaagcccgagcagtgcctggccggcaaggcccacagcaccggcgagcagcccccccagctgagcctggccaccagagtgaagcacgagagcagcagcagcgacgaggagagagccgccgccaagcccagcaacgccggccacctgcccctgctgcccaacgtgagctacaagaagaccctgagactgaccagcgagcagctgaagagcctgaagctgaagaacggccccaacgacgtggtgttcagcgtgaccacccagtaccagggcacctgcagatgcgagggcaccatctacctgtggaactgggacgacaaggtgatcatcagcgacatcgacggcaccatcaccagaagcgacaccctgggccacatcctgcccaccctgggcaaggactggacccaccagggcatcgccaagctgtaccacaaggtgagccagaacggctacaagttcctgtactgcagcgccagagccatcggcatggccgacatgaccagaggctacctgcactgggtgaacgagagaggcaccgtgctgccccagggccccctgctgctgagccccagcagcctgttcagcgccctgcacagagaggtgatcgagaagaagcccgagaagttcaaggtgcagtgcctgaccgacatcaagaacctgttcttccccaacaccgagcccttctacgccgccttcggcaacagacccgccgacgtgtacagctacaagcaggtgggcgtgagcctgaacagaatcttcaccgtgaaccccaagggcgagctggtgcaggagcacgccaagaccaacatcagcagctacgtgagactgtgcgaggtggtggaccacgtgttccccctgctgaagagaagccacagcagcgacttcccctgcagcgacaccttcagcaacttcaccttctggagagagcccctgccccccttcgagaaccaggacatccacagcgccagcgcctag

SEQ ID NO: 87246 - DNA, 1380 bp, Artificial Sequence
  Description of Artificial Sequence: Synthetic coding sequence
atgagcagagtgcagaccatgaactacgtgggccagctggccggccaggtgttcgtgaccgtgaaggagctgtacaagggcctgaaccccgccaccctgagcggctgcatcgacatcatcgtgatcagacagcccaacggcaacctgcagtgcagccccttccacgtgagattcggcaagatgggcgtgctgagaagcagagagaaggtggtggacatcgagatcaacggcgagagcgtggacctgcacatgaagctgggcgacaacggcgaggccttcttcgtgcaggagaccgacaacgaccaggaggtgatccccatgcacctggccaccagccccatcctgagcgagggcgccagcagaatggagtgccagctgaagagaggcagcgtggacagaatgagaggcctggaccccagcacccccgcccaggtgatcgcccccagcgagacccccagcagcagcagcgtggtgaagaagagaagaaagagaagaagaaagagccagctggacagcctgaagagagacgacaacatgaacaccagcgaggacgaggacatgttccccatcgagatgagcagcgacgaggccatggagctgctggagagcagcagaaccctgcccaacgacatcccccccttccaggacgacatccccgaggagaacctgagcctggccgtgatctacccccagagcgccagctaccccaacagcgacagagagtggagccccacccccagcagcctggtggactgcaagagaaccgccccccacctggccgtggccgccgagggcggcctgagcagcagctgccccccccagagcagcctgttccaccccagcgagagccccagcggcagcagacccagcacccccaagagcgacagcgagctggtgagcaagagcaccgagagaaccggccagaagaaccccgagatgctgtggctgtggggcgagctgccccaggccgccaagagcagcagcccccacaagatgaaggagagcagccccctgagcagcagaaagatctgcgacaagagccacttccaggccatccacagcgagagcagcgacaccttcagcgaccagagccccaccctggtgggcggcgccctgctggaccagaacaagccccagaccgagatgcagttcgtgaacgaggaggacctggagaccctgggcgccgccgcccccctgctgcccatgatcgaggagctgaagccccccagcgccagcgtggtgcagaccgccaacaagaccgacagccccagcagaaagagagacaagagaagcagacacctgggcgccgacggcgtgtacctggacgacctgaccgacatggaccccgaggtggccgccctgtacttccccaagaagtag

SEQ ID NO: 87247 - DNA, 2691 bp, Artificial Sequence
  Description of Artificial Sequence: Synthetic coding sequence
atgaactacgtgggccagctggccggccaggtgatcgtgaccgtgaaggagctgtacaagggcatcaaccaggccaccctgagcggctgcatcgacgtgatcgtggtgcagcagcaggacggcagctaccagtgcagccccttccacgtgagattcggcaagctgggcgtgctgagaagcaaggagaaggtgatcgacatcgagatcaacggcagcgccgtggacctgcacatgaagctgggcgacaacggcgaggccttcttcgtggaggagaccgaggaggagtacgagaagctgcccgcctacctggccaccagccccatccccaccgaggaccagttcttcaaggacatcgacacccccctggtgaagagcggcggcgacgagacccccagccagagcagcgacatcagccacgtgctggagaccgagaccatcttcacccccagcagcgtgaagaagaagaagagaagaagaaagaagtacaagcaggacagcaagaaggaggagcaggccgccagcgccgccgccgaggacacctgcgacgtgggcgtgagcagcgacgacgacaagggcgcccaggccgccagaggcagcagcaacgccagcctgaaggaggaggagtgcaaggagcccctgctgttccacagcggcgaccactaccccctgagcgacggcgactggagccccctggagaccacctacccccagaccgcctgccccaagagcgacagcgagctggaggtgaagcccgccgagagcctgctgagaagcgagagccacatggagtggacctggggcggcttccccgagagcaccaaggtgagcaagagagagagaagcgaccaccaccccagaaccgccaccatcacccccagcgagaacacccacttcagagtgatccccagcgaggacaacctgatcagcgaggtggagaaggacgccagcatggaggacaccgtgtgcaccatcgtgaagcccaagcccagagccctgggcacccagatgagcgaccccaccagcgtggccgagctgctggagccccccctggagagcacccagatcagcagcatgctggacgccgaccacctgcccaacgccgccctggccgaggcccccagcgagagcaagcccgccgccaaggtggacagccccagcaagaagaagggcgtgcacaagagaagccagcaccagggccccgacgacatctacctggacgacctgaagggcctggagcccgaggtggccgccctgtacttccccaagagcgagagcgagcccggcagcagacagtggcccgagagcgacaccctgagcggcagccagagcccccagagcgtgggcagcgccgccgccgacagcggcaccgagtgcctgagcgacagcgccatggacctgcccgacgtgaccctgagcctgtgcggcggcctgagcgagaacggcgagatcagcaaggagaagttcatggagcacatcatcacctaccacgagttcgccgagaaccccggcctgatcgacaaccccaacctggtgatcagaatctacaacagatactacaactgggccctggccgcccccatgatcctgagcctgcaggtgttccagaagagcctgcccaaggccaccgtggagagctgggtgaaggacaagatgcccaagaagagcggcagatggtggttctggagaaagagagagagcatgaccaagcagctgcccgagagcaaggagggcaagagcgaggccccccccgccagcgacctgcccagcagcagcaaggagcccgccggcgccagacccgccgagaacgacagcagcagcgacgagggcagccaggagctggaggagagcatcaccgtggaccccatccccaccgagcccctgagccacggcagcaccaccagctacaagaagagcctgagactgagcagcgaccagatcgccaagctgaagctgcacgacggccccaacgacgtggtgttcagcatcaccacccagtaccagggcacctgcagatgcgccggcaccatctacctgtggaactggaacgacaagatcatcatcagcgacatcgacggcaccatcaccaagagcgacgccctgggccagatcctgccccagctgggcaaggactggacccaccagggcatcgccaagctgtaccacagcatcaacgagaacggctacaagttcctgtactgcagcgccagagccatcggcatggccgacatgaccagaggctacctgcactgggtgaacgacaagggcaccatcctgcccagaggccccctgatgctgagccccagcagcctgttcagcgccttccacagagaggtgatcgagaagaagcccgagaagttcaagatcgagtgcctgaacgacatcaagaacctgttcgcccccagcaagcagcccttctacgccgccttcggcaacagacccaacgacgtgtacgcctacacccaggtgggcgtgcccgactgcagaatcttcaccgtgaaccccaagggcgagctgatccaggagagaaccaagggcaacaagagcagctaccacagactgagcgagctggtggagcacgtgttccccctgctgagcaaggagcagaacagcgccttcccctgccccgagttcagcagcttctgctactggagagaccccatccccgaggtggacctggacgacctgagctag

SEQ ID NO: 87248 - DNA, 702 bp, Artificial Sequence
  Description of Artificial Sequence: Synthetic coding sequence
atgaactacgtgggccagctggccggccaggtgatcgtgaccgtgaaggagctgtacaagggcatcaaccaggccaccctgagcggctgcatcgacgtgatcgtggtgcagcagcaggacggcagctaccagtgcagccccttccacgtgagattcggcaagctgggcgtgctgagaagcaaggagaaggtgatcgacatcgagatcaacggcagcgccgtggacctgcacatgaagctgggcgacaacggcgaggccttcttcgtggaggagaccgaggaggagtacgagaagctgcccgcctacctggccaccagccccatccccaccgaggaccagttcttcaaggacatcgacacccccctggtgaagagcggcggcgacgagacccccagccagagcagcgacatcagccacgtgctggagaccgagaccatcttcacccccagcagcgtgaagaagaagaagagaagaagaaagaagtacaagcaggacagcaagaaggaggagcaggccgccagcgccgccgccgaggacacctgcgacgtgggcgtgagcagcgacgacgacaagggcgcccaggccgccagaggcagcagcaacgccagcctgaaggaggaggagtgcaaggagcccctgctgttccacagcggcgaccactaccccctgagcgacggcgactggagccccctggagacctag

SEQ ID NO: 87249 - DNA, 2556 bp, Artificial Sequence
  Description of Artificial Sequence: Synthetic coding sequence
atgaactacgtgggccagctggccgagaccgtgttcggcaccgtgaaggagctgtacagaggcctgaaccccgccaccctgagcggcggcatcgacgtgctggtggtgaagcaggtggacggcagcttcagatgcagccccttccacgtgagattcggcaagctgggcgtgctgagaagcagagagaaggtggtggacatcgagctgaacggcgagcccgtggacctgcacatgaagctgggcgacagcggcgaggccttcttcgtgcaggagctggagagcgacgacgagcacgtgccccccggcctgtgcaccagccccatcccctggggcggcctgagcggcttccccagcgacagccagctgggcaccgccagcgagcccgagggcctggtgatggccggcaccgccagcaccggcagaagaaagagaagaagaagaagaaagcccaagcagaaggaggacgccgtggccaccgacagcagccccgaggagctggaggccggcgccgagagcgagctgagcctgcccgagaagctgagacccgagccccccggcgtgcagctggaggagaagagcagcctgcagcccaaggacatctacccctacagcgacggcgagtggcccccccaggccagcctgagcgccggcgagctgaccagccccaagagcgacagcgagctggaggtgagaacccccgagcccagccccctgagagccgagagccacatgcagtgggcctggggcagactgcccaaggtggccagagccgagagacccgagagcagcgtggtgctggagggcagagccggcgccaccagcccccccagaggcggccccagcacccccagcaccagcgtggccggcggcgtggaccccctgggcctgcccatccagcagaccgaggccggcgccgacctgcagcccgacaccgaggaccccaccctggtgggcccccccctgcacacccccgagaccgaggagagcaagacccagagcagcggcgacatgggcctgccccccgccagcaagagctggagctgggccaccctggaggtgcccgtgcccaccggccagcccgagagagtgagcagaggcaagggcagccccaagagaagccagcacctgggccccagcgacatctacctggacgacctgcccagcctggacagcgagaacgccgccctgtacttcccccagagcgacagcggcctgggcgccagaagatggagcgagcccagcagccagaagagcctgagagaccccaaccccgagcacgagcccgagcccaccctggacaccgtggacaccatcgccctgagcctgtgcggcggcctggccgacagcagagacatcagcctggagaagttcaaccagcacagcgtgagctaccaggacctgaccaagaaccccggcctgctggacgaccccaacctggtggtgaagatcaacggcaagcactacaactgggccgtggccgcccccatgatcctgagcctgcaggccttccagaagaacctgcccaagagcaccatggacaagctggagagagagaagatgcccagaaagggcggcagatggtggttcagctggagaagaagagacttcctggccgaggagagaagcgcccagaaggagaagaccgccgccaaggagcagcagggcgagaagaccgaggtgctgagcagcgacgacgacgcccccgacagccccgtgatcctggagatccccagcctgccccccagcaccccccccagcacccccacctacaagaagagcctgagactgagcagcgaccagatcagaagactgaacctgcaggagggcgccaacgacgtggtgttcagcgtgaccacccagtaccagggcacctgcagatgcaaggccaccatctacctgtggaagtgggacgacaaggtggtgatcagcgacatcgacggcaccatcaccaagagcgacgccctgggccacatcctgccccagctgggcaaggactggacccaccagggcatcaccagcctgtaccacaagatccagctgaacggctacaagttcctgtactgcagcgccagagccatcggcatggccgacctgaccaagggctacctgcagtgggtgagcgagggcggctgcagcctgcccaagggccccatcctgctgagccccagcagcctgttcagcgccctgcacagagaggtgatcgagaagaagcccgaggtgttcaaggtggcctgcctgagcgacatccagcagctgttcctgccccacggccagcccttctacgccgccttcggcaacagacccaacgacgtgttcgcctacagacaggtgggcctgcccgagagcagaatcttcaccgtgaaccccagaggcgagctgatccaggagctgatcaagaaccacaagagcacctacgagagactgggcgaggtggtggagctgctgttcccccccgtggccagaggccccagcaccgacctggccaaccccgagtacagcaacttctgctactggagagagcccctgcccgccgtggacctggacaccctggactag

SEQ ID NO: 87250 - DNA, 1242 bp, Artificial Sequence
  Description of Artificial Sequence: Synthetic coding sequence
atgggcctgccccccgccagcaagagctggagctgggccaccctggaggtgcccgtgcccaccggccagcccgagagagtgagcagaggcaagggcagccccaagagaagccagcacctgggccccagcgacatctacctggacgacctgcccagcctggacagcgagaacgccgccctgtacttcccccagagcgacagcggcctgggcgccagaagatggagcgagcccagcagccagaagagcctgagagaccccaaccccgagcacgagcccgagcccaccctggacaccgtggacaccatcgccctgagcctgtgcggcggcctggccgacagcagagacatcagcctggagaagttcaaccagcacagcgtgagctaccaggacctgaccaagaaccccggcctgctggacgaccccaacctggtggtgaagatcaacggcaagcactacaactgggccgtggccgcccccatgatcctgagcctgcaggccttccagaagaacctgcccaagagaagcgcccagaaggagaagaccgccgccaaggagcagcagggcgagaagaccgaggtgctgagcagcgacgacgacgcccccgacagccccgtgatcctggagatccccagcctgccccccagcaccccccccagcacccccacctacaagaagagcctgagactgagcagcgaccagatcagaagactgaacctgcaggagggcgccaacgacgtggtgttcagcgtgaccacccagtaccagggcacctgcagatgcaaggccaccatctacctgtggaagtgggacgacaaggtggtgatcagcgacatcgacggcaccatcaccaagagcgacgccctgggccacatcctgccccagctgggcaaggactggacccaccagggcatcaccagcctgtaccacaagatccagctgaacggctacaagttcctgtactgcagcgccagagccatcggcatggccgacctgaccaagggctacctgcagtgggtgagcgagggcggctgcagcctgcccaagggccccatcctgctgagccccagcagcctgttcagcgccctgcacagagaggtgatcgagaagaagcccgaggtgttcaaggtggcctgcctgagcgacatccagcagctgttcctgccccacggccagcccttctacgccgccttcggcaacagacccaacgacgtgttcgcctacagacaggtgggcctgccctag

SEQ ID NO: 87251 - DNA, 813 bp, Artificial Sequence
  Description of Artificial Sequence: Synthetic coding sequence
tgagtgaagatcaacggcaagcactacaactgggccgtggccgcccccatgatcctgagcctgcaggccttccagaagaacctgcccaagagaagcgcccagaaggagaagaccgccgccaaggagcagcagggcgagaagaccgaggtgctgagcagcgacgacgacgcccccgacagccccgtgatcctggagatccccagcctgccccccagcaccccccccagcacccccacctacaagaagagcctgagactgagcagcgaccagatcagaagactgaacctgcaggagggcgccaacgacgtggtgttcagcgtgaccacccagtaccagggcacctgcagatgcaaggccaccatctacctgtggaagtgggacgacaaggtggtgatcagcgacatcgacggcaccatcaccaagagcgacgccctgggccacatcctgccccagctgggcaaggactggacccaccagggcatcaccagcctgtaccacaagatccagctgaacggctacaagttcctgtactgcagcgccagagccatcggcatggccgacctgaccaagggctacctgcagtgggtgagcgagggcggctgcagcctgcccaagggccccatcctgctgagccccagcagcctgttcagcgccctgcacagagaggtgatcgagaagaagcccgaggtgttcaaggtggcctgcctgagcgacatccagcagctgttcctgccccacggccagcccttctacgccgccttcggcaacagacccaacgacgtgttcgcctacagacaggtgggcctgccctag

SEQ ID NO: 87252 - DNA, 531 bp, Artificial Sequence
  Description of Artificial Sequence: Synthetic coding sequence
atgaagcccctgctgctggccgtgagcctgggcctgatcgccgccctgcaggcccaccacctgctggccagcgacgaggagatccaggacgtgagcggcacctggtacctgaaggccatgaccgtggacagagagttccccgagatgaacctggagagcgtgacccccatgaccctgaccaccctggagggcggcaacctggaggccaaggtgaccatgctgatcagcggcagatgccaggaggtgaaggccgtgctggagaagaccgacgagcccggcaagtacaccgccgacggcggcaagcacgtggcctacatcatcagaagccacgtgaaggaccactacatcttctactgcgagggcgagctgcacggcaagcccgtgagaggcgtgaagctggtgggcagagaccccaagaacaacctggaggccctggaggacttcgagaaggccgccggcgccagaggcctgagcaccgagagcatcctgatccccagacagagcgagacctgcagccccggcagcgactag

SEQ ID NO: 87253 - DNA, 531 bp, Artificial Sequence; identical to SEQ ID NO: 87252
  Description of Artificial Sequence: Synthetic coding sequence

SEQ ID NO: 87254 - DNA, 564 bp, Artificial Sequence
  Description of Artificial Sequence: Synthetic coding sequence
atgagacagggcctgctggtgctggccctggtgctggtgctggtgctggtgctggccgccggcagccaggtgcaggagtggtaccccagagagagccacgccctgaactggaacaagttcagcggcttctggtacatcctggccaccgccaccgacgcccagggcttcctgcccgccagagacaagagaaagctgggcgccagcgtggtgaaggtgaacaaggtgggccagctgagagtgctgctggccttcagaagaggccagggctgcggcagagcccagcccagacaccccggcaccagcggccacctgtgggccagcctgagcgtgaagggcgtgaaggccttccacgtgctgagcaccgactacagctacggcctggtgtacctgagactgggcagagccacccagaactacaagaacctgctgctgttccacagacagaacgtgagcagcttccagagcctgaaggagttcatggacgcctgcgacatcctgggcctgagcaaggccgccgtgatcctgcccaaggacgccagcagaacccacaccatcctgccctag

SEQ ID NO: 87255 - DNA, 603 bp, Artificial Sequence
  Description of Artificial Sequence: Synthetic coding sequence
atgagacagggcctgctggtgctggccctggtgctggtgctggtgctggtgctggccgccggcagccaggtgcaggagtggtaccccagagagagccacgccctgaactggaacaagttcagcggcttctggtacatcctggccaccgccaccgacgcccagggcttcctgcccgccagagacaagagaaagctgggcgccagcgtggtgaaggtgaacaaggtgggccagctgagagtgctgctggccttcagaagactgaagggctgccagagccaggaggtgatcctgagaaaggacggcaagaagcccgtgttcggcaacgcctgcgcctacgccgccggccccagagagggccaggagggcgtgaagggcgtgaaggccttccacgtgctgagcaccgactacagctacggcctggtgtacctgagactgggcagagccacccagaactacaagaacctgctgctgttccacagacagaacgtgagcagcttccagagcctgaaggagttcatggacgcctgcgacatcctgggcctgagcaaggccgccgtgatcctgcccaaggacgccagcagaacccacaccatcctgccctag

SEQ ID NO: 87256 - DNA, 273 bp, Artificial Sequence
  Description of Artificial Sequence: Synthetic coding sequence
accttcgagctgagcgacgacggcagattcgaggtgtggaacgccatgaccagaggccagcactgcgacacctggagctacgtgctgatccccgccgcccagcccggccagttcaccgtggaccacggcgtggacaccagagccggctggcccagcagcggcagcgcctgctgggccggcgccggctgctgcctgcccggcagatggaccagcagcagcgcctgggccgagctgagagccagcagaatgaccaccagcagcagccagatgtag

SEQ ID NO: 87257 - DNA, 579 bp, Artificial Sequence
  Description of Artificial Sequence: Synthetic coding sequence
atgagactgctgtgcggcctgtggctgtggctgagcctgctgaaggtgctgcaggcccagacccccacccccctgcccctgcccccccccatgcagagcttccagggcaaccagttccagggcgagtggttcgtgctgggcctggccggcaacagcttcagacccgagcacagagccctgctgaacgccttcaccgccaccttcgagctgagcgacgacggcagattcgaggtgtggaacgccatgaccagaggccagcactgcgacacctggagctacgtgctgatccccgccgcccagcccggccagttcaccgtggaccacggcgtggagcccggcgccgacagagaggagaccagagtggtggacagcgactacacccagttcgccctgatgctgagcagaagacacaccagcagactggccgtgctgagaatcagcctgctgggcagaagctggctgctgccccccggcaccctggaccagttcatctgcctgggcagagcccagggcctgagcgacgacaacatcgtgttccccgacgtgaccggctggagcccccaggccagcgtgtgctag

SEQ ID NO: 87258 - DNA, 597 bp, Artificial Sequence
  Description of Artificial Sequence: Synthetic coding sequence
atgcccctgggcctgctgtggctgggcctggccctgctgggcgccctgcacgcccaggcccaggacagcaccagcgacctgatccccgccccccccctgagcaaggtgcccctgcagcagaacttccaggacaaccagttccagggcaagtggtacgtggtgggcctggccggcaacgccatcctgagagaggacaaggacccccagaagatgtacgccaccatctacgagctgaaggaggacaagagctacaacgtgaccagcgtgctgttcagaaagaagaagtgcgactactggatcagaaccttcgtgcccggctgccagcccggcgagttcaccctgggcaacatcaagagctaccccggcctgaccagctacctggtgagagtggtgagcaccaactacaaccagcacgccatggtgttcttcaagaaggtgagccagaacagagagtacttcaagatcaccctgtacggcagaaccaaggagctgaccagcgagctgaaggagaacttcatcagattcagcaagagcctgggcctgcccgagaaccacatcgtgttccccgtgcccatcgaccagtgcatcgacggctag

SEQ ID NO: 87259 - DNA, 603 bp, Artificial Sequence
  Description of Artificial Sequence: Synthetic coding sequence
atgcccctgggcctgctgtggctgggcctggccctgctgggcgccctgcacgcccaggcccaggacagcaccagcgacctgatccccgccccccccctgagcaaggtgcccctgcagcagaacttccaggacaaccagttccagggcaagtggtacgtggtgggcctggccggcaacgccatcctgagagaggacaaggacccccagaagatgtacgccaccatctacgagctgaaggaggacaagagctacaacgtgaccagcgtgctgttcagagagaaggcccagaagtgcgactactggatcagaaccttcgtgcccggctgccagcccggcgagttcaccctgggcaacatcaagagctaccccggcctgaccagctacctggtgagagtggtgagcaccaactacaaccagcacgccatggtgttcttcaagaaggtgagccagaacagagagtacttcaagatcaccctgtacggcagaaccaaggagctgaccagcgagctgaaggagaacttcatcagattcagcaagagcctgggcctgcccgagaaccacatcgtgttccccgtgcccatcgaccagtgcatcgacggctag

SEQ ID NO: 87260 - DNA, 603 bp, Artificial Sequence
  Description of Artificial Sequence: Synthetic coding sequence
atgcccctgggcctgctgtggctgggcctggccctgctgggcgccctgcacgcccaggcccaggacagcaccagcgacctgatccccgccccccccctgagcaaggtgcccctgcagcagaacttccaggacaaccagttccagggcaagtggtacgtggtgggcctggccggcaacgccatcctgagagaggacaaggacccccagaagatgtacgccaccatctacgagctgaaggaggacaagagctacaacgtgaccagcgtgctgttcagacagtggaagaagaagtgcgactactggatcagaaccttcgtgcccggctgccagcccggcgagttcaccctgggcaacatcaagagctaccccggcctgaccagctacctggtgagagtggtgagcaccaactacaaccagcacgccatggtgttcttcaagaaggtgagccagaacagagagtacttcaagatcaccctgtacggcagaaccaaggagctgaccagcgagctgaaggagaacttcatcagattcagcaagagcctgggcctgcccgagaaccacatcgtgttccccgtgcccatcgaccagtgcatcgacggctag

SEQ ID NO: 87261 - DNA, 597 bp, Artificial Sequence; identical to SEQ ID NO: 87258
  Description of Artificial Sequence: Synthetic coding sequence

SEQ ID NO: 87262 - DNA, 597 bp, Artificial Sequence
  Description of Artificial Sequence: Synthetic coding sequence
atgcccctgggcctgctgtggctgggcctggccctgctgggcgccctgcacgcccaggcccaggacagcaccagcgacctgatccccgccccccccctgagcaaggtgcccctgcagcagaacttccaggacaaccagttccagggcaagtggtacgtggtgggcctggccggcaacgccatcctgagagaggacaaggacccccagaagatgtacgccaccatctacgagctgaaggaggacaagagctacaacgtgaccagcgtgctgttcagaaagaagaagtgcgactactggatcagaaccttcgtgcccggctgccagcccggcgagttcaccctgggcaacatcaagagctaccccggcctgaccagctacctggtgagagtggtgagcaccaactacaaccagcacgccatggtgttcttcaagaaggtgagccagaacagagagtacttcaagatcaccctgtacggcagaaccaaggagctgaccagcgagctgaaggagaacttcatcagattcagcaagagcctgggcctgcccgagaaccacatcgtgttccccgtgcccatcggcaacggccagagcggctag

SEQ ID NO: 87263 - DNA, 492 bp, Artificial Sequence
  Description of Artificial Sequence: Synthetic coding sequence
atgggcggcctgctgctggccgccttcctggccctggtgagcgtgcccagagcccaggccgtgtggctgggcagactggaccccgagcagctgctgggcccctggtacgtgctggccgtggccagcagagagaagggcttcgccatggagaaggacatgaagaacgtggtgggcgtggtggtgaccctgacccccgagaacaacctgagaaccctgagcagccagcacggcctgggcggctgcgaccagagcgtgatggacctgatcaagagaaacagcggctgggtgttcgagaaccccagcatcggcgtgctggagctgtgggtgctggccaccaacttcagagactacgccatcatcttcacccagctggagttcggcgacgagcccttcaacaccgtggagctgtacagcctgaccgagaccgccagccaggaggccatgggcctgttcaccaagtggagcagaagcctgggcttcctgagccagtag

SEQ ID NO: 87264 - DNA, 459 bp, Artificial Sequence
  Description of Artificial Sequence: Synthetic coding sequence
atggaggagctggacagacagaagatcggcggcttctggagagaggtgggcgtggccagcgaccagagcctggtgctgaccgcccccaagagagtggagggcctgttcctgaccctgagcggcagcaacctgaccgtgaaggtggcctacaacagcagcggcagctgcgagatcgagaagatcgtgggcagcgagatcgacagcaccggcaagttcgccttccccggccacagagagatccacgtgctggacaccgactacgagggctacgccatcctgagagtgagcctgatgtggagaggcagaaacttcagagtgctgaagtacttcaccagaagcctggaggacaaggacagactgggcttctggaagttcagagagctgaccgccgacaccggcctgtacctggccgccagacccggcagatgcgccgagctgctgaaggaggagctgatctag

SEQ ID NO: 87265 - DNA, 531 bp, Artificial Sequence
  Description of Artificial Sequence: Synthetic coding sequence
atggccctgctgctgctgagcctgggcctgagcctgatcgccgcccaggagttcgacccccacaccgtgatgcagagaaactacaacgtggccagagtgagcggcgtgtggtacagcatcttcatggccagcgacgacctgaacagaatcaaggagaacggcgacctgagagtgttcgtgagaaacatcgagcacctgaagaacggcagcctgatcttcgacttcgagtacatggtgcagggcgagtgcgtggccgtggtggtggtgtgcgagaagaccgagaagaacggcgagtacagcatcaactacgagggccagaacaccgtggccgtgagcgagaccgactacagactgttcatcaccttccacctgcagaacttcagaaacggcaccgagacccacaccctggccctgtacgagacctgcgagaagtacggcctgggcagccagaacatcatcgacctgaccaacaaggacccctgctacagcaagcactacagaagcccccccagaccccccatgagatggtag

SEQ ID NO: 87266 - DNA, 1119 bp, Artificial Sequence
  Description of Artificial Sequence: Synthetic coding sequence
atgagcctgagatgcggcgacgccgccagaaccctgggccccagagtgttcggcagatacttctgcagccccgtgagacccctgagcagcctgcccgacaagaagaaggagctgctgcagaacggccccgacctgcaggacttcgtgagcggcgacctggccgacagaagcacctgggacgagtacaagggcaacctgaagagacagaagggcgagagactgagactgcccccctggctgaagaccgagatccccatgggcaagaactacaacaagctgaagaacaccctgagaaacctgaacctgcacaccgtgtgcgaggaggccagatgccccaacatcggcgagtgctggggcggcggcgagtacgccaccgccaccgccaccatcatgctgatgggcgacacctgcaccagaggctgcagattctgcagcgtgaagaccgccagaaaccccccccccctggacgccagcgagccctacaacaccgccaaggccatcgccgagtggggcctggactacgtggtgctgaccagcgtggacagagacgacatgcccgacggcggcgccgagcacatcgccaagaccgtgagctacctgaaggagagaaaccccaagatcctggtggagtgcctgacccccgacttcagaggcgacctgaaggccatcgagaaggtggccctgagcggcctggacgtgtacgcccacaacgtggagaccgtgcccgagctgcagagcaaggtgagagaccccagagccaacttcgaccagagcctgagagtgctgaagcacgccaagaaggtgcagcccgacgtgatcagcaagaccagcatcatgctgggcctgggcgagaacgacgagcaggtgtacgccaccatgaaggccctgagagaggccgacgtggactgcctgaccctgggccagtacatgcagcccaccagaagacacctgaaggtggaggagtacatcacccccgagaagttcaagtactgggagaaggtgggcaacgagctgggcttccactacaccgccagcggccccctggtgagaagcagctacaaggccggcgagttcttcctgaagaacctggtggccaagagaaagaccaaggacctgtag

SEQ ID NO: 87267 - DNA, 969 bp, Artificial Sequence
  Description of Artificial Sequence: Synthetic coding sequence
atgagcctgagatgcggcgacgccgccagaaccctgggccccagagtgttcggcagatacttctgcagccccgtgagacccctgagcagcctgcccgacaagaagaaggagctgctgcagaacggccccgacctgcaggacttcgtgagcggcgacctggccgacagaagcacctgggacgagtacaagggcaacctgaagagacagaagggcgagagactgagactgcccccctggctgaagaccgagatccccatgggcaagaactacaacaagctgaagaacaccctgagaaacctgaacctgcacaccgtgtgcgaggaggccagatgccccaacatcggcgagtgctggggcggcggcgagtacgccaccgccaccgccaccatcatgctgatgggcgacacctgcaccagaggctgcagattctgcagcgtgaagaccgccagaaaccccccccccctggacgccagcgagccctacaacaccgccaaggccatcgccgagtggggcctggactacgtggtgctgaccagcgtggacagagacgacatgcccgacggcggcgccgagcacatcgccaagaccgtgagctacctgaaggagagaaaccccaagatcctggtggagtgcctgacccccgacttcagaggcgacctgaaggccatcgagaaggtggccctgagcggcctggacgtgtacgcccacaacgtggagaccgtgcccgagctgcagagcaaggtgagagaccccagagccaacttcgaccagagcctgagagtgctgaagcacgccaagaaggtgcagcccgacgtgatcagcaagaccagcatcatgctgggcctgggcgagaacgacgagcaggtgtacgccaccatgaaggccctgagagaggccgacgtggactgcctgaccctgggccagtacatgcagcccaccagaagacacctgaaggtgaacttcagctag

SEQ ID NO: 87268 - DNA, 603 bp, Artificial Sequence
  Description of Artificial Sequence: Synthetic coding sequence
atggccagcagcctgacctgcaccggcgtgatctgggccctgctgagcttcctgtgcgccgccaccagctgcgtgggcttcttcatgccctactggctgtggggcagccagctgggcaagcccgtgagcttcggcaccttcagaagatgcagctaccccgtgcacgacgagagcagacagatgatggtgatggtggaggagtgcggcagatacgccagcttccagggcatccccagcgccgagtggagaatctgcaccatcgtgaccggcctgggctgcggcctgctgctgctggtggccctgaccgccctgatgggctgctgcgtgagcgacctgatcagcagaaccgtgggcagagtggccggcggcatccagttcctgggcggcctgctgatcggcgccggctgcgccctgtaccccctgggctgggacagcgaggaggtgagacagacctgcggctacaccagcggccagttcgacctgggcaagtgcgagatcggctgggcctactactgcaccggcgccggcgccaccgccgccatgctgctgtgcacctggctggcctgcttcagcggcaagaagcagaagcactacccctactag

SEQ ID NO: 87269 - DNA, 663 bp, Artificial Sequence
  Description of Artificial Sequence: Synthetic coding sequence
atgagaagcagcctgaccatggtgggcaccctgtgggccttcctgagcctggtgaccgccgtgaccagcagcaccagctacttcctgccctactggctgttcggcagccagatgggcaagcccgtgagcttcagcaccttcagaagatgcaactaccccgtgagaggcgagggccacagcctgatcatggtggaggagtgcggcagatacgccagcttcaacgccatccccagcctggcctggcagatgtgcaccgtggtgaccggcgccggctgcgccctgctgctgctggtggccctggccgccgtgctgggctgctgcatggaggagctgatcagcagaatgatgggcagatgcatgggcgccgcccagttcgtgggcggcctgctgatcagcagcggctgcgccctgtaccccctgggctggaacagccccgagatcatgcagacctgcggcaacgtgagcaaccagttccagctgggcacctgcagactgggctgggcctactactgcgccggcggcggcgccgccgccgccatgctgatctgcacctggctgagctgcttcgccggcagaaaccccaagcccgtgatcctggtggagagcatcatgagaaacaccaacagctacgccatggagctggaccactgcctgaagccctag

SEQ ID NO: 87270 - DNA, 564 bp, Artificial Sequence
  Description of Artificial Sequence: Synthetic coding sequence
atgagaagcagcctgaccatggtgggcaccctgtgggccttcctgagcctggtgaccgccgtgaccagcagcaccagctacttcctgccctactggctgttcggcagccagatgggcaagcccgtgagcttcagcaccttcagaagatgcaactaccccgtgagaggcgagggccacagcctgatcatggtggaggagtgcggcagatacgccagcttcaacgccatccccagcctggcctggcagatgtgcaccgtggtgaccggcgccggctgcgccctgctgctgctggtggccctggccgccgtgctgggctgctgcatggaggagctgatcagcagaatgatgggcagatgcatgggcgccgcccagttcgtgggcggcacctgcagactgggctgggcctactactgcgccggcggcggcgccgccgccgccatgctgatctgcacctggctgagctgcttcgccggcagaaaccccaagcccgtgatcctggtggagagcatcatgagaaacaccaacagctacgccatggagctggaccactgcctgaagccctag

SEQ ID NO: 87271 - DNA, 687 bp, Artificial Sequence
  Description of Artificial Sequence: Synthetic coding sequence
atgtgccacgtgatcgtgacctgcagaagcatgctgtggaccctgctgagcatcgtggtggccttcgccgagctgatcgccttcatgagcgccgactggctgatcggcaaggccagaagcagaggcggcgtggagcccgccggccccggcggcggcagccccgagccctaccaccccaccctgggcatctacgccagatgcatcagaaaccccggcgtgcagcacttccagagagacaccctgtgcggcccctacgccgagagcttcggcgagatcgccagcggcttctggcaggccaccgccatcttcctggccgtgggcatcttcatcctgtgcatggtggccctggtgagcgtgttcaccatgtgcgtgcagagcatcatgaagaagagcatcttcaacgtgtgcggcctgctgcagggcatcgccggcctgttcctgatcctgggcctgatcctgtaccccgccggctggggctgccagaaggccatcgactactgcggccactacgccagcgcctacaagcccggcgactgcagcctgggctgggccttctacaccgccatcggcggcaccgtgctgaccttcatctgcgccgtgttcagcgcccaggccgagatcgccaccagcagcgacaaggtgcaggaggagatcgaggagggcaagaacctgatctgcctgctgtag

SEQ ID NO: 87272 - DNA, 687 bp, Artificial Sequence; identical to SEQ ID NO: 87271
  Description of Artificial Sequence: Synthetic coding sequence

SEQ ID NO: 87273 - DNA, 669 bp, Artificial Sequence
  Description of Artificial Sequence: Synthetic coding sequence
atgctgcccgcccaggaggccgccaagctgtaccacaccaactacgtgagaaacagcagagccatcggcgtgctgtgggccatcttcaccatctgcttcgccatcgtgaacgtggtgtgcttcatccagccctactggatcggcgacggcgtggacaccccccaggccggctacttcggcctgttccactactgcatcggcaacggcttcagcagagagctgacctgcagaggcagcttcaccgacttcagcaccctgcccagcggcgccttcaaggccgccagcttcttcatcggcctgagcatgatgctgatcatcgcctgcatcatctgcttcaccctgttcttcttctgcaacaccgccaccgtgtacaagatctgcgcctggatgcagctgaccagcgccgcctgcctggtgctgggctgcatgatcttccccgacggctgggacagcgacgaggtgaagagaatgtgcggcgagaagaccgacaagtacaccctgggcgcctgcagcgtgagatgggcctacatcctggccatcatcggcatcctggacgccctgatcctgagcttcctggccttcgtgctgggcaacagacaggacagcctgatggccgaggagctgaaggccgagaacaaggtgctgctgagccagtacagcctggagtag

SEQ ID NO: 87274 - DNA, 711 bp, Artificial Sequence
  Description of Artificial Sequence: Synthetic coding sequence
atgcccggcgccgccgccgccgccgccgccgccgccgccgccatgctgcccgcccaggaggccgccaagctgtaccacaccaactacgtgagaaacagcagagccatcggcgtgctgtgggccatcttcaccatctgcttcgccatcgtgaacgtggtgtgcttcatccagccctactggatcggcgacggcgtggacaccccccaggccggctacttcggcctgttccactactgcatcggcaacggcttcagcagagagctgacctgcagaggcagcttcaccgacttcagcaccctgcccagcggcgccttcaaggccgccagcttcttcatcggcctgagcatgatgctgatcatcgcctgcatcatctgcttcaccctgttcttcttctgcaacaccgccaccgtgtacaagatctgcgcctggatgcagctgaccagcggcgactgcctggtgctgttcgacctgcacttccccgacggctgggacagcgacgaggtgaagagaatgtgcggcgagaagaccgacaagtacaccctgggcgcctgcagcgtgagatgggcctacatcctggccatcatcggcatcctggacgccctgatcctgagcttcctggccttcgtgctgggcaacagacaggacagcctgatggccgaggagctgaaggccgagaacaaggtgctgctgagccagtacagcctggagtag

SEQ ID NO: 87275 - DNA, 699 bp, Artificial Sequence
  Description of Artificial Sequence: Synthetic coding sequence
atgcccggcgccgccgccgccgccgccgccgccgccgccgccatgctgcccgcccaggaggccgccaagctgtaccacaccaactacgtgagaaacagcagagccatcggcgtgctgtgggccatcttcaccatctgcttcgccatcgtgaacgtggtgtgcttcatccagccctactggatcggcgacggcgtggacaccccccaggccggctacttcggcctgttccactactgcatcggcaacggcttcagcagagagctgacctgcagaggcagcttcaccgacttcagcaccctgcccagcggcgccttcaaggccgccagcttcttcatcggcctgagcatgatgctgatcatcgcctgcatcatctgcttcaccctgttcttcttctgcaacaccgccaccgtgtacaagatctgcgcctggatgcagctgaccagcggcgactgcctggtgctgttcgacctgcacttccccgacggctgggacagcgacgaggtgaagagaatgtgcggcgagaagaccgacaagtacaccctgggcgcctgcagcgtgagatgggcctacatcctggccatcatcggcatcctggacgccctgatcctgagcttcctggccttcgtgctgggcaacagacaggacagcctgatggccgaggagctgaaggccgagaacaaggacgacggcaacgcctag

SEQ ID NO: 87276 - DNA, 660 bp, Artificial Sequence
  Description of Artificial Sequence: Synthetic coding sequence
atggtgaagctgctgcccgcccaggaggccgccaagatctaccacaccaactacgtgagaaacagcagagccgtgggcgtgatgtggggcaccctgaccatctgcttcagcgtgctggtgatggccctgttcatccagccctactggatcggcgacagcgtgaacaccccccaggccggctacttcggcctgttcagctactgcgtgggcaacgtgctgagcagcgagctgatctgcaagggcggccccctggacttcagcagcatccccagcagagccttcaagaccgccatgttcttcgtggccctgggcatgttcctgatcatcggcagcatcatctgcttcagcctgttcttcatctgcaacaccgccaccgtgtacaagatctgcgcctggatgcagctggccgccgccaccggcctgatgatcggctgcctggtgtaccccgacggctgggacagcagcgaggtgagaagaatgtgcggcgagcagaccggcaagtacaccctgggccactgcaccatcagatgggccttcatgctggccatcctgagcatcggcgacgccctgatcctgagcttcctggccttcgtgctgggctacagacaggacaagctgctgcccgacgactacaaggccgacggcaccgaggaggtgtag

SEQ ID NO: 87277 - DNA, 660 bp, Artificial Sequence; identical to SEQ ID NO: 87276
  Description of Artificial Sequence: Synthetic coding sequence

SEQ ID NO: 87278 - DNA, 675 bp, Artificial Sequence
  Description of Artificial Sequence: Synthetic coding sequence
atgagcgtgttcggcaagctgttcggcgccggcggcggcaaggccggcaagggcggccccaccccccaggaggccatccagagactgagagacaccgaggagatgctgagcaagaagcaggagttcctggagaagaagatcgagcaggagctgaccgccgccaagaagcacggcaccaagaacaagagagccgccctgcaggccctgaagagaaagaagagatacgagaagcagctggcccagatcgacggcaccctgagcaccatcgagttccagagagaggccctggagaacgccaacaccaacaccgaggtgctgaagaacatgggctacgccgccaaggccatgaaggccgcccacgacaacatggacatcgacaaggtggacgagctgatgcaggacatcgccgaccagcaggagctggccgaggagatcagcaccgccatcagcaagcccgtgggcttcggcgaggagttcgacgaggacgagctgatggccgagctggaggagctggagcaggaggagctggacaagaacctgctggagatcagcggccccgagaccgtgcccctgcccaacgtgcccagcatcgccctgcccagcaagcccgccaagaagaaggaggaggaggacgacgacatgaaggagctggagaactgggccggcagcatgtag

SEQ ID NO: 87279 - DNA, 1434 bp, Artificial Sequence
  Description of Artificial Sequence: Synthetic coding sequence
atgggcgccctggccagagccctgcccagcatcctgctggccctgctgctgaccagcacccccgaggccctgggcgccaaccccggcctggtggccagaatcaccgacaagggcctgcagtacgccgcccaggagggcctgctggccctgcagagcgagctgctgagaatcaccctgcccgacttcaccggcgacctgagaatcccccacgtgggcagaggcagatacgagttccacagcctgaacatccacagctgcgagctgctgcacagcgccctgagacccgtgcccggccagggcctgagcctgagcatcagcgacagcagcatcagagtgcagggcagatggaaggtgagaaagagcttcttcaagctgcagggcagcttcgacgtgagcgtgaagggcatcagcatcagcgtgaacctgctgctgggcagcgagagcagcggcagacccaccgtgaccgccagcagctgcagcagcgacatcgccgacgtggaggtggacatgagcggcgacctgggctggctgctgaacctgttccacaaccagatcgagagcaagttccagaaggtgctggagagcagaatctgcgagatgatccagaagagcgtgagcagcgacctgcagccctacctgcagaccctgcccgtgaccaccgagatcgacagcttcgccgacatcgactacagcctggtggaggcccccagagccaccgcccagatgctggaggtgatgttcaagggcgagatcttccacagaaaccacagaagccccgtgaccctgctggccgccgtgatgagcctgcccgaggagcacaacaagatggtgtacttcgccatcagcgactacgtgttcaacaccgccagcctggtgtaccacgaggagggctacctgaacttcagcatcaccgacgacatgatcccccccgacagcaacatcagactgaccaccaagagcttcagacccttcgtgcccagactggccagactgtaccccaacatgaacctggagctgcagggcagcgtgcccagcgcccccctgctgaacttcagccccggcaacctgagcgtggacccctacatggagatcgacgccttcgtgctgctgcccagcagcagcaaggagcccgtgttcagactgagcgtggccaccaacgtgagcgccaccctgaccttcaacaccagcaagatcaccggcttcctgaagcccggcaaggtgaaggtggagctgaaggagagcaaggtgggcctgttcaacgccgagctgctggaggccctgctgaactactacatcctgaacaccttctaccccaagttcaacgacaagctggccgagggcttccccctgcccctgctgaagagagtgcagctgtacgacctgggcctgcagatccacaaggacttccccagcagaagagaccaccccccctag

SEQ ID NO: 87280 - DNA, 486 bp, Artificial Sequence
  Description of Artificial Sequence: Synthetic coding sequence
atgagcgtgcccggcccctaccaggccgccaccggccccagcagcgcccccagcgccccccccagctacgaggagaccgtggccgtgaacagctactaccccaccccccccgcccccatgcccggccccaccaccggcctggtgaccggccccgacggcaagggcatgaacccccccagctactacacccagcccgcccccatccccaacaacaaccccatcaccgtgcagaccgtgtacgtgcagcaccccatcaccttcctggacagacccatccagatgtgctgccccagctgcaacaagatgatcgtgagccagctgagctacaacgccggcgccctgacctggctgagctgcggcagcctgtgcctgctgggctgcatcgccggctgctgcttcatccccttctgcgtggacgccctgcaggacgtggaccactactgccccaactgcagagccctgctgggcacctacaagagactgtag

SEQ ID NO: 87281 - DNA, 687 bp, Artificial Sequence
  Description of Artificial Sequence: Synthetic coding sequence
atgagcgtgcccggcccctaccaggccgccaccggccccagcagcgcccccagcgccccccccagctacgaggagaccgtggccgtgaacagctactaccccaccccccccgcccccatgcccggccccaccaccggcctggtgaccggccccgacggcaagggcatgaacccccccagctactacacccagcccgcccccatccccaacaacaaccccatcaccgtgcagaccgtgtacgtgcagcaccccatcaccttcctggacagacccatccagatgtgctgccccagctgcaacaagatgatcgtgagccagctgagctacaacgccggcgccctgacctggctgagctgcggcagcctgtgcctgctgggcgtgcacagcggcctgctgctgcaccccctgctgagaggctgccccgccggcagaggccccctgctgagccagctgcagagcagccccggccacctgcaggccttcgtgggcctgagccagacctggagagagcccggcgccgccggcagccccttccacctgagcagcagcttcacccccggcggcggcagcgccctggtggtgagccccctgcagggcgcccacctgcacgtgttcttctggggcgagtacgtggccaagctgaccaacctgcagacccccgagatcgccgcctggagcagagcctag

SEQ ID NO: 87282 - DNA, 459 bp, Artificial Sequence
  Description of Artificial Sequence: Synthetic coding sequence
atgagcgtgcccggcccctaccaggccgccaccggccccagcagcgcccccagcgccccccccagctacgaggagaccgtggccgtgaacagctactaccccaccccccccgcccccatgcccggccccaccaccggcctggtgaccggccccgacggcaagggcatgaacccccccagctactacacccagcccgcccccatccccaacaacaaccccatcaccgtgcagaccgtgtacgtgcagcaccccatcaccttcctggacagacccatccagatgtgctgccccagctgcaacaagatgatcgtgagccagctgagctacaacgccggcgccctgacctggctgagctgcggcagcctgtgcctgctgggccaggagtgcagcggcaccatcgtggccctgagaagcttcgacctgctgggcagctgcaacccccccagcagcgccagctag

SEQ ID NO: 87283 - DNA, 486 bp, Artificial Sequence; identical to SEQ ID NO: 87280
  Description of Artificial Sequence: Synthetic coding sequence

SEQ ID NO: 87284 - DNA, 6123 bp, Artificial Sequence
  Description of Artificial Sequence: Synthetic coding sequence
atggagcacaaggaggtggtgctgctgctgctgctgttcctgaagagcgccgcccccgagcagagccacgtggtgcaggactgctaccacggcgacggccagagctacagaggcacctacagcaccaccgtgaccggcagaacctgccaggcctggagcagcatgaccccccaccagcacaacagaaccaccgagaactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgacgccgtggccgccccctactgctacaccagagaccccggcgtgagatgggagtactgcaacctgacccagtgcagcgacgccgagggcaccgccgtggccccccccaccgtgacccccgtgcccagcctggaggcccccagcgagcaggcccccaccgagcagagacccggcgtgcaggagtgctaccacggcaacggccagagctacagaggcacctacagcaccaccgtgaccggcagaacctgccaggcctggagcagcatgaccccccacagccacagcagaacccccgagtactaccccaacgccggcctgatcatgaactactgcagaaaccccgaccccgtggccgccccctactgctacaccagagaccccagcgtgagatgggagtactgcaacctgacccagtgcagcgacgccgagggcaccgccgtggccccccccaccatcacccccatccccagcctggaggcccccagcgagcaggcccccaccgagcagagacccggcgtgcaggagtgctaccacggcaacggccagagctaccagggcacctacttcatcaccgtgaccggcagaacctgccaggcctggagcagcatgaccccccacagccacagcagaacccccgcctactaccccaacgccggcctgatcaagaactactgcagaaaccccgaccccgtggccgccccctggtgctacaccaccgaccccagcgtgagatgggagtactgcaacctgaccagatgcagcgacgccgagtggaccgccttcgtgccccccaacgtgatcctggcccccagcctggaggccttcttcgagcaggccctgaccgaggagacccccggcgtgcaggactgctactaccactacggccagagctacagaggcacctacagcaccaccgtgaccggcagaacctgccaggcctggagcagcatgaccccccaccagcacagcagaacccccgagaactaccccaacgccggcctgaccagaaactactgcagaaaccccgacgccgagatcagaccctggtgctacaccatggaccccagcgtgagatgggagtactgcaacctgacccagtgcctggtgaccgagagcagcgtgctggccaccctgaccgtggtgcccgaccccagcaccgaggccagcagcgaggaggcccccaccgagcagagccccggcgtgcaggactgctaccacggcgacggccagagctacagaggcagcttcagcaccaccgtgaccggcagaacctgccagagctggagcagcatgaccccccactggcaccagagaaccaccgagtactaccccaacggcggcctgaccagaaactactgcagaaaccccgacgccgagatcagcccctggtgctacaccatggaccccaacgtgagatgggagtactgcaacctgacccagtgccccgtgaccgagagcagcgtgctggccaccagcaccgccgtgagcgagcaggcccccaccgagcagagccccaccgtgcaggactgctaccacggcgacggccagagctacagaggcagcttcagcaccaccgtgaccggcagaacctgccagagctggagcagcatgaccccccactggcaccagagaaccaccgagtactaccccaacggcggcctgaccagaaactactgcagaaaccccgacgccgagatcagaccctggtgctacaccatggaccccagcgtgagatgggagtactgcaacctgacccagtgccccgtgatggagagcaccctgctgaccacccccaccgtggtgcccgtgcccagcaccgagctgcccagcgaggaggcccccaccgagaacagcaccggcgtgcaggactgctacagaggcgacggccagagctacagaggcaccctgagcaccaccatcaccggcagaacctgccagagctggagcagcatgaccccccactggcacagaagaatccccctgtactaccccaacgccggcctgaccagaaactactgcagaaaccccgacgccgagatcagaccctggtgctacaccatggaccccagcgtgagatgggagtactgcaacctgaccagatgccccgtgaccgagagcagcgtgctgaccacccccaccgtggcccccgtgcccagcaccgaggcccccagcgagcaggccccccccgagaagagccccgtggtgcaggactgctaccacggcgacggcagaagctacagaggcatcagcagcaccaccgtgaccggcagaacctgccagagctggagcagcatgatcccccactggcaccagagaacccccgagaactaccccaacgccggcctgaccgagaactactgcagaaaccccgacagcggcaagcagccctggtgctacaccaccgacccctgcgtgagatgggagtactgcaacctgacccagtgcagcgagaccgagagcggcgtgctggagacccccaccgtggtgcccgtgcccagcatggaggcccacagcgaggccgcccccaccgagcagacccccgtggtgagacagtgctaccacggcaacggccagagctacagaggcaccttcagcaccaccgtgaccggcagaacctgccagagctggagcagcatgaccccccacagacaccagagaacccccgagaactaccccaacgacggcctgaccatgaactactgcagaaaccccgacgccgacaccggcccctggtgcttcaccatggaccccagcatcagatgggagtactgcaacctgaccagatgcagcgacaccgagggcaccgtggtggccccccccaccgtgatccaggtgcccagcctgggcccccccagcgagcaggactgcatgttcggcaacggcaagggctacagaggcaagaaggccaccaccgtgaccggcaccccctgccaggagtgggccgcccaggagccccacagacacagcaccttcatccccggcaccaacaagtgggccggcctggagaagaactactgcagaaaccccgacggcgacatcaacggcccctggtgctacaccatgaaccccagaaagctgttcgactactgcgacatccccctgtgcgccagcagcagcttcgactgcggcaagccccaggtggagcccaagaagtgccccggcagcatcgtgggcggctgcgtggcccacccccacagctggccctggcaggtgagcctgagaaccagattcggcaagcacttctgcggcggcaccctgatcagccccgagtgggtgctgaccgccgcccactgcctgaagaagagcagcagacccagcagctacaaggtgatcctgggcgcccaccaggaggtgaacctggagagccacgtgcaggagatcgaggtgagcagactgttcctggagcccacccaggccgacatcgccctgctgaagctgagcagacccgccgtgatcaccgacaaggtgatgcccgcctgcctgcccagccccgactacatggtgaccgccagaaccgagtgctacatcaccggctggggcgagacccagggcaccttcggcaccggcctgctgaaggaggcccagctgctggtgatcgagaacgaggtgtgcaaccactacaagtacatctgcgccgagcacctggccagaggcaccgacagctgccagggcgacagcggcggccccctggtgtgcttcgagaaggacaagtacatcctgcagggcgtgaccagctggggcctgggctgcgccagacccaacaagcccggcgtgtacgccagagtgagcagattcgtgacctggatcgagggcatgatgagaaacaactag

SEQ ID NO: 87285 - DNA, 6123 bp, Artificial Sequence; identical to SEQ ID NO: 87284
  Description of Artificial Sequence: Synthetic coding sequence

SEQ ID NO: 87286 - DNA, 4602 bp, Artificial Sequence
  Description of Artificial Sequence: Synthetic coding sequence
atgatgcagctgaccctgaacaccctgttccccgtggtgagcacccccgccatcacctacatcgtgaccgtgttcaccggcgacgtgagaggcgccggcaccaagagcaagatctacctggtgatgtacggcgccagaggcaacaagaacagcggcaagatcttcctggagggcggcgtgttcgacagaggcagaaccgacatcttccacatcgagctggccgtgctgctgagccccctgagcagagtgagcgtgggccacggcaacgtgggcgtgaacagaggctggttctgcgagaaggtggtgatcctgtgccccttcaccggcatccagcagaccttcccctgcagcaactggctggacgagaagaaggccgacggcctgatcgagagacagctgtacgagatggtgagcctgagaaagaagagactgaagaagttcccctggagcctgtgggtgtggaccaccgacctgaagaaggccggcaccaacagccccatcttcatccagatctacggccagaagggcagaaccgacgagatcctgctgaaccccaacaacaagtggttcaagcccggcatcatcgagaagttcagaatcgagctgcccgacctgggcagattctacaagatcagagtgtggcacgacaagagaagcagcggcagcggctggcacctggagagaatgaccctgatgaacaccctgaacaaggacaagtacaacttcaactgcaacagatggctggacgccaacgaggacgacaacgagatcgtgagagagatgaccgccgagggccccaccgtgagaagaatcatgggcatggccagataccacgtgaccgtgtgcaccggcgagctggagggcgccggcaccgacgccaacgtgtacctgtgcctgttcggcgacgtgggcgacaccggcgagagactgctgtacaactgcagaaacaacaccgacctgttcgagaagggcaacgccgacgagttcaccatcgagagcgtgaccatgagaaacgtgagaagagtgagaatcagacacgacggcaagggcagcggcagcggctggtacctggacagagtgctggtgagagaggagggccagcccgagagcgacaacgtggagttcccctgcctgagatggctggacaaggacaaggacgacggccagctggtgagagagctgctgcccagcgacagcagcgccaccctgaagaacttcagataccacatcagcctgaagaccggcgacgtgagcggcgccagcaccgacagcagagtgtacatcaagctgtacggcgacaagagcgacaccatcaagcaggtgctgctggtgagcgacaacaacctgaaggactacttcgagagaggcagagtggacgagttcaccctggagaccctgaacatcggcaacatcaacagactggtgatcggccacgacagcaccggcatgcacgccagctggttcctgggcagcgtgcagatcagagtgcccagacagggcaagcagtacaccttccccgccaacagatggctggacaagaaccaggccgacggcagactggaggtggagctgtaccccagcgaggtggtggagatccagaagctggtgcactacgaggtggagatctggaccggcgacgtgggcggcgccggcaccagcgccagagtgtacatgcagatctacggcgagaagggcaagaccgaggtgctgttcctgagcagcagaagcaaggtgttcgagagagccagcaaggacaccttccagctggaggccgccgacgtgggcgaggtgtacaagctgagactgggccacaccggcgagggcttcggccccagctggttcgtggacaccgtgtggctgagacacctggtggtgagagaggtggacctgacccccgaggaggaggccagaaagaagaaggagaaggacaagctgagacagctgctgaagaaggagagactgaaggccaagctgcagagaaagaagaagaagagaaagggcagcgacgaggaggacgagggcgaggaggaggagagcagcagcagcgaggagagcagcagcgaggaggaggagatggaggaggaggaggaggaggaggagttcggccccggcatgcaggaggtgatcgagcagcacaagttcgaggcccacagatggctggccagaggcaaggaggacaacgagctggtggtggagctggtgcccgccggcaagcccggccccgagagaaacacctacgaggtgcaggtggtgaccggcaacgtgcccaaggccggcaccgacgccaacgtgtacctgaccatctacggcgaggagtacggcgacaccggcgagagacccctgaagaagagcgacaagagcaacaagttcgagcagggccagaccgacaccttcaccatctacgccatcgacctgggcgccctgaccaagatcagaatcagacacgacaacaccggcaacagagccggctggttcctggacagaatcgacatcaccgacatgaacaacgagatcacctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggacggcgccgagaccctgaccttcccctgcgacagatggctggccaccagcgaggacgacaagaagaccatcagagagctggtgccctacgacatcttcaccgagaagtacatgaaggacggcagcctgagacaggtgtacaaggaggtggaggagcccctggacatcgtgctgtacagcgtgcagatcttcaccggcaacatccccggcgccggcaccgacgccaaggtgtacatcaccatctacggcgacctgggcgacaccggcgagagatacctgggcaagagcgagaacagaaccaacaagttcgagagaggcaccgccgacaccttcatcatcgaggccgccgacctgggcgtgatctacaagatcaagctgagacacgacaacagcaagtggtgcgccgactggtacgtggagaaggtggagatctggaacgacaccaacgaggacgagttcctgttcctgtgcggcagatggctgagcctgaagaaggaggacggcagactggagagactgttctacgagaaggagtacaccggcgacagaagcagcaactgcagcagccccgccgacttctgggagatcgccctgagcagcaagatggccgacgtggacatcagcaccgtgaccggccccatggccgactacgtgcaggagggccccatcatcccctactacgtgagcgtgaccaccggcaagcacaaggacgccgccaccgacagcagagccttcatcttcctgatcggcgaggacgacgagagaagcaagagaatctggctggactaccccagaggcaagagaggcttcagcagaggcagcgtggaggagttctacgtggccggcctggacgtgggcatcatcaagaagatcgaggtgctgtacgagatgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagagtgaagtgcctggacccccacagcagcttccagcccccccccacccccagccccggcagcagcggcctgagcatggacctggtgaaggcccagatgagcctgtag

SEQ ID NO: 87287 - DNA, 5844 bp, Artificial Sequence
  Description of Artificial Sequence: Synthetic coding sequence
atgatgcagctgaccctgaacaccctgttccccgtggtgagcacccccgccatcacctacatcgtgaccgtgttcaccggcgacgtgagaggcgccggcaccaagagcaagatctacctggtgatgtacggcgccagaggcaacaagaacagcggcaagatcttcctggagggcggcgtgttcgacagaggcagaaccgacatcttccacatcgagctggccgtgctgctgagccccctgagcagagtgagcgtgggccacggcaacgtgggcgtgaacagaggctggttctgcgagaaggtggtgatcctgtgccccttcaccggcatccagcagaccttcccctgcagcaactggctggacgagaagaaggccgacggcctgatcgagagacagctgtacgagatggtgagcctgagaaagaagagactgaagaagttcccctggagcctgtgggtgtggaccaccgacctgaagaaggccggcaccaacagccccatcttcatccagatctacggccagaagggcagaaccgacgagatcctgctgaaccccaacaacaagtggttcaagcccggcatcatcgagaagttcagaatcgagctgcccgacctgggcagattctacaagatcagagtgtggcacgacaagagaagcagcggcagcggctggcacctggagagaatgaccctgatgaacaccctgaacaaggacaagtacaacttcaactgcaacagatggctggacgccaacgaggacgacaacgagatcgtgagagagatgaccgccgagggccccaccgtgagaagaatcatgggcatggccagataccacgtgaccgtgtgcaccggcgagctggagggcgccggcaccgacgccaacgtgtacctgtgcctgttcggcgacgtgggcgacaccggcgagagactgctgtacaactgcagaaacaacaccgacctgttcgagaagggcaacgccgacgagttcaccatcgagagcgtgaccatgagaaacgtgagaagagtgagaatcagacacgacggcaagggcagcggcagcggctggtacctggacagagtgctggtgagagaggagggccagcccgagagcgacaacgtggagttcccctgcctgagatggctggacaaggacaaggacgacggccagctggtgagagagctgctgcccagcgacagcagcgccaccctgaagaacttcagataccacatcagcctgaagaccggcgacgtgagcggcgccagcaccgacagcagagtgtacatcaagctgtacggcgacaagagcgacaccatcaagcaggtgctgctggtgagcgacaacaacctgaaggactacttcgagagaggcagagtggacgagttcaccctggagaccctgaacatcggcaacatcaacagactggtgatcggccacgacagcaccggcatgcacgccagctggttcctgggcagcgtgcagatcagagtgcccagacagggcaagcagtacaccttccccgccaacagatggctggacaagaaccaggccgacggcagactggaggtggagctgtaccccagcgaggtggtggagatccagaagctggtgcactacgaggtggagatctggaccggcgacgtgggcggcgccggcaccagcgccagagtgtacatgcagatctacggcgagaagggcaagaccgaggtgctgttcctgagcagcagaagcaaggtgttcgagagagccagcaaggacaccttccagctggaggccgccgacgtgggcgaggtgtacaagctgagactgggccacaccggcgagggcttcggccccagctggttcgtggacaccgtgtggctgagacacctggtggtgagagaggtggacctgacccccgaggaggaggccagaaagaagaaggagaaggacaagctgagacagctgctgaagaaggagagactgaaggccaagctgcagagaaagaagaagaagagaaagggcagcgacgaggaggacgagggcgaggaggaggagagcagcagcagcgaggagagcagcagcgaggaggaggagatggaggaggaggaggaggaggaggagttcggccccggcatgcaggaggtgatcgagcagcacaagttcgaggcccacagatggctggccagaggcaaggaggacaacgagctggtggtggagctggtgcccgccggcaagcccggccccgagagaaacacctacgaggtgcaggtggtgaccggcaacgtgcccaaggccggcaccgacgccaacgtgtacctgaccatctacggcgaggagtacggcgacaccggcgagagacccctgaagaagagcgacaagagcaacaagttcgagcagggccagaccgacaccttcaccatctacgccatcgacctgggcgccctgaccaagatcagaatcagacacgacaacaccggcaacagagccggctggttcctggacagaatcgacatcaccgacatgaacaacgagatcacctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggacggcgccgagaccctgaccttcccctgcgacagatggctggccaccagcgaggacgacaagaagaccatcagagagctggtgccctacgacatcttcaccgagaagtacatgaaggacggcagcctgagacaggtgtacaaggaggtggaggagcccctggacatcgtgctgtacagcgtgcagatcttcaccggcaacatccccggcgccggcaccgacgccaaggtgtacatcaccatctacggcgacctgggcgacaccggcgagagatacctgggcaagagcgagaacagaaccaacaagttcgagagaggcaccgccgacaccttcatcatcgaggccgccgacctgggcgtgatctacaagatcaagctgagacacgacaacagcaagtggtgcgccgactggtacgtggagaaggtggagatctggaacgacaccaacgaggacgagttcctgttcctgtgcggcagatggctgagcctgaagaaggaggacggcagactggagagactgttctacgagaaggagtacaccggcgacagaagcagcaactgcagcagccccgccgacttctgggagatcgccctgagcagcaagatggccgacgtggacatcagcaccgtgaccggccccatggccgactacgtgcaggagggccccatcatcccctactacgtgagcgtgaccaccggcaagcacaaggacgccgccaccgacagcagagccttcatcttcctgatcggcgaggacgacgagagaagcaagagaatctggctggactaccccagaggcaagagaggcttcagcagaggcagcgtggaggagttctacgtggccggcctggacgtgggcatcatcaagaagatcgagctgggccacgacggcgccagccccgagagctgctggctggtggaggagctgtgcctggccgtgcccacccagggcaccaagtacatgctgaactgcaactgctggctggccaaggacagaggcgacggcatcaccagcagagtgttcgacctgctggacgccatggtggtgaacatcggcgtgaaggtgctgtacgagatgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctggtggtgaccagactgggcctggccgccgagtgcggctag

SEQ ID NO: 87288 - DNA, 3435 bp, Artificial Sequence
  Description of Artificial Sequence: Synthetic coding sequence
atgctgagacacctgaccgacaccttcaccatctacgccatcgacctgggcgccctgaccaagatcagaatcagacacgacaacaccggcaacagagccggctggttcctggacagaatcgacatcaccgacatgaacaacgagatcacctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggacggcgccgagaccctgaccttcccctgcgacagatggctggccaccagcgaggacgacaagaagaccatcagagagctggtgccctacgacatcttcaccgagaagtacatgaaggacggcagcctgagacaggtgtacaaggaggtggaggagcccctggacatcgtgctgtacagcgtgcagatcttcaccggcaacatccccggcgccggcaccgacgccaaggtgtacatcaccatctacggcgacctgggcgacaccggcgagagatacctgggcaagagcgagaacagaaccaacaagttcgagagaggcaccgccgacaccttcatcatcgaggccgccgacctgggcgtgatctacaagatcaagctgagacacgacaacagcaagtggtgcgccgactggtacgtggagaaggtggagatctggaacgacaccaacgaggacgagttcctgttcctgtgcggcagatggctgagcctgaagaaggaggacggcagactggagagactgttctacgagaaggagtacaccggcgacagaagcagcaactgcagcagccccgccgacttctgggagatcgccctgagcagcaagatggccgacgtggacatcagcaccgtgaccggccccatggccgactacgtgcaggagggccccatcatcccctactacgtgagcgtgaccaccggcaagcacaaggacgccgccaccgacagcagagccttcatcttcctgatcggcgaggacgacgagagaagcaagagaatctggctggactaccccagaggcaagagaggcttcagcagaggcagcgtggaggagttctacgtggccggcctggacgtgggcatcatcaagaagatcgaggtgctgtacgagatgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctgggcgagctgagaaaggtgagactggagcacgacagcagcggctactgcagcggctggctggtggagaaggtggaggtgaccaacaccagcaccggcgtggccaccatcttcaactgcggcagatggctggacaagaagagaggcgacggcctgacctggagagacctgttccccagcgtgtag

SEQ ID NO: 87289 - DNA, 921 bp, Artificial Sequence
  Description of Artificial Sequence: Synthetic coding sequence
atgagactgggcaccaactgcgagcacccccagctgcccctggccgcccccagcggctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggactag

SEQ ID NO: 87290 - DNA, 6636 bp, Artificial Sequence
  Description of Artificial Sequence: Synthetic coding sequence
atgatgccccagaagaagagaagaagaaagaaggacatcgacttcctggccctgtacgaggccgagctgctgaactacgccagcgaggacgacgagggcgagctggagcacgagtactacaaggccagagtgtacgaggtggtgaccgccaccggcgacgtgagaggcgccggcaccgacgccaacgtgttcatcaccctgttcggcgagaacggcctgagccccaagctgcagctgaccagcaagagcaagagcgccttcgagaagggcaacgtggacgtgttcagagtgagaaccaacaacgtgggcctgatctacaaggtgagaatcgagcacgacaacaccggcctgaacgccagctggtacctggaccacgtgatcgtgaccgacatgaagagaccccacctgagatactacttcaactgcaacaactggctgagcaaggtggagggcgacagacagtggtgcagagacctgctggccagcttcaaccccatggacatgcccagaggcaacaagtacgaggtgaaggtgtacaccggcgacgtgatcggcgccggcaccgacgccgacgtgttcatcaacatcttcggcgagtacggcgacaccggcgagagaagactggagaacgagaaggacaacttcgagaagggcgccgaggacagattcatcctggacgcccccgacctgggccagctgatgaagatcaacgtgggccacaacaacaagggcggcagcgccggctggttcctgagccagatcgtgatcgaggacatcggcaacaagagaaagtacgacttccccctgaacagatggctggccctggacgaggacgacggcaagatccagagagacatcctggtgggcggcgccgagaccaccgccatcacctacatcgtgaccgtgttcaccggcgacgtgagaggcgccggcaccaagagcaagatctacctggtgatgtacggcgccagaggcaacaagaacagcggcaagatcttcctggagggcggcgtgttcgacagaggcagaaccgacatcttccacatcgagctggccgtgctgctgagccccctgagcagagtgagcgtgggccacggcaacgtgggcgtgaacagaggctggttctgcgagaaggtggtgatcctgtgccccttcaccggcatccagcagaccttcccctgcagcaactggctggacgagaagaaggccgacggcctgatcgagagacagctgtacgagatggtgagcctgagaaagaagagactgaagaagttcccctggagcctgtgggtgtggaccaccgacctgaagaaggccggcaccaacagccccatcttcatccagatctacggccagaagggcagaaccgacgagatcctgctgaaccccaacaacaagtggttcaagcccggcatcatcgagaagttcagaatcgagctgcccgacctgggcagattctacaagatcagagtgtggcacgacaagagaagcagcggcagcggctggcacctggagagaatgaccctgatgaacaccctgaacaaggacaagtacaacttcaactgcaacagatggctggacgccaacgaggacgacaacgagatcgtgagagagatgaccgccgagggccccaccgtgagaagaatcatgggcatggccagataccacgtgaccgtgtgcaccggcgagctggagggcgccggcaccgacgccaacgtgtacctgtgcctgttcggcgacgtgggcgacaccggcgagagactgctgtacaactgcagaaacaacaccgacctgttcgagaagggcaacgccgacgagttcaccatcgagagcgtgaccatgagaaacgtgagaagagtgagaatcagacacgacggcaagggcagcggcagcggctggtacctggacagagtgctggtgagagaggagggccagcccgagagcgacaacgtggagttcccctgcctgagatggctggacaaggacaaggacgacggccagctggtgagagagctgctgcccagcgacagcagcgccaccctgaagaacttcagataccacatcagcctgaagaccggcgacgtgagcggcgccagcaccgacagcagagtgtacatcaagctgtacggcgacaagagcgacaccatcaagcaggtgctgctggtgagcgacaacaacctgaaggactacttcgagagaggcagagtggacgagttcaccctggagaccctgaacatcggcaacatcaacagactggtgatcggccacgacagcaccggcatgcacgccagctggttcctgggcagcgtgcagatcagagtgcccagacagggcaagcagtacaccttccccgccaacagatggctggacaagaaccaggccgacggcagactggaggtggagctgtaccccagcgaggtggtggagatccagaagctggtgcactacgaggtggagatctggaccggcgacgtgggcggcgccggcaccagcgccagagtgtacatgcagatctacggcgagaagggcaagaccgaggtgctgttcctgagcagcagaagcaaggtgttcgagagagccagcaaggacaccttccagctggaggccgccgacgtgggcgaggtgtacaagctgagactgggccacaccggcgagggcttcggccccagctggttcgtggacaccgtgtggctgagacacctggtggtgagagaggtggacctgacccccgaggaggaggccagaaagaagaaggagaaggacaagctgagacagctgctgaagaaggagagactgaaggccaagctgcagagaaagaagaagaagagaaagggcagcgacgaggaggacgagggcgaggaggaggagagcagcagcagcgaggagagcagcagcgaggaggaggagatggaggaggaggaggaggaggaggagttcggccccggcatgcaggaggtgatcgagcagcacaagttcgaggcccacagatggctggccagaggcaaggaggacaacgagctggtggtggagctggtgcccgccggcaagcccggccccgagagaaacacctacgaggtgcaggtggtgaccggcaacgtgcccaaggccggcaccgacgccaacgtgtacctgaccatctacggcgaggagtacggcgacaccggcgagagacccctgaagaagagcgacaagagcaacaagttcgagcagggccagaccgacaccttcaccatctacgccatcgacctgggcgccctgaccaagatcagaatcagacacgacaacaccggcaacagagccggctggttcctggacagaatcgacatcaccgacatgaacaacgagatcacctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggacggcgccgagaccctgaccttcccctgcgacagatggctggccaccagcgaggacgacaagaagaccatcagagagctggtgccctacgacatcttcaccgagaagtacatgaaggacggcagcctgagacaggtgtacaaggaggtggaggagcccctggacatcgtgctgtacagcgtgcagatcttcaccggcaacatccccggcgccggcaccgacgccaaggtgtacatcaccatctacggcgacctgggcgacaccggcgagagatacctgggcaagagcgagaacagaaccaacaagttcgagagaggcaccgccgacaccttcatcatcgaggccgccgacctgggcgtgatctacaagatcaagctgagacacgacaacagcaagtggtgcgccgactggtacgtggagaaggtggagatctggaacgacaccaacgaggacgagttcctgttcctgtgcggcagatggctgagcctgaagaaggaggacggcagactggagagactgttctacgagaaggagtacaccggcgacagaagcagcaactgcagcagccccgccgacttctgggagatcgccctgagcagcaagatggccgacgtggacatcagcaccgtgaccggccccatggccgactacgtgcaggagggccccatcatcccctactacgtgagcgtgaccaccggcaagcacaaggacgccgccaccgacagcagagccttcatcttcctgatcggcgaggacgacgagagaagcaagagaatctggctggactaccccagaggcaagagaggcttcagcagaggcagcgtggaggagttctacgtggccggcctggacgtgggcatcatcaagaagatcgaggtgctgtacgagatgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctgggcgagctgagaaaggtgagactggagcacgacagcagcggctactgcagcggctggctggtggagaaggtggaggtgaccaacaccagcaccggcgtggccaccatcttcaactgcggcagatggctggacaagaagagaggcgacggcctgacctggagagacctgttccccagcgtgtag

SEQ ID NO: 87291 - DNA, 3345 bp, Artificial Sequence
  Description of Artificial Sequence: Synthetic coding sequence
atgaacaacgagatcacctactacttcccctgccagagatggctggccgtggaggaggacgacggccagctgagcagagagctgctgcccgtggacgagagctacgtgctgccccagagcgaggagggcagaggcggcggcgacaacaaccccctggacaacctggccctggagcagaaggacaagagcaccaccttcagcgtgaccatcaagaccggcgtgaagaagaacgccggcaccgacgccaacgtgttcatcaccctgttcggcacccaggacgacaccggcatgaccctgctgaagagcagcaagaccaacagcgacaagttcgagagagacagcatcgagatcttcaccgtggagaccctggacctgggcgacctgtggaaggtgagactgggccacgacaacaccggcaaggcccccggctggttcgtggactgggtggaggtggacgcccccagcctgggcaagtgcatgaccttcccctgcggcagatggctggccaagaacgaggacgacggcagcatcatcagagacctgttccacgccgagctgcagaccagactgtacacccccttcgtgccctacgagatcaccctgtacaccagcgacgtgttcgccgccggcaccgacgccaacatcttcatcatcatctacggctgcgacgccgtgtgcacccagcagaagtacctgtgcaccaacaagagagagcagaagcagttcttcgagagaaagagcgccagcagattcatcgtggagctggaggacgtgggcgagatcatcgagaagatcagaatcggccacaacaacaccggcatgaaccccggctggcactgcagccacgtggacatcagaagactgctgcccgacaaggacggcgccgagaccctgaccttcccctgcgacagatggctggccaccagcgaggacgacaagaagaccatcagagagctggtgccctacgacatcttcaccgagaagtacatgaaggacggcagcctgagacaggtgtacaaggaggtggaggagcccctggacatcgtgctgtacagcgtgcagatcttcaccggcaacatccccggcgccggcaccgacgccaaggtgtacatcaccatctacggcgacctgggcgacaccggcgagagatacctgggcaagagcgagaacagaaccaacaagttcgagagaggcaccgccgacaccttcatcatcgaggccgccgacctgggcgtgatctacaagatcaagctgagacacgacaacagcaagtggtgcgccgactggtacgtggagaaggtggagatctggaacgacaccaacgaggacgagttcctgttcctgtgcggcagatggctgagcctgaagaaggaggacggcagactggagagactgttctacgagaaggagtacaccggcgacagaagcagcaactgcagcagccccgccgacttctgggagatcgccctgagcagcaagatggccgacgtggacatcagcaccgtgaccggccccatggccgactacgtgcaggagggccccatcatcccctactacgtgagcgtgaccaccggcaagcacaaggacgccgccaccgacagcagagccttcatcttcctgatcggcgaggacgacgagagaagcaagagaatctggctggactaccccagaggcaagagaggcttcagcagaggcagcgtggaggagttctacgtggccggcctggacgtgggcatcatcaagaagatcgagctgggccacgacggcgccagccccgagagctgctggctggtggaggagctgtgcctggccgtgcccacccagggcaccaagtacatgctgaactgcaactgctggctggccaaggacagaggcgacggcatcaccagcagagtgttcgacctgctggacgccatggtggtgaacatcggcgtgaaggtgctgtacgagatgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctggtggtgaccagactgggcctggccgccgagtgcggctag

SEQ ID NO: 87292 - DNA, 1539 bp, Artificial Sequence
  Description of Artificial Sequence: Synthetic coding sequence
atgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctgggcgagctgagaaaggtgagactggagcacgacagcagcggctactgcagcggctggctggtggagaaggtggaggtgaccaacaccagcaccggcgtggccaccatcttcaactgcggcagatggctggacaagaagagaggcgacggcctgacctggagagacctgttccccagcgtgtag

SEQ ID NO: 87293 - DNA, 1374 bp, Artificial Sequence
  Description of Artificial Sequence: Synthetic coding sequence
atgaccgtgtggaccggcgacgtggtgggcggcggcaccgacagcaacatcttcatgaccctgtacggcatcaacggcagcaccgaggagatgcagctggacaagaagaaggccagattcgagagagagcagaacgacaccttcatcatggagatcctggacatcgcccccttcaccaagatgagaatcagaatcgacggcctgggcagcagacccgagtggttcctggagagaatcctgctgaagaacatgaacaccggcgacctgaccatgttctactacggcgactggctgagccagagaaagggcaagaagaccctggtgtgcgagatgtgcgccgtgatcgacgaggaggagatgatggagtggaccagctacaccgtggccgtgaagaccagcgacatcctgggcgccggcaccgacgccaacgtgttcatcatcatcttcggcgagaacggcgacagcggcaccctggccctgaagcagagcgccaactggaacaagttcgagagaaacaacaccgacaccttcaacttccccgacatgctgagcctgggccacctgtgcaagctgagagtgtggcacgacaacaagggcatcttccccggctggcacctgagctacgtggacgtgaaggacaacagcagagacgagaccttccacttccagtgcgactgctggctgagcaagagcgagggcgacggccagaccgtgagagacttcgcctgcgccaacaacaagatctgcgacgagctggaggagaccacctacgagatcgtgatcgagaccggcaacggcggcgagaccagagagaacgtgtggctgatcctggagggcagaaagaacagaagcaaggagttcctgatggagaacagcagcagacagagagccttcagaaagggcaccaccgacaccttcgagttcgacagcatctacctgggcgacatcgccagcctgtgcgtgggccacctggccagagaggacagattcatccccaagagagagctggcctggcacgtgaagaccatcaccatcaccgagatggagtacggcaacgtgtacttcttcaactgcgactgcctgatccccctgaagagaaagagaaagtacttcaaggtgttcgaggtgaccaagaccaccgagagcttcgccagcaaggtgcagagcctggtgcccgtgaagtacgaggtgatcgtgaccaccggctacgagcccggcgccggcaccgacgccaacgtgttcgtgaccatcttcggcgccaacggcgacaccggcaagagagagctgaagcagaagatgagaaacctgttcgagagaggcagcaccgacagattcttcctggagaccctggagctgggcgagctgagaaagtag

SEQ ID NO: 87294 - DNA, 1122 bp, Artificial Sequence
  Description of Artificial Sequence: Synthetic coding sequence
atgctgatccccttcagcatgaagaactgcttccagctgctgtgcaactgccaggtgcccgccgccggcttcaagaagaccgtgaagaacggcctgatcctgcagagcatcagcaacgacgtgtaccagaacctggccgtggaggactggatccacgaccacatgaacctggagggcaagcccatcctgttcttctggcagaacagccccagcgtggtgatcggcagacaccagaacccctggcaggagtgcaacctgaacctgatgagagaggagggcatcaagctggccagaagaagaagcggcggcggcaccgtgtaccacgacatgggcaacatcaacctgaccttcttcaccaccaagaagaagtacgacagaatggagaacctgaagctgatcgtgagagccctgaacgccgtgcagccccagctggacgtgcaggccaccaagagattcgacctgctgctggacggccagttcaagatcagcggcaccgccagcaagatcggcagaaccaccgcctaccaccactgcaccctgctgtgcagcaccgacggcaccttcctgagcagcctgctgaagagcccctaccagggcatcagaagcaacgccaccgccagcatccccagcctggtgaagaacctgctggagaaggaccccaccctgacctgcgaggtgctgatgaacgccgtggccaccgagtacgccgcctaccaccagatcgacaaccacatccacctgatcaaccccaccgacgagaccctgttccccggcatcaacagcaaggccaaggagctgcagacctgggagtggatctacggcaagacccccaagttcagcatcaacaccagcttccacgtgctgtacgagcagagccacctggagatcaaggtgttcatcgacatcaagaacggcagaatcgagatctgcaacatcgaggcccccgaccactggctgcccctggagatcagagacaagctgaacagcagcctgatcggcagcaagttctgccccaccgagaccaccatgctgaccaacatcctgctgagaacctgcccccaggaccacaagctgaacagcaagtggaacatcctgtgcgagaagatcaagggcatcatgtag

SEQ ID NO: 87295 - DNA, 1122 bp, Artificial Sequence; identical to SEQ ID NO: 87294
  Description of Artificial Sequence: Synthetic coding sequence

SEQ ID NO: 87296 - DNA, 1122 bp, Artificial Sequence; identical to SEQ ID NO: 87294
  Description of Artificial Sequence: Synthetic coding sequence

SEQ ID NO: 87297 - DNA, 1122 bp, Artificial Sequence; identical to SEQ ID NO: 87294
  Description of Artificial Sequence: Synthetic coding sequence

SEQ ID NO: 87298 - DNA, 1122 bp, Artificial Sequence; identical to SEQ ID NO: 87294
  Description of Artificial Sequence: Synthetic coding sequence

SEQ ID NO: 87299 - DNA, 321 bp, Artificial Sequence
  Description of Artificial Sequence: Synthetic coding sequence
atgctgatccccttcagcatgaagaactgcttccagctgctgtgcaactgccaggtgcccgccgccggcttcaagaagaccgtgaagaacggcctgatcctgcagagcatcagcaacgacgtgtaccagaacctggccgtggaggactggatccacgaccacatgaacctggagggcaagcccatcctgttcttctggcagaacagccccagcgtggtgatcggcagacaccagaacccctggcaggagtgcaacctgaacctgatgagagaggagggcatcaagctggccagaagaagaagcggcggcggcaccgtgtag

SEQ ID NO: 87300 - DNA, 756 bp, Artificial Sequence
  Description of Artificial Sequence: Synthetic coding sequence
atgctgatccccttcagcatgaagaactgcttccagctgctgtgcaactgccaggtgcccgccgccggcttcaagaagaccgtgaagaacggcctgatcctgcagagcatcagcaacgacgtgtaccagaacctggccgtggaggactggatccacgaccacatgaacctggagggcaagcccatcctgttcttctggcagaacagccccagcgtggtgatcggcagacaccagaacccctggcaggagtgcaacctgaacctgatgagagaggagggcatcaagctggccagaagaagaagcggcggcggcaccgtgtaccacgacatgggcaacatcaacctgaccttcttcaccaccaagaagaagtacgacagaatggagaacctgaagctgatcgtgagagccctgaacgccgtgcagccccagctggacgtgcaggccaccaagagattcgacctgctgctggacggccagttcaagatcagcggcaccgccagcaagatcggcagaaccaccgcctaccaccactgcaccctgctgtgcagcaccgacggcaccttcctgagcagcctgctgaagagcccctaccagggcatcagaagcaacgccaccgccagcatccccagcctggtgaagaacctgctggagaaggaccccaccctgacctgcgaggtgctgatgaacgccgtggccaccgagtacgccgcctaccaccagatcgacaaccacatccacctgatcaaccccacctag

SEQ ID NO: 87301 - DNA, 120 bp, Artificial Sequence
  Description of Artificial Sequence: Synthetic coding sequence
atgctgatccccttcagcatgaagaactgcttccagctgctgtgcaactgccaggtgcccgccgccggcttcaagaagaccgtgaagaacggcctgatcctgcagagcatcagcaactag

SEQ ID NO: 87302 - DNA, 408 bp, Artificial Sequence
  Description of Artificial Sequence: Synthetic coding sequence
atgctgatccccttcagcatgaagaactgcttccagctgctgtgcaactgccaggtgcccgccgccggcttcaagaagaccgtgaagaacggcctgatcctgcagagcatcagcaacgacgtgtaccagaacctggccgtggaggactggatccacgaccacatgaacctggagggcaagcccatcctgttcttctggcagaacagccccagcgtggtgatcggcagacaccagaacccctggcaggagtgcaacctgaacctgatgagagaggagggcatcaagctggccagaagaagaagcggcggcggcaccgtgtaccacgacatgggcaacatcaacctgaccttcttcaccaccaagaagaagtacgacagaatggagaacctgaagctgatcgtgagatag

SEQ ID NO: 87303 - DNA, 5301 bp, Artificial Sequence
  Description of Artificial Sequence: Synthetic coding sequence
atgggcggcaagaacaagcagagaaccaagggcaacctgagacccagcaacagcggcagagccgccgagctgctggccaaggagcagggcaccgtgcccggcttcatcggcttcggcaccagccagagcgacctgggctacgtgcccgccatccagggcgccgaggagatcgacagcctggtggacagcgacttcagaatggtgctgagaaagctgagcaagaaggacgtgaccaccaagctgaaggccatgcaggagttcggcaccatgtgcaccgagagagacaccgagaccgtgaagggcgtgctgccctactggcccagaatcttctgcaagatcagcctggaccacgacagaagagtgagagaggccacccagcaggccttcgagaagctgatcctgaaggtgaagaagcagctggccccctacctgaagagcctgatgggctactggctgatggcccagtgcgacacctacacccccgccgccttcgccgccaaggacgccttcgaggccgccttcccccccagcaagcagcccgaggccatcgccttctgcaaggacgagatcaccagcgtgctgcaggaccacctgatcaaggagacccccgacaccctgagcgacccccagaccgtgcccgaggaggagagagaggccaagttctacagagtggtgacctgcagcctgctggccctgaagagactgctgtgcctgctgcccgacaacgagctggacagcctggaggagaagttcaagagcctgctgagccagaacaagttctggaagtacggcaagcacagcgtgccccagatcagaagcgcctacttcgagctggtgagcgccctgtgccagagaatcccccagctgatgaaggaggaggccagcaaggtgagccccagcgtgctgctgagcatcgacgacagcgaccccatcgtgtgccccgccctgtgggaggccgtgctgtacaccctgaccaccatcgaggactgctggctgcacgtgaacgccaagaagagcgtgttccccaagctgagcaccgtgatcagagagggcggcagaggcctggccaccgtgatctacccctacctgctgcccttcatcagcaagctgccccagagcatcaccaaccccaagctggacttcttcaagaacttcctgaccagcctggtggccggcctgagcaccgagagaaccaagaccagcagcctggagagcagcgccgtgatcagcgccttcttcgagtgcctgagattcatcatgcagcagaacctgggcgaggaggagatcgagcagatgctggtgaacgaccagctgatccccttcatcgacgccgtgctgaaggaccccggcctgcagcacggccagctgttcaaccacctggccgagaccctgagcagctgggaggccaaggccgacaccgagaaggacgagaagaccgcccacaacctggagaacgtgctgatccacttctgggagagactgagcgagatctgcgtggccaagatcagcgagcccgaggccgacgtggagagcgtgctgggcgtgagcaacctgctgcaggtgctgcagaagcccaagagcagcctgaagagcagcaagaagaagaacggcaaggtgagattcgccgacgagatcctggagagcaacaaggagaacgagaagtgcgtgagcagcgagggcgagaagatcgagggctgggagctgaccaccgagcccagcctgacccacaacagcagcggcctgctgagccccctgagaaagaagcccctggaggacctggtgtgcaagctggccgacatcagcatcaactacgtgaacgagagaaagagcgagcagcacctgagattcctgagcaccctgctggacagcttcagcagcagcagagtgttcaagatgctgctgggcgacgagaagcagagcatcgtgcaggccaagcccctggagatcgccaagctggtgcagaagaaccccgccgtgcagttcctgtaccagaagctgatcggctggctgaacgaggaccagagaaaggacttcggcttcctggtggacatcctgtacagcgccctgagatgctgcgacaacgacatggagagaaagaaggtgctggacgacctgaccaaggtggacctgaagtggaacagcctgctgaagatcatcgagaaggcctgccccagcagcgacaagcacgccctggtgaccccctggctgaagggcgacatcctgggcgagaagctggtgaacctggccgactgcctgtgcaacgaggacctggagagcagagtgagcagcgagagccacttcagcgagagatggaccctgctgagcctggtgctgagccagcacgtgaagaacgactacctgatcggcgacgtgtacgtggagagaatcatcgtgagactgcacgagaccctgttcaagaccaagaagctgagcgaggccgagagcagcgacagcagcgtgagcttcatctgcgacgtggcctacaactacttcagcagcgccaagggctgcctgctgatgcccagcagcgaggacctgctgctgaccctgttccagctgtgcgcccagagcaaggagaagacccacctgcccgacttcctgatctgcaagctgaagaacacctggctgagcggcgtgaacctgctggtgcaccagaccgacagcagctacaaggagagcaccttcctgcacctgagcgccctgtggctgaagaaccaggtgcaggccagcagcctggacatcaacagcctgcaggtgctgctgagcgccgtggacgacctgctgaacaccctgctggagagcgaggacagctacctgatgggcgtgtacatcggcagcgtgatgcccaacgacagcgagtgggagaagatgagacagagcctgcccatgcagtggctgcacagacccctgctggagggcagactgagcctgaactacgagtgcttcaagaccgacttcaaggagcaggacatcaagaccctgcccagccacctgtgcaccagcgccctgctgagcaagatggtgctgatcgccctgagaaaggagaccgtgctggagaacaacgagctggagaagatcatcgccgagctgctgtacagcctgcagtggtgcgaggagctggacaacccccccatcttcctgatcggcttctgcgagatcctgcagaagatgaacatcacctacgacaacctgagagtgctgggcaacaccagcggcctgctgcagctgctgttcaacagaagcagagagcacggcaccctgtggagcctgatcatcgccaagctgatcctgagcagaagcatcagcagcgacgaggtgaagccccactacaagagaaaggagagcttcttccccctgaccgagggcaacctgcacaccatccagagcctgtgccccttcctgagcaaggaggagaagaaggagttcagcgcccagtgcatccccgccctgctgggctggaccaagaaggacctgtgcagcaccaacggcggcttcggccacctggccatcttcaacagctgcctgcagaccaagagcatcgacgacggcgagctgctgcacggcatcctgaagatcatcatcagctggaagaaggagcacgaggacatcttcctgttcagctgcaacctgagcgaggccagccccgaggtgctgggcgtgaacatcgagatcatcagattcctgagcctgttcctgaagtactgcagcagccccctggccgagagcgagtgggacttcatcatgtgcagcatgctggcctggctggagaccaccagcgagaaccaggccctgtacagcatccccctggtgcagctgttcgcctgcgtgagctgcgacctggcctgcgacctgagcgccttcttcgacagcaccaccctggacaccatcggcaacctgcccgtgaacctgatcagcgagtggaaggagttcttcagccagggcatccacagcctgctgctgcccatcctggtgaccgtgaccggcgagaacaaggacgtgagcgagaccagcttccagaacgccatgctgaagcccatgtgcgagaccctgacctacatcagcaaggagcagctgctgagccacaagctgcccgccagactggtggccgaccagaagaccaacctgcccgagtacctgcagaccctgctgaacaccctggcccccctgctgctgttcagagccagacccgtgcagatcgccgtgtaccacatgctgtacaagctgatgcccgagctgccccagtacgaccaggacaacctgaagagctacggcgacgaggaggaggagcccgccctgagcccccccgccgccctgatgagcctgctgagcatccaggaggacctgctggagaacgtgctgggctgcatccccgtgggccagatcgtgaccatcaagcccctgagcgaggacttctgctacgtgctgggctacctgctgacctggaagctgatcctgaccttcttcaaggccgccagcagccagctgagagccctgtacagcatgtacctgagaaagaccaagagcctgaacaagctgctgtaccacctgttcagactgatgcccgagaaccccacctacgccgagaccgccgtggaggtgcccaacaaggaccccaagaccttcttcaccgaggagctgcagctgagcatcagagagaccaccatgctgccctaccacatcccccacctggcctgcagcgtgtaccacatgaccctgaaggacctgcccgccatggtgagactgtggtggaacagcagcgagaagagagtgttcaacatcgtggacagattcaccagcaagtacgtgagcagcgtgctgagcttccaggagatcagcagcgtgcagaccagcacccagctgttcaacggcatgaccgtgaaggccagagccaccaccagagaggtgatggccacctacaccatcgaggacatcgtgatcgagctgatcatccagctgcccagcaactaccccctgggcagcatcatcgtggagagcggcaagagagtgggcgtggccgtgcagcagtggagaaactggatgctgcagctgagcacctacctgacccaccagaacggcagcatcatggagggcctggccctgtggaagaacaacgtggacaagagattcgagggcgtggaggactgcatgatctgcttcagcgtgatccacggcttcaactacagcctgcccaagaaggcctgcagaacctgcaagaagaagttccacagcgcctgcctgtacaagtggttcaccagcagcaacaagagcacctgccccctgtgcagagagaccttcttctag

SEQ ID NO: 87304 - DNA, 1443 bp, Artificial Sequence
  Description of Artificial Sequence: Synthetic coding sequence
atgggcggcaagaacaagcagagaaccaagggcaacctgagacccagcaacagcggcagagccgccgagctgctggccaaggagcagggcaccgtgcccggcttcatcggcttcggcaccagccagagcgacctgggctacgtgcccgccatccagggcgccgaggagatcgacagcctggtggacagcgacttcagaatggtgctgagaaagctgagcaagaaggacgtgaccaccaagctgaaggccaacgccatgcaggagttcggcaccatgtgcaccgagagagacaccgagaccgtgaagggcgtgctgccctactggcccagaatcttctgcaagatcagcctggaccacgacagaagagtgagagaggccacccagcaggccttcgagaagctgatcctgaaggtgaagaagcagctggccccctacctgaagagcctgatgggctactggctgatggcccagtgcgacacctacacccccgccgccttcgccgccaaggacgccttcgaggccgccttcccccccagcaagcagcccgaggccatcgccttctgcaaggacgagatcaccagcgtgctgcaggaccacctgatcaaggagacccccgacaccctgagcgacccccagaccgtgcccgaggaggagagagaggccaagttctacagagtggtgacctgcagcctgctggccctgaagagactgctgtgcctgctgcccgacaacgagctggacagcctggaggagaagttcaagagcctgctgagccagaacaagttctggaagtacggcaagcacagcgtgccccagatcagaagcgcctacttcgagctggtgagcgccctgtgccagagaatcccccagctgatgaaggaggaggccagcaaggtgagccccagcgtgctgctgagcatcgacgacagcgaccccatcgtgtgccccgccctgtgggaggccgtgctgtacaccctgaccaccatcgaggactgctggctgcacgtgaacgccaagaagagcgtgttccccaagctgagcaccgtgatcagagagggcggcagaggcctggccaccgtgatctacccctacctgctgcccttcatcagcaagctgccccagagcatcaccaaccccaagctggacttcttcaagaacttcctgaccagcctggtggccggcctgagcaccgagagaaccaagaccagcagcctggagagcagcgccgtgatcagcgccttcttcgagtgcctgagattcatcatgcagcagaacctgggcgaggaggagatcgagcagatgctggtgaacgaccagctgatccccttcatcgacgccgtgctgaaggaccccggcctgcagcacggccagctgttcaaccacctggccgagaccctgagcagctgggaggccaaggccgacaccgagaaggacgagaagtag

SEQ ID NO: 87305 - DNA, 5439 bp, Artificial Sequence
  Description of Artificial Sequence: Synthetic coding sequence
atggacagagtgggcggcggcaagggccccggcggcagctactacagagtgagcagcagcgccgccagaagcagaaagctgtgccccggcagagtgaacagaggcctgagcgcccagagcaccgccgccaccgccaccatgggcggcaagaacaagcagagaaccaagggcaacctgagacccagcaacagcggcagagccgccgagctgctggccaaggagcagggcaccgtgcccggcttcatcggcttcggcaccagccagagcgacctgggctacgtgcccgccatccagggcgccgaggagatcgacagcctggtggacagcgacttcagaatggtgctgagaaagctgagcaagaaggacgtgaccaccaagctgaaggccatgcaggagttcggcaccatgtgcaccgagagagacaccgagaccgtgaagggcgtgctgccctactggcccagaatcttctgcaagatcagcctggaccacgacagaagagtgagagaggccacccagcaggccttcgagaagctgatcctgaaggtgaagaagcagctggccccctacctgaagagcctgatgggctactggctgatggcccagtgcgacacctacacccccgccgccttcgccgccaaggacgccttcgaggccgccttcccccccagcaagcagcccgaggccatcgccttctgcaaggacgagatcaccagcgtgctgcaggaccacctgatcaaggagacccccgacaccctgagcgacccccagaccgtgcccgaggaggagagagaggccaagttctacagagtggtgacctgcagcctgctggccctgaagagactgctgtgcctgctgcccgacaacgagctggacagcctggaggagaagttcaagagcctgctgagccagaacaagttctggaagtacggcaagcacagcgtgccccagatcagaagcgcctacttcgagctggtgagcgccctgtgccagagaatcccccagctgatgaaggaggaggccagcaaggtgagccccagcgtgctgctgagcatcgacgacagcgaccccatcgtgtgccccgccctgtgggaggccgtgctgtacaccctgaccaccatcgaggactgctggctgcacgtgaacgccaagaagagcgtgttccccaagctgagcaccgtgatcagagagggcggcagaggcctggccaccgtgatctacccctacctgctgcccttcatcagcaagctgccccagagcatcaccaaccccaagctggacttcttcaagaacttcctgaccagcctggtggccggcctgagcaccgagagaaccaagaccagcagcctggagagcagcgccgtgatcagcgccttcttcgagtgcctgagattcatcatgcagcagaacctgggcgaggaggagatcgagcagatgctggtgaacgaccagctgatccccttcatcgacgccgtgctgaaggaccccggcctgcagcacggccagctgttcaaccacctggccgagaccctgagcagctgggaggccaaggccgacaccgagaaggacgagaagaccgcccacaacctggagaacgtgctgatccacttctgggagagactgagcgagatctgcgtggccaagatcagcgagcccgaggccgacgtggagagcgtgctgggcgtgagcaacctgctgcaggtgctgcagaagcccaagagcagcctgaagagcagcaagaagaagaacggcaaggtgagattcgccgacgagatcctggagagcaacaaggagaacgagaagtgcgtgagcagcgagggcgagaagatcgagggctgggagctgaccaccgagcccagcctgacccacaacagcagcggcctgctgagccccctgagaaagaagcccctggaggacctggtgtgcaagctggccgacatcagcatcaactacgtgaacgagagaaagagcgagcagcacctgagattcctgagcaccctgctggacagcttcagcagcagcagagtgttcaagatgctgctgggcgacgagaagcagagcatcgtgcaggccaagcccctggagatcgccaagctggtgcagaagaaccccgccgtgcagttcctgtaccagaagctgatcggctggctgaacgaggaccagagaaaggacttcggcttcctggtggacatcctgtacagcgccctgagatgctgcgacaacgacatggagagaaagaaggtgctggacgacctgaccaaggtggacctgaagtggaacagcctgctgaagatcatcgagaaggcctgccccagcagcgacaagcacgccctggtgaccccctggctgaagggcgacatcctgggcgagaagctggtgaacctggccgactgcctgtgcaacgaggacctggagagcagagtgagcagcgagagccacttcagcgagagatggaccctgctgagcctggtgctgagccagcacgtgaagaacgactacctgatcggcgacgtgtacgtggagagaatcatcgtgagactgcacgagaccctgttcaagaccaagaagctgagcgaggccgagagcagcgacagcagcgtgagcttcatctgcgacgtggcctacaactacttcagcagcgccaagggctgcctgctgatgcccagcagcgaggacctgctgctgaccctgttccagctgtgcgcccagagcaaggagaagacccacctgcccgacttcctgatctgcaagctgaagaacacctggctgagcggcgtgaacctgctggtgcaccagaccgacagcagctacaaggagagcaccttcctgcacctgagcgccctgtggctgaagaaccaggtgcaggccagcagcctggacatcaacagcctgcaggtgctgctgagcgccgtggacgacctgctgaacaccctgctggagagcgaggacagctacctgatgggcgtgtacatcggcagcgtgatgcccaacgacagcgagtgggagaagatgagacagagcctgcccatgcagtggctgcacagacccctgctggagggcagactgagcctgaactacgagtgcttcaagaccgacttcaaggagcaggacatcaagaccctgcccagccacctgtgcaccagcgccctgctgagcaagatggtgctgatcgccctgagaaaggagaccgtgctggagaacaacgagctggagaagatcatcgccgagctgctgtacagcctgcagtggtgcgaggagctggacaacccccccatcttcctgatcggcttctgcgagatcctgcagaagatgaacatcacctacgacaacctgagagtgctgggcaacaccagcggcctgctgcagctgctgttcaacagaagcagagagcacggcaccctgtggagcctgatcatcgccaagctgatcctgagcagaagcatcagcagcgacgaggtgaagccccactacaagagaaaggagagcttcttccccctgaccgagggcaacctgcacaccatccagagcctgtgccccttcctgagcaaggaggagaagaaggagttcagcgcccagtgcatccccgccctgctgggctggaccaagaaggacctgtgcagcaccaacggcggcttcggccacctggccatcttcaacagctgcctgcagaccaagagcatcgacgacggcgagctgctgcacggcatcctgaagatcatcatcagctggaagaaggagcacgaggacatcttcctgttcagctgcaacctgagcgaggccagccccgaggtgctgggcgtgaacatcgagatcatcagattcctgagcctgttcctgaagtactgcagcagccccctggccgagagcgagtgggacttcatcatgtgcagcatgctggcctggctggagaccaccagcgagaaccaggccctgtacagcatccccctggtgcagctgttcgcctgcgtgagctgcgacctggcctgcgacctgagcgccttcttcgacagcaccaccctggacaccatcggcaacctgcccgtgaacctgatcagcgagtggaaggagttcttcagccagggcatccacagcctgctgctgcccatcctggtgaccgtgaccggcgagaacaaggacgtgagcgagaccagcttccagaacgccatgctgaagcccatgtgcgagaccctgacctacatcagcaaggagcagctgctgagccacaagctgcccgccagactggtggccgaccagaagaccaacctgcccgagtacctgcagaccctgctgaacaccctggcccccctgctgctgttcagagccagacccgtgcagatcgccgtgtaccacatgctgtacaagctgatgcccgagctgccccagtacgaccaggacaacctgaagagctacggcgacgaggaggaggagcccgccctgagcccccccgccgccctgatgagcctgctgagcatccaggaggacctgctggagaacgtgctgggctgcatccccgtgggccagatcgtgaccatcaagcccctgagcgaggacttctgctacgtgctgggctacctgctgacctggaagctgatcctgaccttcttcaaggccgccagcagccagctgagagccctgtacagcatgtacctgagaaagaccaagagcctgaacaagctgctgtaccacctgttcagactgatgcccgagaaccccacctacgccgagaccgccgtggaggtgcccaacaaggaccccaagaccttcttcaccgaggagctgcagctgagcatcagagagaccaccatgctgccctaccacatcccccacctggcctgcagcgtgtaccacatgaccctgaaggacctgcccgccatggtgagactgtggtggaacagcagcgagaagagagtgttcaacatcgtggacagattcaccagcaagtacgtgagcagcgtgctgagcttccaggagatcagcagcgtgcagaccagcacccagctgttcaacggcatgaccgtgaaggccagagccaccaccagagaggtgatggccacctacaccatcgaggacatcgtgatcgagctgatcatccagctgcccagcaactaccccctgggcagcatcatcgtggagagcggcaagagagtgggcgtggccgtgcagcagtggagaaactggatgctgcagctgagcacctacctgacccaccagaacggcagcatcatggagggcctggccctgtggaagaacaacgtggacaagagattcgagggcgtggaggactgcatgatctgcttcagcgtgatccacggcttcaactacagcctgcccaagaaggcctgcagaacctgcaagaagaagttccacagcgcctgcctgtacaagtggttcaccagcagcaacaagagcacctgccccctgtgcagagagaccttcttctag

SEQ ID NO: 87306 - DNA, 1404 bp, Artificial Sequence
  Description of Artificial Sequence: Synthetic coding sequence
atgaagaaccagaacggcaccttcaaggactgggccaacgccaacgtgagcagacagatcgaggacaccgtgctgtacggctactacaccctgtacagcgtgatcctgttctgcgtgttcttctggatccccttcgtgtacttctactacgaggagaaggacgacgacgacaccagcaagtgcacccagatcaagaccgccctgaagtacaccctgggcttcgtggtgatctgcgccctgctgctgctggtgggcgccttcgtgcccctgaacgtgcccaacaacaagaacagcaccgagtgggagaaggtgaagagcctgttcgaggagctgggcagcagccacggcctggccgccctgagcttcagcatcagcagcctgaccctgatcggcatgctggccgccatcacctacaccgcctacggcatgagcgccctgcccctgaacctgatcaagggcaccagaagcgccgcctacgagagactggagaacaccgaggacatcgaggaggtggagcagcacatccagaccatcaagagcaagagcaaggacggcagacccctgcccgccagagacaagagagccctgaagcagttcgaggagagactgagaaccctgaagaagagagagagacacctggagttcatcgagaacagctggtggaccaagttctgcggcgccctgagacccctgaagatcgtgtggggcatcttcttcatcctggtggccctgctgttcgtgatcagcctgttcctgagcaacctggacaaggccctgcacagcgccggcatcgacagcggcttcatcatcttcggcgccaacctgagcaaccccctgaacatgctgctgcccctgctgcagaccgtgttccccctggactacatcctgatcaccatcatcatcatgtacttcatcttcaccagcatggccggcatcagaaacatcggcatctggttcttctggatcagactgtacaagatcagaagaggcagaaccagaccccaggccctgctgttcctgtgcatgatcctgctgctgatcgtgctgcacaccagctacatgatctacagcctggccccccagtacgtgatgtacggcagccagaactacctgatcgagaccaacatcaccagcgacaaccacaagggcaacagcaccctgagcgtgcccaagagatgcgacgccgacgcccccgaggaccagtgcaccgtgaccagaacctacctgttcctgcacaagttctggttcttcagcgccgcctactacttcggcaactgggccttcctgggcgtgttcctgatcggcctgatcgtgagctgctgcaagggcaagaagagcgtgatcgagggcgtggacgaggacagcgacatcagcgacgacgagcccagcgtgtacagcgcctag

SEQ ID NO: 87307 - DNA, 1623 bp, Artificial Sequence
  Description of Artificial Sequence: Synthetic coding sequence
atggccaccagcggcgccgccagcgccgagctggtgatcggctggtgcatcttcggcctgctgctgctggccatcctggccttctgctggatctacgtgagaaagtaccagagcagaagagagagcgaggtggtgagcaccatcaccgccatcttcagcctggccatcgccctgatcaccagcgccctgctgcccgtggacatcttcctggtgagctacatgaagaaccagaacggcaccttcaaggactgggccaacgccaacgtgagcagacagatcgaggacaccgtgctgtacggctactacaccctgtacagcgtgatcctgttctgcgtgttcttctggatccccttcgtgtacttctactacgaggagaaggacgacgacgacaccagcaagtgcacccagatcaagaccgccctgaagtacaccctgggcttcgtggtgatctgcgccctgctgctgctggtgggcgccttcgtgcccctgaacgtgcccaacaacaagaacagcaccgagtgggagaaggtgaagagcctgttcgaggagctgggcagcagccacggcctggccgccctgagcttcagcatcagcagcctgaccctgatcggcatgctggccgccatcacctacaccgcctacggcatgagcgccctgcccctgaacctgatcaagggcaccagaagcgccgcctacgagagactggagaacaccgaggacatcgaggaggtggagcagcacatccagaccatcaagagcaagagcaaggacggcagacccctgcccgccagagacaagagagccctgaagcagttcgaggagagactgagaaccctgaagaagagagagagacacctggagttcatcgagaacagctggtggaccaagttctgcggcgccctgagacccctgaagatcgtgtggggcatcttcttcatcctggtggccctgctgttcgtgatcagcctgttcctgagcaacctggacaaggccctgcacagcgccggcatcgacagcggcttcatcatcttcggcgccaacctgagcaaccccctgaacatgctgctgcccctgctgcagaccgtgttccccctggactacatcctgatcaccatcatcatcatgtacttcatcttcaccagcatggccggcatcagaaacatcggcatctggttcttctggatcagactgtacaagatcagaagaggcagaaccagaccccaggccctgctgttcctgtgcatgatcctgctgctgatcgtgctgcacaccagctacatgatctacagcctggccccccagtacgtgatgtacggcagccagaactacctgatcgagaccaacatcaccagcgacaaccacaagggcaacagcaccctgagcgtgcccaagagatgcgacgccgacgcccccgaggaccagtgcaccgtgaccagaacctacctgttcctgcacaagttctggttcttcagcgccgcctactacttcggcaactgggccttcctgggcgtgttcctgatcggcctgatcgtgagctgctgcaagggcaagaagagcgtgatcgagggcgtggacgaggacagcgacatcagcgacgacgagcccagcgtgtacagcgcctag

SEQ ID NO: 87308 - DNA, 939 bp, Artificial Sequence
  Description of Artificial Sequence: Synthetic coding sequence
atgagctaccagaagaagcagcccaccccccagccccccgtggactgcgtgaagaccagcggcggcggcggcggcggcggcggcagcggcggcggcggctgcggcttcttcggcggcggcggcagcggcggcggcagcagcggcagcggctgcggctacagcggcggcggcggctacagcggcggcggctgcggcggcggcagcagcggcggcggcggcggcggcggcatcggcggctgcggcggcggcagcggcggcagcgtgaagtacagcggcggcggcggcagcagcggcggcggcagcggctgcttcagcagcggcggcggcggcagcggctgcttcagcagcggcggcggcggcagcagcggcggcggcagcggctgcttcagcagcggcggcggcggcagcagcggcggcggcagcggctgcttcagcagcggcggcggcggcttcagcggccaggccgtgcagtgccagagctacggcggcgtgagcagcggcggcagcagcggcggcggcagcggctgcttcagcagcggcggcggcggcggcagcgtgtgcggctacagcggcggcggcagcggctgcggcggcggcagcagcggcggcagcggcagcggctacgtgagcagccagcaggtgacccagaccagctgcgccccccagcccagctacggcggcggcagcagcggcggcggcggcagcggcggcagcggctgcttcagcagcggcggcggcggcggcagcagcggctgcggcggcggcagcagcggcatcggcagcggctgcatcatcagcggcggcggcagcgtgtgcggcggcggcagcagcggcggcggcggcggcggcagcagcgtgggcggcagcggcagcggcaagggcgtgcccatctgccaccagacccagcagaagcaggcccccacctggcccagcaagtag

SEQ ID NO: 87309 - DNA, 1002 bp, Artificial Sequence
  Description of Artificial Sequence: Synthetic coding sequence
atgagctaccagaagaagcagcccaccccccagccccccgtggactgcgtgaagaccagcggcggcggcggcggcggcggcggcagcggcggcggcggctgcggcttcttcggcggcggcggcagcggcggcggcagcagcggcagcggctgcggctacagcggcggcggcggctacagcggcggcggctgcggcggcggcagcagcggcggcggcggcggcggcggcatcggcggctgcggcggcggcagcggcggcagcgtgaagtacagcggcggcggcggcagcagcggcggcggcagcggctgcttcagcagcggcggcggcggcagcggctgcttcagcagcggcggcggcggcagcagcggcggcggcagcggctgcttcagcagcggcggcggcggcagcagcggcggcggcagcggctgcttcagcagcggcggcggcggcttcagcggccaggccgtgcagtgccagagctacggcggcgtgagcagcggcggcagcagcggcggcggcagcggctgcttcagcagcggcggcggcggcggcagcgtgtgcggctacagcggcggcggcagcggctgcggcggcggcagcagcggcggcagcggcagcggctacgtgagcagccagcaggtgacccagaccagctgcgccccccagcccagctacggcggcggcgtgagaagaagaagacagagaagaaagagactgctgctgcagagaagaggcagaagagagctgagactgagaagaagactgctgagagactggcagagactgcaccaccagtggagaggcctgagactgagaagatggttcctgtggagaagaagaagaagactgctgagaggctggctgagagagtggcagggcagacccgacctgccccccgaccccgccgaggccggcgcctacctggccgtgcagatcgacccccccggctaccacggcggcgagggcgtgggcggcgtgttccagggccacagatgggcctag

SEQ ID NO: 87310 - DNA, 927 bp, Artificial Sequence
  Description of Artificial Sequence: Synthetic coding sequence
atggacgccctgaagagcgccggcagagccctgatcagaagccccagcctggccaagcagagctggggcggcggcggcagacacagaaagctgcccgagaactggaccgacaccagagagaccctgctggagggcatgctgttcagcctgaagtacctgggcatgaccctggtggagcagcccaagggcgaggagctgagcgccgccgccatcaagagaatcgtggccaccgccaaggccagcggcaagaagctgcagaaggtgaccctgaaggtgagccccagaggcatcatcctgaccgacaacctgaccaaccagctgatcgagaacgtgagcatctacagaatcagctactgcaccgccgacaagatgcacgacaaggtgttcgcctacatcgcccagagccagcacaaccagagcctggagtgccacgccttcctgtgcaccaagagaaagatggcccaggccgtgaccctgaccgtggcccaggccttcaaggtggccttcgagttctggcaggtgagcaaggaggagaaggagaagagagacaaggccagccaggagggcggcgacgtgctgggcgccagacaggactgcacccccagcctgaagagcctggtggccaccggcaacctgctggacctggaggagaccgccaaggcccccctgagcaccgtgagcgccaacaccaccaacatggacgaggtgcccagaccccaggccctgagcggcagcagcgtggtgtgggagctggacgacggcctggacgaggccttcagcagactggcccagagcagaaccaacccccaggtgctggacaccggcctgaccgcccaggacatgcactacgcccagtgcctgagccccgtggactgggacaagcccgacagcagcggcaccgagcaggacgacctgttcagcttctag

SEQ ID NO: 87311 - DNA, 810 bp, Artificial Sequence; identical to SEQ ID NO: 76834
  Description of Artificial Sequence: Synthetic coding sequence

SEQ ID NO: 87312 - DNA, 13635 bp, Artificial Sequence
  Description of Artificial Sequence: Synthetic coding sequence
atgctgaccccccccctgctgctgctgctgcccctgctgagcgccctggtggccgccgccatcgacgcccccaagacctgcagccccaagcagttcgcctgcagagaccagatcacctgcatcagcaagggctggagatgcgacggcgagagagactgccccgacggcagcgacgaggcccccgagatctgcccccagagcaaggcccagagatgccagcccaacgagcacaactgcctgggcaccgagctgtgcgtgcccatgagcagactgtgcaacggcgtgcaggactgcatggacggcagcgacgagggcccccactgcagagagctgcagggcaactgcagcagactgggctgccagcaccactgcgtgcccaccctggacggccccacctgctactgcaacagcagcttccagctgcaggccgacggcaagacctgcaaggacttcgacgagtgcagcgtgtacggcacctgcagccagctgtgcaccaacaccgacggcagcttcatctgcggctgcgtggagggctacctgctgcagcccgacaacagaagctgcaaggccaagaacgagcccgtggacagaccccccgtgctgctgatcgccaacagccagaacatcctggccacctacctgagcggcgcccaggtgagcaccatcacccccaccagcaccagacagaccaccgccatggacttcagctacgccaacgagaccgtgtgctgggtgcacgtgggcgacagcgccgcccagacccagctgaagtgcgccagaatgcccggcctgaagggcttcgtggacgagcacaccatcaacatcagcctgagcctgcaccacgtggagcagatggccatcgactggctgaccggcaacttctacttcgtggacgacatcgacgacagaatcttcgtgtgcaacagaaacggcgacacctgcgtgaccctgctggacctggagctgtacaaccccaagggcatcgccctggaccccgccatgggcaaggtgttcttcaccgactacggccagatccccaaggtggagagatgcgacatggacggccagaacagaaccaagctggtggacagcaagatcgtgttcccccacggcatcaccctggacctggtgagcagactggtgtactgggccgacgcctacctggactacatcgaggtggtggactacgagggcaagggcagacagaccatcatccagggcatcctgatcgagcacctgtacggcctgaccgtgttcgagaactacctgtacgccaccaacagcgacaacgccaacgcccagcagaagaccagcgtgatcagagtgaacagattcaacagcaccgagtaccaggtggtgaccagagtggacaagggcggcgccctgcacatctaccaccagagaagacagcccagagtgagaagccacgcctgcgagaacgaccagtacggcaagcccggcggctgcagcgacatctgcctgctggccaacagccacaaggccagaacctgcagatgcagaagcggcttcagcctgggcagcgacggcaagagctgcaagaagcccgagcacgagctgttcctggtgtacggcaagggcagacccggcatcatcagaggcatggacatgggcgccaaggtgcccgacgagcacatgatccccatcgagaacctgatgaaccccagagccctggacttccacgccgagaccggcttcatctacttcgccgacaccaccagctacctgatcggcagacagaagatcgacggcaccgagagagagaccatcctgaaggacggcatccacaacgtggagggcgtggccgtggactggatgggcgacaacctgtactggaccgacgacggccccaagaagaccatcagcgtggccagactggagaaggccgcccagaccagaaagaccctgatcgagggcaagatgacccaccccagagccatcgtggtggaccccctgaacggctggatgtactggaccgactgggaggaggaccccaaggacagcagaagaggcagactggagagagcctggatggacggcagccacagagacatcttcgtgaccagcaagaccgtgctgtggcccaacggcctgagcctggacatccccgccggcagactgtactgggtggacgccttctacgacagaatcgagaccatcctgctgaacggcaccgacagaaagatcgtgtacgagggccccgagctgaaccacgccttcggcctgtgccaccacggcaactacctgttctggaccgagtacagaagcggcagcgtgtacagactggagagaggcgtgggcggcgccccccccaccgtgaccctgctgagaagcgagagaccccccatcttcgagatcagaatgtacgacgcccagcagcagcaggtgggcaccaacaagtgcagagtgaacaacggcggctgcagcagcctgtgcctggccacccccggcagcagacagtgcgcctgcgccgaggaccaggtgctggacgccgacggcgtgacctgcctggccaaccccagctacgtgccccccccccagtgccagcccggcgagttcgcctgcgccaacagcagatgcatccaggagagatggaagtgcgacggcgacaacgactgcctggacaacagcgacgaggcccccgccctgtgccaccagcacacctgccccagcgacagattcaagtgcgagaacaacagatgcatccccaacagatggctgtgcgacggcgacaacgactgcggcaacagcgaggacgagagcaacgccacctgcagcgccagaacctgcccccccaaccagttcagctgcgccagcggcagatgcatccccatcagctggacctgcgacctggacgacgactgcggcgacagaagcgacgagagcgccagctgcgcctaccccacctgcttccccctgacccagttcacctgcaacaacggcagatgcatcaacatcaactggagatgcgacaacgacaacgactgcggcgacaacagcgacgaggccggctgcagccacagctgcagcagcacccagttcaagtgcaacagcggcagatgcatccccgagcactggacctgcgacggcgacaacgactgcggcgactacagcgacgagacccacgccaactgcaccaaccaggccaccagaccccccggcggctgccacaccgacgagttccagtgcagactggacggcctgtgcatccccctgagatggagatgcgacggcgacaccgactgcatggacagcagcgacgagaagagctgcgagggcgtgacccacgtgtgcgaccccagcgtgaagttcggctgcaaggacagcgccagatgcatcagcaaggcctgggtgtgcgacggcgacaacgactgcgaggacaacagcgacgaggagaactgcgagagcctggcctgcagaccccccagccacccctgcgccaacaacaccagcgtgtgcctgccccccgacaagctgtgcgacggcaacgacgactgcggcgacggcagcgacgagggcgagctgtgcgaccagtgcagcctgaacaacggcggctgcagccacaactgcagcgtggcccccggcgagggcatcgtgtgcagctgccccctgggcatggagctgggccccgacaaccacacctgccagatccagagctactgcgccaagcacctgaagtgcagccagaagtgcgaccagaacaagttcagcgtgaagtgcagctgctacgagggctgggtgctggagcccgacggcgagagctgcagaagcctggaccccttcaagcccttcatcatcttcagcaacagacacgagatcagaagaatcgacctgcacaagggcgactacagcgtgctggtgcccggcctgagaaacaccatcgccctggacttccacctgagccagagcgccctgtactggaccgacgtggtggaggacaagatctacagaggcaagctgctggacaacggcgccctgaccagcttcgaggtggtgatccagtacggcctggccacccccgagggcctggccgtggactggatcgccggcaacatctactgggtggagagcaacctggaccagatcgaggtggccaagctggacggcaccctgagaaccaccctgctggccggcgacatcgagcaccccagagccatcgccctggaccccagagacggcatcctgttctggaccgactgggacgccagcctgcccagaatcgaggccgccagcatgagcggcgccggcagaagaaccgtgcacagagagaccggcagcggcggctggcccaacggcctgaccgtggactacctggagaagagaatcctgtggatcgacgccagaagcgacgccatctacagcgccagatacgacggcagcggccacatggaggtgctgagaggccacgagttcctgagccaccccttcgccgtgaccctgtacggcggcgaggtgtactggaccgactggagaaccaacaccctggccaaggccaacaagtggaccggccacaacgtgaccgtggtgcagagaaccaacacccagcccttcgacctgcaggtgtaccaccccagcagacagcccatggcccccaacccctgcgaggccaacggcggccagggcccctgcagccacctgtgcctgatcaactacaacagaaccgtgagctgcgcctgcccccacctgatgaagctgcacaaggacaacaccacctgctacgagttcaagaagttcctgctgtacgccagacagatggagatcagaggcgtggacctggacgccccctactacaactacatcatcagcttcaccgtgcccgacatcgacaacgtgaccgtgctggactacgacgccagagagcagagagtgtactggagcgacgtgagaacccaggccatcaagagagccttcatcaacggcaccggcgtggagaccgtggtgagcgccgacctgcccaacgcccacggcctggccgtggactgggtgagcagaaacctgttctggaccagctacgacaccaacaagaagcagatcaacgtggccagactggacggcagcttcaagaacgccgtggtgcagggcctggagcagccccacggcctggtggtgcaccccctgagaggcaagctgtactggaccgacggcgacaacatcagcatggccaacatggacggcagcaacagaaccctgctgttcagcggccagaagggccccgtgggcctggccatcgacttccccgagagcaagctgtactggatcagcagcggcaaccacaccatcaacagatgcaacctggacggcagcggcctggaggtgatcgacgccatgagaagccagctgggcaaggccaccgccctggccatcatgggcgacaagctgtggtgggccgaccaggtgagcgagaagatgggcacctgcagcaaggccgacggcagcggcagcgtggtgctgagaaacagcaccaccctggtgatgcacatgaaggtgtacgacgagagcatccagctggaccacaagggcaccaacccctgcagcgtgaacaacggcgactgcagccagctgtgcctgcccaccagcgagaccaccagaagctgcatgtgcaccgccggctacagcctgagaagcggccagcaggcctgcgagggcgtgggcagcttcctgctgtacagcgtgcacgagggcatcagaggcatccccctggaccccaacgacaagagcgacgccctggtgcccgtgagcggcaccagcctggccgtgggcatcgacttccacgccgagaacgacaccatctactgggtggacatgggcctgagcaccatcagcagagccaagagagaccagacctggagagaggacgtggtgaccaacggcatcggcagagtggagggcatcgccgtggactggatcgccggcaacatctactggaccgaccagggcttcgacgtgatcgaggtggccagactgaacggcagcttcagatacgtggtgatcagccagggcctggacaagcccagagccatcaccgtgcaccccgagaagggctacctgttctggaccgagtggggccagtaccccagaatcgagagaagcagactggacggcaccgagagagtggtgctggtgaacgtgagcatcagctggcccaacggcatcagcgtggactaccaggacggcaagctgtactggtgcgacgccagaaccgacaagatcgagagaatcgacctggagaccggcgagaacagagaggtggtgctgagcagcaacaacatggacatgttcagcgtgagcgtgttcgaggacttcatctactggagcgacagaacccacgccaacggcagcatcaagagaggcagcaaggacaacgccaccgacagcgtgcccctgagaaccggcatcggcgtgcagctgaaggacatcaaggtgttcaacagagacagacagaagggcaccaacgtgtgcgccgtggccaacggcggctgccagcagctgtgcctgtacagaggcagaggccagagagcctgcgcctgcgcccacggcatgctggccgaggacggcgccagctgcagagagtacgccggctacctgctgtacagcgagagaaccatcctgaagagcatccacctgagcgacgagagaaacctgaacgcccccgtgcagcccttcgaggaccccgagcacatgaagaacgtgatcgccctggccttcgactacagagccggcaccagccccggcacccccaacagaatcttcttcagcgacatccacttcggcaacatccagcagatcaacgacgacggcagcagaagaatcaccatcgtggagaacgtgggcagcgtggagggcctggcctaccacagaggctgggacaccctgtactggaccagctacaccaccagcaccatcaccagacacaccgtggaccagaccagacccggcgccttcgagagagagaccgtgatcaccatgagcggcgacgaccaccccagagccttcgtgctggacgagtgccagaacctgatgttctggaccaactggaacgagcagcaccccagcatcatgagagccgccctgagcggcgccaacgtgctgaccctgatcgagaaggacatcagaacccccaacggcctggccatcgaccacagagccgagaagctgtacttcagcgacgccaccctggacaagatcgagagatgcgagtacgacggcagccacagatacgtgatcctgaagagcgagcccgtgcaccccttcggcctggccgtgtacggcgagcacatcttctggaccgactgggtgagaagagccgtgcagagagccaacaagcacgtgggcagcaacatgaagctgctgagagtggacatcccccagcagcccatgggcatcatcgccgtggccaacgacaccaacagctgcgagctgagcccctgcagaatcaacaacggcggctgccaggacctgtgcctgctgacccaccagggccacgtgaactgcagctgcagaggcggcagaatcctgcaggacgacctgacctgcagagccgtgaacagcagctgcagagcccaggacgagttcgagtgcgccaacggcgagtgcatcaacttcagcctgacctgcgacggcgtgccccactgcaaggacaagagcgacgagaagcccagctactgcaacagcagaagatgcaagaagaccttcagacagtgcagcaacggcagatgcgtgagcaacatgctgtggtgcaacggcgccgacgactgcggcgacggcagcgacgagatcccctgcaacaagaccgcctgcggcgtgggcgagttcagatgcagagacggcacctgcatcggcaacagcagcagatgcaaccagttcgtggactgcgaggacgccagcgacgagatgaactgcagcgccaccgactgcagcagctacttcagactgggcgtgaagggcgtgctgttccagccctgcgagagaaccagcctgtgctacgcccccagctgggtgtgcgacggcgccaacgactgcggcgactacagcgacgagagagactgccccggcgtgaagagacccagatgccccctgaactacttcgcctgccccagcggcagatgcatccccatgagctggacctgcgacaaggaggacgactgcgagcacggcgaggacgagacccactgcaacaagttctgcagcgaggcccagttcgagtgccagaaccacagatgcatcagcaagcagtggctgtgcgacggcagcgacgactgcggcgacggcagcgacgaggccgcccactgcgagggcaagacctgcggccccagcagcttcagctgccccggcacccacgtgtgcgtgcccgagagatggctgtgcgacggcgacaaggactgcgccgacggcgccgacgagagcatcgccgccggctgcctgtacaacagcacctgcgacgacagagagttcatgtgccagaacagacagtgcatccccaagcacttcgtgtgcgaccacgacagagactgcgccgacggcagcgacgagagccccgagtgcgagtaccccacctgcggccccagcgagttcagatgcgccaacggcagatgcctgagcagcagacagtgggagtgcgacggcgagaacgactgccacgaccagagcgacgaggcccccaagaacccccactgcaccagccaggagcacaagtgcaacgccagcagccagttcctgtgcagcagcggcagatgcgtggccgaggccctgctgtgcaacggccaggacgactgcggcgacagcagcgacgagagaggctgccacatcaacgagtgcctgagcagaaagctgagcggctgcagccaggactgcgaggacctgaagatcggcttcaagtgcagatgcagacccggcttcagactgaaggacgacggcagaacctgcgccgacgtggacgagtgcagcaccaccttcccctgcagccagagatgcatcaacacccacggcagctacaagtgcctgtgcgtggagggctacgcccccagaggcggcgacccccacagctgcaaggccgtgaccgacgaggagcccttcctgatcttcgccaacagatactacctgagaaagctgaacctggacggcagcaactacaccctgctgaagcagggcctgaacaacgccgtggccctggacttcgactacagagagcagatgatctactggaccgacgtgaccacccagggcagcatgatcagaagaatgcacctgaacggcagcaacgtgcaggtgctgcacagaaccggcctgagcaaccccgacggcctggccgtggactgggtgggcggcaacctgtactggtgcgacaagggcagagacaccatcgaggtgagcaagctgaacggcgcctacagaaccgtgctggtgagcagcggcctgagagagcccagagccctggtggtggacgtgcagaacggctacctgtactggaccgactggggcgaccacagcctgatcggcagaatcggcatggacggcagcagcagaagcgtgatcgtggacaccaagatcacctggcccaacggcctgaccctggactacgtgaccgagagaatctactgggccgacgccagagaggactacatcgagttcgccagcctggacggcagcaacagacacgtggtgctgagccaggacatcccccacatcttcgccctgaccctgttcgaggactacgtgtactggaccgactgggagaccaagagcatcaacagagcccacaagaccaccggcaccaacaagaccctgctgatcagcaccctgcacagacccatggacctgcacgtgttccacgccctgagacagcccgacgtgcccaaccacccctgcaaggtgaacaacggcggctgcagcaacctgtgcctgctgagccccggcggcggccacaagtgcgcctgccccaccaacttctacctgggcagcgacggcagaacctgcgtgagcaactgcaccgccagccagttcgtgtgcaagaacgacaagtgcatccccttctggtggaagtgcgacaccgaggacgactgcggcgaccacagcgacgagccccccgactgccccgagttcaagtgcagacccggccagttccagtgcagcaccggcatctgcaccaaccccgccttcatctgcgacggcgacaacgactgccaggacaacagcgacgaggccaactgcgacatccacgtgtgcctgcccagccagttcaagtgcaccaacaccaacagatgcatccccggcatcttcagatgcaacggccaggacaactgcggcgacggcgaggacgagagagactgccccgaggtgacctgcgcccccaaccagttccagtgcagcatcaccaagagatgcatccccagagtgtgggtgtgcgacagagacaacgactgcgtggacggcagcgacgagcccgccaactgcacccagatgacctgcggcgtggacgagttcagatgcaaggacagcggcagatgcatccccgccagatggaagtgcgacggcgaggacgactgcggcgacggcagcgacgagcccaaggaggagtgcgacgagagaacctgcgagccctaccagttcagatgcaagaacaacagatgcgtgcccggcagatggcagtgcgactacgacaacgactgcggcgacaacagcgacgaggagagctgcacccccagaccctgcagcgagagcgagttcagctgcgccaacggcagatgcatcgccggcagatggaagtgcgacggcgaccacgactgcgccgacggcagcgacgagaaggactgcacccccagatgcgacatggaccagttccagtgcaagagcggccactgcatccccctgagatggagatgcgacgccgacgccgactgcatggacggcagcgacgaggaggcctgcggcaccggcgtgagaacctgccccctggacgagttccagtgcaacaacaccctgtgcaagcccctggcctggaagtgcgacggcgaggacgactgcggcgacaacagcgacgagaaccccgaggagtgcgccagattcgtgtgcccccccaacagacccttcagatgcaagaacgacagagtgtgcctgtggatcggcagacagtgcgacggcaccgacaactgcggcgacggcaccgacgaggaggactgcgagccccccaccgcccacaccacccactgcaaggacaagaaggagttcctgtgcagaaaccagagatgcctgagcagcagcctgagatgcaacatgttcgacgactgcggcgacggcagcgacgaggaggactgcagcatcgaccccaagctgaccagctgcgccaccaacgccagcatctgcggcgacgaggccagatgcgtgagaaccgagaaggccgcctactgcgcctgcagaagcggcttccacaccgtgcccggccagcccggctgccaggacatcaacgagtgcctgagattcggcacctgcagccagctgtgcaacaacaccaagggcggccacctgtgcagctgcgccagaaacttcatgaagacccacaacacctgcaaggccgagggcagcgagtaccaggtgctgtacatcgccgacgacaacgagatcagaagcctgttccccggccacccccacagcgcctacgagcaggccttccagggcgacgagagcgtgagaatcgacgccatggacgtgcacgtgaaggccggcagagtgtactggaccaactggcacaccggcaccatcagctacagaagcctgccccccgccgccccccccaccaccagcaacagacacagaagacagatcgacagaggcgtgacccacctgaacatcagcggcctgaagatgcccagaggcatcgccatcgactgggtggccggcaacgtgtactggaccgacagcggcagagacgtgatcgaggtggcccagatgaagggcgagaacagaaagaccctgatcagcggcatgatcgacgagccccacgccatcgtggtggaccccctgagaggcaccatgtactggagcgactggggcaaccaccccaagatcgagaccgccgccatggacggcaccctgagagagaccctggtgcaggacaacatccagtggcccaccggcctggccgtggactaccacaacgagagactgtactgggccgacgccaagctgagcgtgatcggcagcatcagactgaacggcaccgaccccatcgtggccgccgacagcaagagaggcctgagccaccccttcagcatcgacgtgttcgaggactacatctacggcgtgacctacatcaacaacagagtgttcaagatccacaagttcggccacagccccctggtgaacctgaccggcggcctgagccacgccagcgacgtggtgctgtaccaccagcacaagcagcccgaggtgaccaacccctgcgacagaaagaagtgcgagtggctgtgcctgctgagccccagcggccccgtgtgcacctgccccaacggcaagagactggacaacggcacctgcgtgcccgtgcccagccccacccccccccccgacgcccccagacccggcacctgcaacctgcagtgcttcaacggcggcagctgcttcctgaacgccagaagacagcccaagtgcagatgccagcccagatacaccggcgacaagtgcgagctggaccagtgctgggagcactgcagaaacggcggcacctgcgccgccagccccagcggcatgcccacctgcagatgccccaccggcttcaccggccccaagtgcacccagcaggtgtgcgccggctactgcgccaacaacagcacctgcaccgtgaaccagggcaaccagccccagtgcagatgcctgcccggcttcctgggcgacagatgccagtacagacagtgcagcggctactgcgagaacttcggcacctgccagatggccgccgacggcagcagacagtgcagatgcaccgcctacttcgagggcagcagatgcgaggtgaacaagtgcagcagatgcctggagggcgcctgcgtggtgaacaagcagagcggcgacgtgacctgcaactgcaccgacggcagagtggcccccagctgcctgacctgcgtgggccactgcagcaacggcggcagctgcaccatgaacagcaagatgatgcccgagtgccagtgccccccccacatgaccggccccagatgcgaggagcacgtgttcagccagcagcagcccggccacatcgccagcatcctgatccccctgctgctgctgctgctgctggtgctggtggccggcgtggtgttctggtacaagagaagagtgcagggcgccaagggcttccagcaccagagaatgaccaacggcgccatgaacgtggagatcggcaaccccacctacaagatgtacgagggcggcgagcccgacgacgtgggcggcctgctggacgccgacttcgccctggaccccgacaagcccaccaacttcaccaaccccgtgtacgccaccctgtacatgggcggccacggcagcagacacagcctggccagcaccgacgagaagagagagctgctgggcagaggccccgaggacgagatcggcgaccccctggcctag

SEQ ID NO: 87313 - DNA, 2142 bp, Artificial Sequence
  Description of Artificial Sequence: Synthetic coding sequence
atgctgctggccaccctgctgctgctgctgctgggcggcgccctggcccaccccgacagaatcatcttccccaaccacgcctgcgaggacccccccgccgtgctgctggaggtgcagggcaccctgcagagacccctggtgagagacagcagaaccagccccgccaactgcacctggctgatcctgggcagcaaggagcagaccgtgaccatcagattccagaagctgcacctggcctgcggcagcgagagactgaccctgagaagccccctgcagcccctgatcagcctgtgcgaggccccccccagccccctgcagctgcccggcggcaacgtgaccatcacctacagctacgccggcgccagagcccccatgggccagggcttcctgctgagctacagccaggactggctgatgtgcctgcaggaggagttccagtgcctgaaccacagatgcgtgagcgccgtgcagagatgcgacggcgtggacgcctgcggcgacggcagcgacgaggccggctgcagcagcgaccccttccccggcctgacccccagacccgtgcccagcctgccctgcaacgtgaccctggaggacttctacggcgtgttcagcagccccggctacacccacctggccagcgtgagccacccccagagctgccactggctgctggacccccacgacggcagaagactggccgtgagattcaccgccctggacctgggcttcggcgacgccgtgcacgtgtacgacggccccggcccccccgagagcagcagactgctgagaagcctgacccacttcagcaacggcaaggccgtgaccgtggagaccctgagcggccaggccgtggtgagctaccacaccgtggcctggagcaacggcagaggcttcaacgccacctaccacgtgagaggctactgcctgccctgggacagaccctgcggcctgggcagcggcctgggcgccggcgagggcctgggcgagagatgctacagcgaggcccagagatgcgacggcagctgggactgcgccgacggcaccgacgaggaggactgccccggctgcccccccggccacttcccctgcggcgccgccggcaccagcggcgccaccgcctgctacctgcccgccgacagatgcaactaccagaccttctgcgccgacggcgccgacgagagaagatgcagacactgccagcccggcaacttcagatgcagagacgagaagtgcgtgtacgagacctgggtgtgcgacggccagcccgactgcgccgacggcagcgacgagtgggactgcagctacgtgctgcccagaaaggtgatcaccgccgccgtgatcggcagcctggtgtgcggcctgctgctggtgatcgccctgggctgcacctgcaagctgtacgccatcagaacccaggagtacagcatcttcgcccccctgagcagaatggaggccgagatcgtgcagcagcaggccccccccagctacggccagctgatcgcccagggcgccatcccccccgtggaggacttccccaccgagaaccccaacgacaacagcgtgctgggcaacctgagaagcctgctgcagatcctgagacaggacatgacccccggcggcggccccggcgccagaagaagacagagaggcagactgatgagaagactggtgagaagactgagaagatggggcctgctgcccagaaccaacacccccgccagagccagcgaggccagaagccaggtgacccccagcgccgcccccctggaggccctggacggcggcaccggccccgccagagagggcggcgccgtgggcggccaggacggcgagcaggccccccccctgcccatcaaggcccccctgcccagcgccagcaccagccccgcccccaccaccgtgcccgaggcccccggccccctgcccagcctgcccctggagcccagcctgctgagcggcgtggtgcaggccctgagaggcagactgctgcccagcctgggcccccccggccccaccagaagcccccccggcccccacaccgccgtgctggccctggaggacgaggacgacgtgctgctggtgcccctggccgagcccggcgtgtgggtggccgaggccgaggacgagcccctgctgacctag

SEQ ID NO: 87314 - DNA, 1671 bp, Artificial Sequence
  Description of Artificial Sequence: Synthetic coding sequence
atgctgctggccaccctgctgctgctgctgctgggcggcgccctggcccaccccgacagaatcatcttccccaaccacgcctgcgaggacccccccgccgtgctgctggaggtgcagggcaccctgcagagacccctggtgagagacagcagaaccagccccgccaactgcacctggctgatcctgggcagcaaggagcagaccgtgaccatcagattccagaagctgcacctggcctgcggcagcgagagactgaccctgagaagccccctgcagcccctgatcagcctgtgcgaggccccccccagccccctgcagctgcccggcggcaacgtgaccatcacctacagctacgccggcgccagagcccccatgggccagggcttcctgctgagctacagccaggactggctgatgtgcctgcaggaggagttccagtgcctgaaccacagatgcgtgagcgccgtgcagagatgcgacggcgtggacgcctgcggcgacggcagcgacgaggccggctgcagcagcgaccccttccccggcctgacccccagacccgtgcccagcctgccctgcaacgtgaccctggaggacttctacggcgtgttcagcagccccggctacacccacctggccagcgtgagccacccccagagctgccactggctgctggacccccacgacggcagaagactggccgtgagattcaccgccctggacctgggcttcggcgacgccgtgcacgtgtacgacggccccggcccccccgagagcagcagactgctgagaagcctgacccacttcagcaacggcaaggccgtgaccgtggagaccctgagcggccaggccgtggtgagctaccacaccgtggcctggagcaacggcagaggcttcaacgccacctaccacgtgagaggctactgcctgccctgggacagaccctgcggcctgggcagcggcctgggcgccggcgagggcctgggcgagagatgctacagcgaggcccagagatgcgacggcagctgggactgcgccgacggcaccgacgaggaggactgccccggctgcccccccggccacttcccctgcggcgccgccggcaccagcggcgccaccgcctgctacctgcccgccgacagatgcaactaccagaccttctgcgccgacggcgccgacgagagaagatgcagacactgccagcccggcaacttcagatgcagagacgagaagtgcgtgtacgagacctgggtgtgcgacggccagcccgactgcgccgacggcagcgacgagtgggactgcagctacgtgctgcccagaaaggtgatcaccgccgccgtgatcggcagcctggtgtgcggcctgctgctggtgatcgccctgggctgcacctgcaagctgtacgccatcagaacccaggagtacagcatcttcgcccccctgagcagaatggaggccgagatcgtgcagcagcaggccccccccagctacggccagctgatcgcccagggcgccatcccccccgtggaggacttccccaccgagaaccccaacgacaacagcgtgctgggcaacctgagaagcctgctgcagatcctgagacaggacatgacccccggcggcggccccggcgccagaagaagacagagaggcagactgatgagaagactgtag

SEQ ID NO: 87315 - DNA, 13968 bp, Artificial Sequence
  Description of Artificial Sequence: Synthetic coding sequence
atggacagaggccccgccgccgtggcctgcaccctgctgctggccctggtggcctgcctggcccccgccagcggccaggagtgcgacagcgcccacttcagatgcggcagcggccactgcatccccgccgactggagatgcgacggcaccaaggactgcagcgacgacgccgacgagatcggctgcgccgtggtgacctgccagcagggctacttcaagtgccagagcgagggccagtgcatccccaacagctgggtgtgcgaccaggaccaggactgcgacgacggcagcgacgagagacaggactgcagccagagcacctgcagcagccaccagatcacctgcagcaacggccagtgcatccccagcgagtacagatgcgaccacgtgagagactgccccgacggcgccgacgagaacgactgccagtaccccacctgcgagcagctgacctgcgacaacggcgcctgctacaacaccagccagaagtgcgactggaaggtggactgcagagacagcagcgacgagatcaactgcaccgagatctgcctgcacaacgagttcagctgcggcaacggcgagtgcatccccagagcctacgtgtgcgaccacgacaacgactgccaggacggcagcgacgagcacgcctgcaactaccccacctgcggcggctaccagttcacctgccccagcggcagatgcatctaccagaactgggtgtgcgacggcgaggacgactgcaaggacaacggcgacgaggacggctgcgagagcggcccccacgacgtgcacaagtgcagccccagagagtggagctgccccgagagcggcagatgcatcagcatctacaaggtgtgcgacggcatcctggactgccccggcagagaggacgagaacaacaccagcaccggcaagtactgcagcatgaccctgtgcagcgccctgaactgccagtaccagtgccacgagaccccctacggcggcgcctgcttctgcccccccggctacatcatcaaccacaacgacagcagaacctgcgtggagttcgacgactgccagatctggggcatctgcgaccagaagtgcgagagcagacccggcagacacctgtgccactgcgaggagggctacatcctggagagaggccagtactgcaaggccaacgacagcttcggcgaggccagcatcatcttcagcaacggcagagacctgctgatcggcgacatccacggcagaagcttcagaatcctggtggagagccagaacagaggcgtggccgtgggcgtggccttccactaccacctgcagagagtgttctggaccgacaccgtgcagaacaaggtgttcagcgtggacatcaacggcctgaacatccaggaggtgctgaacgtgagcgtggagacccccgagaacctggccgtggactgggtgaacaacaagatctacctggtggagaccaaggtgaacagaatcgacatggtgaacctggacggcagctacagagtgaccctgatcaccgagaacctgggccaccccagaggcatcgccgtggaccccaccgtgggctacctgttcttcagcgactgggagagcctgagcggcgagcccaagctggagagagccttcatggacggcagcaacagaaaggacctggtgaagaccaagctgggctggcccgccggcgtgaccctggacatgatcagcaagagagtgtactgggtggacagcagattcgactacatcgagaccgtgacctacgacggcatccagagaaagaccgtggtgcacggcggcagcctgatcccccaccccttcggcgtgagcctgttcgagggccaggtgttcttcaccgactggaccaagatggccgtgctgaaggccaacaagttcaccgagaccaacccccaggtgtactaccaggccagcctgagaccctacggcgtgaccgtgtaccacagcctgagacagccctacgccaccaacccctgcaaggacaacaacggcggctgcgagcaggtgtgcgtgctgagccacagaaccgacaacgacggcctgggcttcagatgcaagtgcaccttcggcttccagctggacaccgacgagagacactgcatcgccgtgcagaacttcctgatcttcagcagccaggtggccatcagaggcatccccttcaccctgagcacccaggaggacgtgatggtgcccgtgagcggcaaccccagcttcttcgtgggcatcgacttcgacgcccaggacagcaccatcttcttcagcgacatgagcaagcacatgatcttcaagcagaagatcgacggcaccggcagagagatcctggccgccaacagagtggagaacgtggagagcctggccttcgactggatcagcaagaacctgtactggaccgacagccactacaagagcatcagcgtgatgagactggccgacaagaccagaagaaccgtggtgcagtacctgaacaaccccagaagcgtggtggtgcaccccttcgccggctacctgttcttcaccgactggttcagacccgccaagatcatgagagcctggagcgacggcagccacctgctgcccgtgatcaacaccaccctgggctggcccaacggcctggccatcgactgggccgccagcagactgtactgggtggacgcctacttcgacaagatcgagcacagcaccttcgacggcctggacagaagaagactgggccacatcgagcagatgacccaccccttcggcctggccatcttcggcgagcacctgttcttcaccgactggagactgggcgccatcatcagagtgagaaaggccgacggcggcgagatgaccgtgatcagaagcggcatcgcctacatcctgcacctgaagagctacgacgtgaacatccagaccggcagcaacgcctgcaaccagcccacccaccccaacggcgactgcagccacttctgcttccccgtgcccaacttccagagagtgtgcggctgcccctacggcatgagactggccagcaaccacctgacctgcgagggcgaccccaccaacgagccccccaccgagcagtgcggcctgttcagcttcccctgcaagaacggcagatgcgtgcccaactactacctgtgcgacggcgtggacgactgccacgacaacagcgacgagcagctgtgcggcaccctgaacaacacctgcagcagcagcgccttcacctgcggccacggcgagtgcatccccgcccactggagatgcgacaagagaaacgactgcgtggacggcagcgacgagcacaactgccccacccacgcccccgccagctgcctggacacccagtacacctgcgacaaccaccagtgcatcagcaagaactgggtgtgcgacaccgacaacgactgcggcgacggcagcgacgagaagaactgcaacagcaccgagacctgccagcccagccagttcaactgccccaaccacagatgcatcgacctgagcttcgtgtgcgacggcgacaaggactgcgtggacggcagcgacgaggtgggctgcgtgctgaactgcaccgccagccagttcaagtgcgccagcggcgacaagtgcatcggcgtgaccaacagatgcgacggcgtgttcgactgcagcgacaacagcgacgaggccggctgccccaccagaccccccggcatgtgccacagcgacgagttccagtgccaggaggacggcatctgcatccccaacttctgggagtgcgacggccaccccgactgcctgtacggcagcgacgagcacaacgcctgcgtgcccaagacctgccccagcagctacttccactgcgacaacggcaactgcatccacagagcctggctgtgcgacagagacaacgactgcggcgacatgagcgacgagaaggactgccccacccagcccttcagatgccccagctggcagtggcagtgcctgggccacaacatctgcgtgaacctgagcgtggtgtgcgacggcatcttcgactgccccaacggcaccgacgagagccccctgtgcaacggcaacagctgcagcgacttcaacggcggctgcacccacgagtgcgtgcaggagcccttcggcgccaagtgcctgtgccccctgggcttcctgctggccaacgacagcaagacctgcgaggacatcgacgagtgcgacatcctgggcagctgcagccagcactgctacaacatgagaggcagcttcagatgcagctgcgacaccggctacatgctggagagcgacggcagaacctgcaaggtgaccgccagcgagagcctgctgctgctggtggccagccagaacaagatcatcgccgacagcgtgaccagccaggtgcacaacatctacagcctggtggagaacggcagctacatcgtggccgtggacttcgacagcatcagcggcagaatcttctggagcgacgccacccagggcaagacctggagcgccttccagaacggcaccgacagaagagtggtgttcgacagcagcatcatcctgaccgagaccatcgccatcgactgggtgggcagaaacctgtactggaccgactacgccctggagaccatcgaggtgagcaagatcgacggcagccacagaaccgtgctgatcagcaagaacctgaccaaccccagaggcctggccctggaccccagaatgaacgagcacctgctgttctggagcgactggggccaccaccccagaatcgagagagccagcatggacggcagcatgagaaccgtgatcgtgcaggacaagatcttctggccctgcggcctgaccatcgactaccccaacagactgctgtacttcatggacagctacctggactacatggacttctgcgactacaacggccaccacagaagacaggtgatcgccagcgacctgatcatcagacacccctacgccctgaccctgttcgaggacagcgtgtactggaccgacagagccaccagaagagtgatgagagccaacaagtggcacggcggcaaccagagcgtggtgatgtacaacatccagtggcccctgggcatcgtggccgtgcaccccagcaagcagcccaacagcgtgaacccctgcgccttcagcagatgcagccacctgtgcctgctgagcagccagggcccccacttctacagctgcgtgtgccccagcggctggagcctgagccccgacctgctgaactgcctgagagacgaccagcccttcctgatcaccgtgagacagcacatcatcttcggcatcagcctgaaccccgaggtgaagagcaacgacgccatggtgcccatcgccggcatccagaacggcctggacgtggagttcgacgacgccgagcagtacatctactgggtggagaaccccggcgagatccacagagtgaagaccgacggcaccaacagaaccgtgttcgccagcatcagcatggtgggccccagcatgaacctggccctggactggatcagcagaaacctgtacagcaccaaccccagaacccagagcatcgaggtgctgaccctgcacggcgacatcagatacagaaagaccctgatcgccaacgacggcaccgccctgggcgtgggcttccccatcggcatcaccgtggaccccgccagaggcaagctgtactggagcgaccagggcaccgacagcggcgtgcccgccaagatcgccagcgccaacatggacggcaccagcgtgaagaccctgttcaccggcaacctggagcacctggagtgcgtgaccctggacatcgaggagcagaagctgtactgggccgtgaccggcagaggcgtgatcgagagaggcaacgtggacggcaccgacagaatgatcctggtgcaccagctgagccacccctggggcatcgccgtgcacgacagcttcctgtactacaccgacgagcagtacgaggtgatcgagagagtggacaaggccaccggcgccaacaagatcgtgctgagagacaacgtgcccaacctgagaggcctgcaggtgtaccacagaagaaacgccgccgagagcagcaacggctgcagcaacaacatgaacgcctgccagcagatctgcctgcccgtgcccggcggcctgttcagctgcgcctgcgccaccggcttcaagctgaaccccgacaacagaagctgcagcccctacaacagcttcatcgtggtgagcatgctgagcgccatcagaggcttcagcctggagctgagcgaccacagcgagaccatggtgcccgtggccggccagggcagaaacgccctgcacgtggacgtggacgtgagcagcggcttcatctactggtgcgacttcagcagcagcgtggccagcgacaacgccatcagaagaatcaagcccgacggcagcagcctgatgaacatcgtgacccacggcatcggcgagaacggcgtgagaggcatcgccgtggactgggtggccggcaacctgtacttcaccaacgccttcgtgagcgagaccctgatcgaggtgctgagaatcaacaccacctacagaagagtgctgctgaaggtgaccgtggacatgcccagacacatcgtggtggaccccaagaacagatacctgttctgggccgactacggccagagacccaagatcgagagaagcttcctggactgcaccaacagaaccgtgctggtgagcgagggcatcgtgacccccagaggcctggccgtggacagaagcgacggctacgtgtactgggtggacgacagcctggacatcatcgccagaatcagaatcaacggcgagaacagcgaggtgatcagatacggcagcagataccccaccccctacggcatcaccgtgttcgagaacagcatcatctgggtggacagaaacctgaagaagatcttccaggccagcaaggagcccgagaacaccgagccccccaccgtgatcagagacaacatcaactggctgagagacgtgaccatcttcgacaagcaggtgcagcccagaagccccgccgaggtgaacaacaacccctgcctggagaacaacggcggctgcagccacctgtgcttcgccctgcccggcctgcacacccccaagtgcgactgcgccttcggcaccctgcagagcgacggcaagaactgcgccatcagcaccgagaacttcctgatcttcgccctgagcaacagcctgagaagcctgcacctggaccccgagaaccacagcccccccttccagaccatcaacgtggagagaaccgtgatgagcctggactacgacagcgtgagcgacagaatctacttcacccagaacctggccagcggcgtgggccagatcagctacgccaccctgagcagcggcatccacacccccaccgtgatcgccagcggcatcggcaccgccgacggcatcgccttcgactggatcaccagaagaatctactacagcgactacctgaaccagatgatcaacagcatggccgaggacggcagcaacagaaccgtgatcgccagagtgcccaagcccagagccatcgtgctggacccctgccagggctacctgtactgggccgactgggacacccacgccaagatcgagagagccaccctgggcggcaacttcagagtgcccatcgtgaacagcagcctggtgatgcccagcggcctgaccctggactacgaggaggacctgctgtactgggtggacgccagcctgcagagaatcgagagaagcaccctgaccggcgtggacagagaggtgatcgtgaacgccgccgtgcacgccttcggcctgaccctgtacggccagtacatctactggaccgacctgtacacccagagaatctacagagccaacaagtacgacggcagcggccagatcgccatgaccaccaacctgctgagccagcccagaggcatcaacaccgtggtgaagaaccagaagcagcagtgcaacaacccctgcgagcagttcaacggcggctgcagccacatctgcgcccccggccccaacggcgccgagtgccagtgcccccacgagggcaactggtacctggccaacaacagaaagcactgcatcgtggacaacggcgagagatgcggcgccagcagcttcacctgcagcaacggcagatgcatcagcgaggagtggaagtgcgacaacgacaacgactgcggcgacggcagcgacgagatggagagcgtgtgcgccctgcacacctgcagccccaccgccttcacctgcgccaacggcagatgcgtgcagtacagctacagatgcgactactacaacgactgcggcgacggcagcgacgaggccggctgcctgttcagagactgcaacgccaccaccgagttcatgtgcaacaacagaagatgcatccccagagagttcatctgcaacggcgtggacaactgccacgacaacaacaccagcgacgagaagaactgccccgacagaacctgccagagcggctacaccaagtgccacaacagcaacatctgcatccccagagtgtacctgtgcgacggcgacaacgactgcggcgacaacagcgacgagaaccccacctactgcaccacccacacctgcagcagcagcgagttccagtgcgccagcggcagatgcatcccccagcactggtactgcgaccaggagaccgactgcttcgacgccagcgacgagcccgccagctgcggccacagcgagagaacctgcctggccgacgagttcaagtgcgacggcggcagatgcatccccagcgagtggatctgcgacggcgacaacgactgcggcgacatgagcgacgaggacaagagacaccagtgccagaaccagaactgcagcgacagcgagttcctgtgcgtgaacgacagaccccccgacagaagatgcatcccccagagctgggtgtgcgacggcgacgtggactgcaccgacggctacgacgagaaccagaactgcaccagaagaacctgcagcgagaacgagttcacctgcggctacggcctgtgcatccccaagatcttcagatgcgacagacacaacgactgcggcgactacagcgacgagagaggctgcctgtaccagacctgccagcagaaccagttcacctgccagaacggcagatgcatcagcaagaccttcgtgtgcgacgaggacaacgactgcggcgacggcagcgacgagctgatgcacctgtgccacacccccgagcccacctgccccccccacgagttcaagtgcgacaacggcagatgcatcgagatgatgaagctgtgcaaccacctggacgactgcctggacaacagcgacgagaagggctgcggcatcaacgagtgccacgaccccagcatcagcggctgcgaccacaactgcaccgacaccctgaccagcttctactgcagctgcagacccggctacaagctgatgagcgacaagagaacctgcgtggacatcgacgagtgcaccgagatgcccttcgtgtgcagccagaagtgcgagaacgtgatcggcagctacatctgcaagtgcgcccccggctacctgagagagcccgacggcaagacctgcagacagaacagcaacatcgagccctacctgatcttcagcaacagatactacctgagaaacctgaccatcgacggctacttctacagcctgatcctggagggcctggacaacgtggtggccctggacttcgacagagtggagaagagactgtactggatcgacacccagagacaggtgatcgagagaatgttcctgaacaagaccaacaaggagaccatcatcaaccacagactgcccgccgccgagagcctggccgtggactgggtgagcagaaagctgtactggctggacgccagactggacggcctgttcgtgagcgacctgaacggcggccacagaagaatgctggcccagcactgcgtggacgccaacaacaccttctgcttcgacaaccccagaggcctggccctgcacccccagtacggctacctgtactgggccgactggggccacagagcctacatcggcagagtgggcatggacggcaccaacaagagcgtgatcatcagcaccaagctggagtggcccaacggcatcaccatcgactacaccaacgacctgctgtactgggccgacgcccacctgggctacatcgagtacagcgacctggagggccaccacagacacaccgtgtacgacggcgccctgccccaccccttcgccatcaccatcttcgaggacaccatctactggaccgactggaacaccagaaccgtggagaagggcaacaagtacgacggcagcaacagacagaccctggtgaacaccacccacagacccttcgacatccacgtgtaccacccctacagacagcccatcgtgagcaacccctgcggcaccaacaacggcggctgcagccacctgtgcctgatcaagcccggcggcaagggcttcacctgcgagtgccccgacgacttcagaaccctgcagctgagcggcagcacctactgcatgcccatgtgcagcagcacccagttcctgtgcgccaacaacgagaagtgcatccccatctggtggaagtgcgacggccagaaggactgcagcgacggcagcgacgagctggccctgtgcccccagagattctgcagactgggccagttccagtgcagcgacggcaactgcaccagcccccagaccctgtgcaacgcccaccagaactgccccgacggcagcgacgaggacagactgctgtgcgagaaccaccactgcgacagcaacgagtggcagtgcgccaacaagagatgcatccccgagagctggcagtgcgacaccttcaacgactgcgaggacaacagcgacgaggacagcagccactgcgccagcagaacctgcagacccggccagttcagatgcgccaacggcagatgcatcccccaggcctggaagtgcgacgtggacaacgactgcggcgaccacagcgacgagcccatcgaggagtgcatgagcagcgcccacctgtgcgacaacttcaccgagttcagctgcaagaccaactacagatgcatccccaagtgggccgtgtgcaacggcgtggacgactgcagagacaacagcgacgagcagggctgcgaggagagaacctgccaccccgtgggcgacttcagatgcaagaaccaccactgcatccccctgagatggcagtgcgacggccagaacgactgcggcgacaacagcgacgaggagaactgcgcccccagagagtgcaccgagagcgagttcagatgcgtgaaccagcagtgcatccccagcagatggatctgcgaccactacaacgactgcggcgacaacagcgacgagagagactgcgagatgagaacctgccaccccgagtacttccagtgcaccagcggccactgcgtgcacagcgagctgaagtgcgacggcagcgccgactgcctggacgccagcgacgaggccgactgccccaccagattccccgacggcgcctactgccaggccaccatgttcgagtgcaagaaccacgtgtgcatccccccctactggaagtgcgacggcgacgacgactgcggcgacggcagcgacgaggagctgcacctgtgcctggacgtgccctgcaacagccccaacagattcagatgcgacaacaacagatgcatctacagccacgaggtgtgcaacggcgtggacgactgcggcgacggcaccgacgagaccgaggagcactgcagaaagcccacccccaagccctgcaccgagtacgagtacaagtgcggcaacggccactgcatcccccacgacaacgtgtgcgacgacgccgacgactgcggcgactggagcgacgagctgggctgcaacaagggcaaggagagaacctgcgccgagaacatctgcgagcagaactgcacccagctgaacgagggcggcttcatctgcagctgcaccgccggcttcgagaccaacgtgttcgacagaaccagctgcctggacatcaacgagtgcgagcagttcggcacctgcccccagcactgcagaaacaccaagggcagctacgagtgcgtgtgcgccgacggcttcaccagcatgagcgacagacccggcaagagatgcgccgccgagggcagcagccccctgctgctgctgcccgacaacgtgagaatcagaaagtacaacctgagcagcgagagattcagcgagtacctgcaggacgaggagtacatccaggccgtggactacgactgggaccccaaggacatcggcctgagcgtggtgtactacaccgtgagaggcgagggcagcagattcggcgccatcaagagagcctacatccccaacttcgagagcggcagaaacaacctggtgcaggaggtggacctgaagctgaagtacgtgatgcagcccgacggcatcgccgtggactgggtgggcagacacatctactggagcgacgtgaagaacaagagaatcgaggtggccaagctggacggcagatacagaaagtggctgatcagcaccgacctggaccagcccgccgccatcgccgtgaaccccaagctgggcctgatgttctggaccgactggggcaaggagcccaagatcgagagcgcctggatgaacggcgaggacagaaacatcctggtgttcgaggacctgggctggcccaccggcctgagcatcgactacctgaacaacgacagaatctactggagcgacttcaaggaggacgtgatcgagaccatcaagtacgacggcaccgacagaagagtgatcgccaaggaggccatgaacccctacagcctggacatcttcgaggaccagctgtactggatcagcaaggagaagggcgaggtgtggaagcagaacaagttcggccagggcaagaaggagaagaccctggtggtgaacccctggctgacccaggtgagaatcttccaccagctgagatacaacaagagcgtgcccaacctgtgcaagcagatctgcagccacctgtgcctgctgagacccggcggctacagctgcgcctgcccccagggcagcagcttcatcgagggcagcaccaccgagtgcgacgccgccatcgagctgcccatcaacctgccccccccctgcagatgcatgcacggcggcaactgctacttcgacgagaccgacctgcccaagtgcaagtgccccagcggctacaccggcaagtactgcgagatggccttcagcaagggcatcagccccggcaccaccgccgtggccgtgctgctgaccatcctgctgatcgtggtgatcggcgccctggccatcgccggcttcttccactacagaagaaccggcagcctgctgcccgccctgcccaagctgcccagcctgagcagcctggtgaagcccagcgagaacggcaacggcgtgaccttcagaagcggcgccgacctgaacatggacatcggcgtgagcggcttcggccccgagaccgccatcgacagaagcatggccatgagcgaggacttcgtgatggagatgggcaagcagcccatcatcttcgagaaccccatgtacagcgccagagacagcgccgtgaaggtggtgcagcccatccaggtgaccgtgagcgagaacgtggacaacaagaactacggcagccccatcaaccccagcgagatcgtgcccgagaccaaccccaccagccccgccgccgacggcacccaggtgaccaagtggaacctgttcaagagaaagagcaagcagaccaccaacttcgagaaccccatctacgcccagatggagaacgagcagaaggagagcgtggccgccacccccccccccagccccagcctgcccgccaagcccaagccccccagcagaagagaccccacccccacctacagcgccaccgaggacaccttcaaggacaccgccaacctggtgaaggaggacagcgaggtgtag

SEQ ID NO: 87316 - DNA, 3678 bp, Artificial Sequence
  Description of Artificial Sequence: Synthetic coding sequence
atggacagaggccccgccgccgtggcctgcaccctgctgctggccctggtggcctgcctggcccccgccagcggccaggagtgcgacagcgcccacttcagatgcggcagcggccactgcatccccgccgactggagatgcgacggcaccaaggactgcagcgacgacgccgacgagatcggctgcgccgtggtgacctgccagcagggctacttcaagtgccagagcgagggccagtgcatccccaacagctgggtgtgcgaccaggaccaggactgcgacgacggcagcgacgagagacaggactgcagccagagcacctgcagcagccaccagatcacctgcagcaacggccagtgcatccccagcgagtacagatgcgaccacgtgagagactgccccgacggcgccgacgagaacgactgccagtaccccacctgcgagcagctgacctgcgacaacggcgcctgctacaacaccagccagaagtgcgactggaaggtggactgcagagacagcagcgacgagatcaactgcaccgagatctgcctgcacaacgagttcagctgcggcaacggcgagtgcatccccagagcctacgtgtgcgaccacgacaacgactgccaggacggcagcgacgagcacgcctgcaactaccccacctgcggcggctaccagttcacctgccccagcggcagatgcatctaccagaactgggtgtgcgacggcgaggacgactgcaaggacaacggcgacgaggacggctgcgagagcggcccccacgacgtgcacaagtgcagccccagagagtggagctgccccgagagcggcagatgcatcagcatctacaaggtgtgcgacggcatcctggactgccccggcagagaggacgagaacaacaccagcaccggcaagtactgcagcatgaccctgtgcagcgccctgaactgccagtaccagtgccacgagaccccctacggcggcgcctgcttctgcccccccggctacatcatcaaccacaacgacagcagaacctgcgtggagttcgacgactgccagatctggggcatctgcgaccagaagtgcgagagcagacccggcagacacctgtgccactgcgaggagggctacatcctggagagaggccagtactgcaaggccaacgacagcttcggcgaggccagcatcatcttcagcaacggcagagacctgctgatcggcgacatccacggcagaagcttcagaatcctggtggagagccagaacagaggcgtggccgtgggcgtggccttccactaccacctgcagagagtgttctggaccgacaccgtgcagaacaaggtgttcagcgtggacatcaacggcctgaacatccaggaggtgctgaacgtgagcgtggagacccccgagaacctggccgtggactgggtgaacaacaagatctacctggtggagaccaaggtgaacagaatcgacatggtgaacctggacggcagctacagagtgaccctgatcaccgagaacctgggccaccccagaggcatcgccgtggaccccaccgtgggcaagaccgtggtgcacggcggcagcctgatcccccaccccttcggcgtgagcctgttcgagggccaggtgttcttcaccgactggaccaagatggccgtgctgaaggccaacaagttcaccgagaccaacccccaggtgtactaccaggccagcctgagaccctacggcgtgaccgtgtaccacagcctgagacagccctacgccaccaacccctgcaaggacaacaacggcggctgcgagcaggtgtgcgtgctgagccacagaaccgacaacgacggcctgggcttcagatgcaagtgcaccttcggcttccagctggacaccgacgagagacactgcatcggcagagagatcctggccgccaacagagtggagaacgtggagagcctggccttcgactggatcagcaagaacctgtactggaccgacagccactacaagagcatcagcgtgatgagactggccgacaagaccagaagaaccgtggtgcagtacctgaacaaccccagaagcgtggtggtgcaccccttcgccggctacctgttcttcaccgactggttcagacccgccaagatcatgagagcctggagcgacggcagccacctgctgcccgtgatcaacaccaccctgggctggcccaacggcctggccatcgactgggccgccagcagactgtactgggtggacgcctacttcgacaagatcgagcacagcaccttcgacggcctggacagaagaagactgggccacatcgagcagatgacccaccccttcggcctggccatcttcggcgagcacctgttcttcaccgactggagactgggcgccatcatcagagtgagaaaggccgacggcggcgagatgaccgtgatcagaagcggcatcgcctacatcctgcacctgaagagctacgacgtgaacatccagaccggcagcaacgcctgcaaccagcccacccaccccaacggcgactgcagccacttctgcttccccgtgcccaacttccagagagtgtgcggctgcccctacggcatgagactggccagcaaccacctgacctgcgagggcgaccccaccaacgagccccccaccgagcagtgcggcctgttcagcttcccctgcaagaacggcagatgcgtgcccaactactacctgtgcgacggcgtggacgactgccacgacaacagcgacgagcagctgtgcggcaccctgaacaacacctgcagcagcagcgccttcacctgcggccacggcgagtgcatccccgcccactggagatgcgacaagagaaacgactgcgtggacggcagcgacgagcacaactgccccacccacgcccccgccagctgcctggacacccagtacacctgcgacaaccaccagtgcatcagcaagaactgggtgtgcgacaccgacaacgactgcggcgacggcagcgacgagaagaactgcaacagcaccgagacctgccagcccagccagttcaactgccccaaccacagatgcatcgacctgagcttcgtgtgcgacggcgacaaggactgcgtggacggcagcgacgaggtgggctgcgtgctgaactgcaccgccagccagttcaagtgcgccagcggcgacaagtgcatcggcgtgaccaacagatgcgacggcgtgttcgactgcagcgacaacagcgacgaggccggctgccccaccagaccccccggcatgtgccacagcgacgagttccagtgccaggaggacggcatctgcatccccaacttctgggagtgcgacggccaccccgactgcctgtacggcagcgacgagcacaacgcctgcgtgcccaagacctgccccagcagctacttccactgcgacaacggcaactgcatccacagagcctggctgtgcgacagagacaacgactgcggcgacatgagcgacgagaaggactgccccacccagcccttcagatgccccagctggcagtggcagtgcctgggccacaacatctgcgtgaacctgagcgtggtgtgcgacggcatcttcgactgccccaacggcaccgacgagagccccctgtgcagcaagttccccgaccacagcctgctggccatcaacagcttctag

SEQ ID NO: 87317 - DNA, 1941 bp, Artificial Sequence
  Description of Artificial Sequence: Synthetic coding sequence
atgctggcccagcactgcgtggacgccaacaacaccttctgcttcgacaaccccagaggcctggccctgcacccccagtacggctacctgtactgggccgactggggccacagagcctacatcggcagagtgggcatggacggcaccaacaagagcgtgatcatcagcaccaagctggagtggcccaacggcatcaccatcgactacaccaacgacctgctgtactgggccgacgcccacctgggctacatcgagtacagcgacctggagggccaccacagacacaccgtgtacgacggcgccctgccccaccccttcgccatcaccatcttcgaggacaccatctactggaccgactggaacaccagaaccgtggagaagggcaacaagtacgacggcagcaacagacagaccctggtgaacaccacccacagacccttcgacatccacgtgtaccacccctacagacagcccatcgtgagcaacccctgcggcaccaacaacggcggctgcagccacctgtgcctgatcaagcccggcggcaagggcttcacctgcgagtgccccgacgacttcagaaccctgcagctgagcggcagcacctactgcatgcccatgtgcagcagcacccagttcctgtgcgccaacaacgagaagtgcatccccatctggtggaagtgcgacggccagaaggactgcagcgacggcagcgacgagctggccctgtgcccccagagattctgcagactgggccagttccagtgcagcgacggcaactgcaccagcccccagaccctgtgcaacgcccaccagaactgccccgacggcagcgacgaggacagactgctgtgcgagaaccaccactgcgacagcaacgagtggcagtgcgccaacaagagatgcatccccgagagctggcagtgcgacaccttcaacgactgcgaggacaacagcgacgaggacagcagccactgcgccagcagaacctgcagacccggccagttcagatgcgccaacggcagatgcatcccccaggcctggaagtgcgacgtggacaacgactgcggcgaccacagcgacgagcccatcgaggagtgcatgagcagcgcccacctgtgcgacaacttcaccgagttcagctgcaagaccaactacagatgcatccccaagtgggccgtgtgcaacggcgtggacgactgcagagacaacagcgacgagcagggctgcgaggagagaacctgccaccccgtgggcgacttcagatgcaagaaccaccactgcatccccctgagatggcagtgcgacggccagaacgactgcggcgacaacagcgacgaggagaactgcgcccccagagagtgcaccgagagcgagttcagatgcgtgaaccagcagtgcatccccagcagatggatctgcgaccactacaacgactgcggcgacaacagcgacgagagagactgcggcatgagactgatgaagctgatcgtgccccacgccttcctgatggtgcacaccgccagactgctgtgcagcaacgccaagaccatgttcgtgagcagacacatcggcaacgtgatggccatgatgaccgtggccatggtgcagatgaagaacttcacctgcgcctggatgttccccgtgatccaccagaccgtgagcggcgtgaccaccatcgccgccttcatcgtgatgagatgcgccatggtgtggatgaccgtggagatggagctgatgagacagagaagcaccgtggagaacagacccctgaacctggtgcagaacatgaacatcagcgtggccatgggcatcgccttccacatgaccatgtgcgtgatgatgcccatgaccgtggtgaccggccccatgaactgggtggccatcaaggagaagaaggagcacgtgctgaagatctacgccagcaagatcgtgcccaactag

SEQ ID NO: 87318 - DNA, 2313 bp, Artificial Sequence
  Description of Artificial Sequence: Synthetic coding sequence
atggagaagagagccgccgccggcctggagggcgcccccggcgccagagcccagctggccgtggtgtgcctggtgaacatcttcctgaccggcagactgagcagcgccgtgcccgccctggccgcctgcagcggcaagctggagcagcacaccgagagaagaggcgtgatctacagccccgcctggcccctgaactacccccccggcaccaactgcagctggtacatccagggcgacagaggcgacatgatcaccatcagcttcagaaacttcgacgtggaggagagccaccagtgcagcctggactggctgctgctgggccccgccgccccccccagacaggaggccttcagactgtgcggcagcgccatcccccccgccttcatcagcgccagagaccacgtgtggatcttcttccacagcgacgccagcagcagcggccaggcccagggcttcagactgagctacatcagaggcaagctgggccaggccagctgccaggccgacgagttcagatgcgacaacggcaagtgcctgcccggcccctggcagtgcaacaccgtggacgagtgcggcgacggcagcgacgagggcaactgcagcgcccccgccagcgagccccccggcagcctgtgccccggcggcaccttcccctgcagcggcgccagaagcaccagatgcctgcccgtggagagaagatgcgacggcctgcaggactgcggcgacggcagcgacgaggccggctgccccgacctggcctgcggcagaagactgggcagcttctacggcagcttcgccagccccgacctgttcggcgccgccagaggccccagcgacctgcactgcacctggctggtggacacccaggacagcagaagagtgctgctgcagctggagctgagactgggctacgacgactacgtgcaggtgtacgagggcctgggcgagagaggcgacagactgctgcagaccctgagctacagaagcaaccacagacccgtgagcctggaggccgcccagggcagactgaccgtggcctaccacgccagagccagaagcgccggccacggcttcaacgccacctaccaggtgaagggctactgcctgccctgggagcagccctgcggcagcagcagcgacagcgacggcggcagcctgggcgaccagggctgcttcagcgagccccagagatgcgacggctggtggcactgcgccagcggcagagacgagcagggctgccccgcctgcccccccgaccagtacccctgcgagggcggcagcggcctgtgctacacccccgccgacagatgcaacaaccagaagagctgccccgacggcgccgacgagaagaactgcttcagctgccagcccggcaccttccactgcggcaccaacctgtgcatcttcgagacctggagatgcgacggccaggaggactgccaggacggcagcgacgagcacggctgcctggccgccgtgcccagaaaggtgatcaccgccgccctgatcggcagcctggtgtgcggcctgctgctggtgatcgccctgggctgcgccttcaagctgtacagcctgagaacccaggagtacagagccttcgagacccagatgaccagactggaggccgagttcgtgagaagagaggccccccccagctacggccagctgatcgcccagggcctgatcccccccgtggaggacttccccgtgtacagcgccagccaggccagcgtgctgcagaacctgagaaccgccatgagaagacagatgagaagacacgccagcagaagaggccccagcagaagaagactgggcagactgtggaacagactgttccacagacccagagcccccagaggccagatccccctgctgaccgccgccagacccagccagaccgtgctgggcgacggcttcctgcagcccgcccccggcgccgcccccgacccccccgcccccctgatggacaccggcagcaccagagccgccggcgacagaccccccagcgcccccggcagagcccccgaggtgggccccagcggcccccccctgcccagcggcctgagagaccccgagtgcagacccgtggacaaggacagaaaggtgtgcagagagcccctggtggacggccccgcccccgccgacgcccccagagagccctgcagcgcccaggacccccacccccaggtgagcaccgccagcagcaccctgggcccccacagccccgagcccctgggcgtgtgcagaaaccccccccccccctgcagccccatgctggaggccagcgacgacgaggccctgctggtgtgctag

SEQ ID NO: 87319 - DNA, 858 bp, Artificial Sequence
  Description of Artificial Sequence: Synthetic coding sequence
atgggcaaccacctgcccgccttcggccccagaccccccggcagaagagaggccctgctgagccccgactgccccctgctgagactgcaccccaccggcaagctgggccaggccagctgccaggccgacgagttcagatgcgacaacggcaagtgcctgcccggcccctggcagtgcaacaccgtggacgagtgcggcgacggcagcgacgagggcaactgcagcgcccccgccagcgagccccccggcagcctgtgccccggcggcaccttcccctgcagcggcgccagaagcaccagatgcctgcccgtggagagaagatgcgacggcctgcaggactgcggcgacggcagcgacgaggccggctgccccgacctggcctgcggcagaagactgggcagcttctacggcagcttcgccagccccgacctgttcggcgccgccagaggccccagcgacctgcactgcacctggctggtggacacccaggacagcagaagagtgctgctgcagctggagctgagactgggctacgacgactacgtgcaggtgtacgagggcctgggcgagagaggcgacagactgctgcagaccctgagctacagaagcaaccacagacccgtgagcctggaggccgcccagggcagactgaccgtggcctaccacgccagagccagaagcgccggccacggcttcaacgccacctaccaggtgaagggctactgcctgccctgggagcagccctgcggcagcagcagcgacagcgacggcggcagcctgggcgaccagggctgcttcagcgagccccagagatgcgacggctggtggcactgcgccagcggcagagacgagcagtag

SEQ ID NO: 87320 - DNA, 5718 bp, Artificial Sequence
  Description of Artificial Sequence: Synthetic coding sequence
atgagaagacagtggggcgccctgctgctgggcgccctgctgtgcgcccacggcctggccagcagccccgagtgcgcctgcggcagaagccacttcacctgcgccgtgagcgccctgggcgagtgcacctgcatccccgcccagtggcagtgcgacggcgacaacgactgcggcgaccacagcgacgaggacggctgcatcctgcccacctgcagccccctggacttccactgcgacaacggcaagtgcatcagaagaagctgggtgtgcgacggcgacaacgactgcgaggacgacagcgacgagcaggactgcccccccagagagtgcgaggaggacgagttcccctgccagaacggctactgcatcagaagcctgtggcactgcgacggcgacaacgactgcggcgacaacagcgacgagcagtgcgacatgagaaagtgcagcgacaaggagttcagatgcagcgacggcagctgcatcgccgagcactggtactgcgacggcgacaccgactgcaaggacggcagcgacgaggagaactgccccagcgccgtgcccgcccccccctgcaacctggaggagttccagtgcgcctacggcagatgcatcctggacatctaccactgcgacggcgacgacgactgcggcgactggagcgacgagagcgactgcagcagccaccagccctgcagaagcggcgagttcatgtgcgacagcggcctgtgcatcaacgccggctggagatgcgacggcgacgccgactgcgacgaccagagcgacgagagaaactgcaccaccagcatgtgcaccgccgagcagttcagatgccacagcggcagatgcgtgagactgagctggagatgcgacggcgaggacgactgcgccgacaacagcgacgaggagaactgcgagaacaccggcagcccccagtgcgccctggaccagttcctgtgctggaacggcagatgcatcggccagagaaagctgtgcaacggcgtgaacgactgcggcgacaacagcgacgagagcccccagcagaactgcagacccagaaccggcgaggagaactgcaacgtgaacaacggcggctgcgcccagaagtgccagatggtgagaggcgccgtgcagtgcacctgccacaccggctacagactgaccgaggacggccacacctgccaggacgtgaacgagtgcgccgaggagggctactgcagccagggctgcaccaacagcgagggcgccttccagtgctggtgcgagaccggctacgagctgagacccgacagaagaagctgcaaggccctgggccccgagcccgtgctgctgttcgccaacagaatcgacatcagacaggtgctgccccacagaagcgagtacaccctgctgctgaacaacctggagaacgccatcgccctggacttccaccacagaagagagctggtgttctggagcgacgtgaccctggacagaatcctgagagccaacctgaacggcagcaacgtggaggaggtggtgagcaccggcctggagagccccggcggcctggccgtggactgggtgcacgacaagctgtactggaccgacagcggcaccagcagaatcgaggtggccaacctggacggcgcccacagaaaggtgctgctgtggcagaacctggagaagcccagagccatcgccctgcaccccatggagggcaccatctactggaccgactggggcaacacccccagaatcgaggccagcagcatggacggcagcggcagaagaatcatcgccgacacccacctgttctggcccaacggcctgaccatcgactacgccggcagaagaatgtactgggtggacgccaagcaccacgtgatcgagagagccaacctggacggcagccacagaaaggccgtgatcagccagggcctgccccaccccttcgccatcaccgtgttcgaggacagcctgtactggaccgactggcacaccaagagcatcaacagcgccaacaagttcaccggcaagaaccaggagatcatcagaaacaagctgcacttccccatggacatccacaccctgcacccccagagacagcccgccggcaagaacagatgcggcgacaacaacggcggctgcacccacctgtgcctgcccagcggccagaactacacctgcgcctgccccaccggcttcagaaagatcagcagccacgcctgcgcccagagcctggacaagttcctgctgttcgccagaagaatggacatcagaagaatcagcttcgacaccgaggacctgagcgacgacgtgatccccctggccgacgtgagaagcgccgtggccctggactgggacagcagagacgaccacgtgtactggaccgacgtgagcaccgacaccatcagcagagccaagtgggacggcaccggccaggaggtggtggtggacaccagcctggagagccccgccggcctggccatcgactgggtgaccaacaagctgtactggaccgacgccggcaccgacagaatcgaggtggccaacaccgacggcagcatgagaaccgtgctgatctgggagaacctggacagacccagagacatcgtggtggagcccatgggcggctacatgtactggaccgactggggcgccagccccaagatcgagagagccggcatggacgccagcggcagacaggtgatcatcagcagcaacctgacctggcccaacggcctggccatcgactacggcagccagagactgtactgggccgacgccggcatgaagaccatcgagttcgccggcctggacggcagcaagagaaaggtgctgatcggcagccagctgccccaccccttcggcctgaccctgtacggcgagagaatctactggaccgactggcagaccaagagcatccagagcgccgacagactgaccggcctggacagagagaccctgcaggagaacctggagaacctgatggacatccacgtgttccacagaagaagaccccccgtgagcaccccctgcgccatggagaacggcggctgcagccacctgtgcctgagaagccccaaccccagcggcttcagctgcacctgccccaccggcatcaacctgctgagcgacggcaagacctgcagccccggcatgaacagcttcctgatcttcgccagaagaatcgacatcagaatggtgagcctggacatcccctacttcgccgacgtggtggtgcccatcaacatcaccatgaagaacaccatcgccatcggcgtggacccccaggagggcaaggtgtactggagcgacagcaccctgcacagaatcagcagagccaacctggacggcagccagcacgaggacatcatcaccaccggcctgcagaccaccgacggcctggccgtggacgccatcggcagaaaggtgtactggaccgacaccggcaccaacagaatcgaggtgggcaacctggacggcagcatgagaaaggtgctggtgtggcagaacctggacagccccagagccatcgtgctgtaccacgagatgggcttcatgtactggaccgactggggcgagaacgccaagctggagagaagcggcatggacggcagcgacagagccgtgctgatcaacaacaacctgggctggcccaacggcctgaccgtggacaaggccagcagccagctgctgtgggccgacgcccacaccgagagaatcgaggccgccgacctgaacggcgccaacagacacaccctggtgagccccgtgcagcacccctacggcctgaccctgctggacagctacatctactggaccgactggcagaccagaagcatccacagagccgacaagggcaccggcagcaacgtgatcctggtgagaagcaacctgcccggcctgatggacatgcaggccgtggacagagcccagcccctgggcttcaacaagtgcggcagcagaaacggcggctgcagccacctgtgcctgcccagacccagcggcttcagctgcgcctgccccaccggcatccagctgaagggcgacggcaagacctgcgaccccagccccgagacctacctgctgttcagcagcagaggcagcatcagaagaatcagcctggacaccagcgaccacaccgacgtgcacgtgcccgtgcccgagctgaacaacgtgatcagcctggactacgacagcgtggacggcaaggtgtactacaccgacgtgttcctggacgtgatcagaagagccgacctgaacggcagcaacatggagaccgtgatcggcagaggcctgaagaccaccgacggcctggccgtggactgggtggccagaaacctgtactggaccgacaccggcagaaacaccatcgaggccagcagactggacggcagctgcagaaaggtgctgatcaacaacagcctggacgagcccagagccatcgccgtgttccccagaaagggctacctgttctggaccgactggggccacatcgccaagatcgagagagccaacctggacggcagcgagagaaaggtgctgatcaacaccgacctgggctggcccaacggcctgaccctggactacgacaccagaagaatctactgggtggacgcccacctggacagaatcgagagcgccgacctgaacggcaagctgagacaggtgctggtgagccacgtgagccaccccttcgccctgacccagcaggacagatggatctactggaccgactggcagaccaagagcatccagagagtggacaagtacagcggcagaaacaaggagaccgtgctggccaacgtggagggcctgatggacatcatcgtggtgagcccccagagacagaccggcaccaacgcctgcggcgtgaacaacggcggctgcacccacctgtgcttcgccagagccagcgacttcgtgtgcgcctgccccgacgagcccgacagcagaccctgcagcctggtgcccggcctggtgccccccgcccccagagccaccggcatgagcgagaagagccccgtgctgcccaacaccccccccaccaccctgtacagcagcaccaccagaaccagaaccagcctggaggaggtggagggcagatgcagcgagagagacgccagactgggcctgtgcgccagaagcaacgacgccgtgcccgccgcccccggcgagggcctgcacatcagctacgccatcggcggcctgctgagcatcctgctgatcctggtggtgatcgccgccctgatgctgtacagacacaagaagagcaagttcaccgaccccggcatgggcaacctgacctacagcaaccccagctacagaaccagcacccaggaggtgaagatcgaggccatccccaagcccgccatgtacaaccagctgtgctacaagaaggagggcggccccgaccacaactacaccaaggagaagatcaagatcgtggagggcatctgcctgctgagcggcgacgacgccgagtgggacgacctgaagcagctgagaagcagcagaggcggcctgctgagagaccacgtgtgcatgaagaccgacaccgtgagcatccaggccagcagcggcagcctggacgacaccgagaccgagcagctgctgcaggaggagcagagcgagtgcagcagcgtgcacaccgccgccacccccgagagaagaggcagcctgcccgacaccggctggaagcacgagagaaagctgagcagcgagagccaggtgtag

SEQ ID NO: 87321 - DNA, 4848 bp, Artificial Sequence
  Description of Artificial Sequence: Synthetic coding sequence
atggaggccgccccccccggccccccctggcccctgctgctgctgctgctgctgctgctggccctgtgcggctgccccgcccccgccgccgccagccccctgctgctgttcgccaacagaagagacgtgagactggtggacgccggcggcgtgaagctggagagcaccatcgtggtgagcggcctggaggacgccgccgccgtggacttccagttcagcaagggcgccgtgtactggaccgacgtgagcgaggaggccatcaagcagacctacctgaaccagaccggcgccgccgtgcagaacgtggtgatcagcggcctggtgagccccgacggcctggcctgcgactgggtgggcaagaagctgtactggaccgacagcgagaccaacagaatcgaggtggccaacctgaacggcaccagcagaaaggtgctgttctggcaggacctggaccagcccagagccatcgccctggaccccgcccacggctacatgtactggaccgactggggcgagacccccagaatcgagagagccggcatggacggcagcaccagaaagatcatcgtggacagcgacatctactggcccaacggcctgaccatcgacctggaggagcagaagctgtactgggccgacgccaagctgagcttcatccacagagccaacctggacggcagcttcagacagaaggtggtggagggcagcctgacccaccccttcgccctgaccctgagcggcgacaccctgtactggaccgactggcagaccagaagcatccacgcctgcaacaagagaaccggcggcaagagaaaggagatcctgagcgccctgtacagccccatggacatccaggtgctgagccaggagagacagcccttcttccacaccagatgcgaggaggacaacggcggctgcagccacctgtgcctgctgagccccagcgagcccttctacacctgcgcctgccccaccggcgtgcagctgcaggacaacggcagaacctgcaaggccggcgccgaggaggtgctgctgctggccagaagaaccgacctgagaagaatcagcctggacacccccgacttcaccgacatcgtgctgcaggtggacgacatcagacacgccatcgccatcgactacgaccccctggagggctacgtgtactggaccgacgacgaggtgagagccatcagaagagcctacctggacggcagcggcgcccagaccctggtgaacaccgagatcaacgaccccgacggcatcgccgtggactgggtggccagaaacctgtactggaccgacaccggcaccgacagaatcgaggtgaccagactgaacggcaccagcagaaagatcctggtgagcgaggacctggacgagcccagagccatcgccctgcaccccgtgatgggcctgatgtactggaccgactggggcgagaaccccaagatcgagtgcgccaacctggacggccaggagagaagagtgctggtgaacgccagcctgggctggcccaacggcctggccctggacctgcaggagggcaagctgtactggggcgacgccaagaccgacaagatcgaggtgatcaacgtggacggcaccaagagaagaaccctgctggaggacaagctgccccacatcttcggcttcaccctgctgggcgacttcatctactggaccgactggcagagaagaagcatcgagagagtgcacaaggtgaaggccagcagagacgtgatcatcgaccagctgcccgacctgatgggcctgaaggccgtgaacgtggccaaggtggtgggcaccaacccctgcgccgacagaaacggcggctgcagccacctgtgcttcttcaccccccacgccaccagatgcggctgccccatcggcctggagctgctgagcgacatgaagacctgcatcgtgcccgaggccttcctggtgttcaccagcagagccgccatccacagaatcagcctggagaccaacaacaacgacgtggccatccccctgaccggcgtgaaggaggccagcgccctggacttcgacgtgagcaacaaccacatctactggaccgacgtgagcctgaagaccatcagcagagccttcatgaacggcagcagcgtggagcacgtggtggagttcggcctggactaccccgagggcatggccgtggactggatgggcaagaacctgtactgggccgacaccggcaccaacagaatcgaggtggccagactggacggccagttcagacaggtgctggtgtggagagacctggacaaccccagaagcctggccctggaccccaccaagggctacatctactggaccgagtggggcggcaagcccagaatcgtgagagccttcatggacggcaccaactgcatgaccctggtggacaaggtgggcagagccaacgacctgaccatcgactacgccgaccagagactgtactggaccgacctggacaccaacatgatcgagagcagcaacatgctgggccaggagagagtggtgatcgccgacgacctgccccaccccttcggcctgacccagtacagcgactacatctactggaccgactggaacctgcacagcatcgagagagccgacaagaccagcggcagaaacagaaccctgatccagggccacctggacttcgtgatggacatcctggtgttccacagcagcagacaggacggcctgaacgactgcatgcacaacaacggccagtgcggccagctgtgcctggccatccccggcggccacagatgcggctgcgccagccactacaccctggaccccagcagcagaaactgcagcccccccaccaccttcctgctgttcagccagaagagcgccatcagcagaatgatccccgacgaccagcacagccccgacctgatcctgcccctgcacggcctgagaaacgtgaaggccatcgactacgaccccctggacaagttcatctactgggtggacggcagacagaacatcaagagagccaaggacgacggcacccagcccttcgtgctgaccagcctgagccagggccagaaccccgacagacagccccacgacctgagcatcgacatctacagcagaaccctgttctggacctgcgaggccaccaacaccatcaacgtgcacagactgagcggcgaggccatgggcgtggtgctgagaggcgacagagacaagcccagagccatcgtggtgaacgccgagagaggctacctgtacttcaccaacatgcaggacagagccgccaagatcgagagagccgccctggacggcaccgagagagaggtgctgttcaccaccggcctgatcagacccgtggccctggtggtggacaacaccctgggcaagctgttctgggtggacgccgacctgaagagaatcgagagctgcgacctgagcggcgccaacagactgaccctggaggacgccaacatcgtgcagcccctgggcctgaccatcctgggcaagcacctgtactggatcgacagacagcagcagatgatcgagagagtggagaagaccaccggcgacaagagaaccagaatccagggcagagtggcccacctgaccggcatccacgccgtggaggaggtgagcctggaggagttcagcgcccacccctgcgccagagacaacggcggctgcagccacatctgcatcgccaagggcgacggcacccccagatgcagctgccccgtgcacctggtgctgctgcagaacctgctgacctgcggcgagccccccacctgcagccccgaccagttcgcctgcgccaccggcgagatcgactgcatccccggcgcctggagatgcgacggcttccccgagtgcgacgaccagagcgacgaggagggctgccccgtgtgcagcgccgcccagttcccctgcgccagaggccagtgcgtggacctgagactgagatgcgacggcgaggccgactgccaggacagaagcgacgaggccgactgcgacgccatctgcctgcccaaccagttcagatgcgccagcggccagtgcgtgctgatcaagcagcagtgcgacagcttccccgactgcatcgacggcagcgacgagctgatgtgcgagatcaccaagccccccagcgacgacagccccgcccacagcagcgccatcggccccgtgatcggcatcatcctgagcctgttcgtgatgggcggcgtgtacttcgtgtgccagagagtggtgtgccagagatacgccggcgccaacggccccttcccccacgagtacgtgagcggcaccccccacgtgcccctgaacttcatcgcccccggcggcagccagcacggccccttcaccggcatcgcctgcggcaagagcatgatgagcagcgtgagcctgatgggcggcagaggcggcgtgcccctgtacgacagaaaccacgtgaccggcgccagcagcagcagcagcagcagcaccaaggccaccctgtacccccccatcctgaaccccccccccagccccgccaccgaccccagcctgtacaacatggacatgttctacagcagcaacatccccgccaccgccagaccctacagaccctacatcatcagaggcatggccccccccaccaccccctgcagcaccgacgtgtgcgacagcgactacagcgccagcagatggaaggccagcaagtactacctggacctgaacagcgacagcgacccctacccccccccccccaccccccacagccagtacctgagcgccgaggacagctgcccccccagccccgccaccgagagaagctacttccacctgttcccccccccccccagcccctgcaccgacagcagctag

SEQ ID NO: 87322 - DNA, 4842 bp, Artificial Sequence
  Description of Artificial Sequence: Synthetic coding sequence
atgggcgccgtgctgagaagcctgctggcctgcagcttctgcgtgctgctgagagccgcccccctgctgctgtacgccaacagaagagacctgagactggtggacgccaccaacggcaaggagaacgccaccatcgtggtgggcggcctggaggacgccgccgccgtggacttcgtgttcagccacggcctgatctactggagcgacgtgagcgaggaggccatcaagagaaccgagttcaacaagaccgagagcgtgcagaacgtggtggtgagcggcctgctgagccccgacggcctggcctgcgactggctgggcgagaagctgtactggaccgacagcgagaccaacagaatcgaggtgagcaacctggacggcagcctgagaaaggtgctgttctggcaggagctggaccagcccagagccatcgccctggaccccagcagcggcttcatgtactggaccgactggggcgaggtgcccaagatcgagagagccggcatggacggcagcagcagattcatcatcatcaacagcgagatctactggcccaacggcctgaccctggactacgaggagcagaagctgtactgggccgacgccaagctgaacttcatccacaagagcaacctggacggcaccaacagacaggccgtggtgaagggcagcctgccccaccccttcgccctgaccctgttcgaggacatcctgtactggaccgactggagcacccacagcatcctggcctgcaacaagtacaccggcgagggcctgagagagatccacagcgacatcttcagccccatggacatccacgccttcagccagcagagacagcccaacgccaccaacccctgcggcatcgacaacggcggctgcagccacctgtgcctgatgagccccgtgaagcccttctaccagtgcgcctgccccaccggcgtgaagctgctggagaacggcaagacctgcaaggacggcgccaccgagctgctgctgctggccagaagaaccgacctgagaagaatcagcctggacacccccgacttcaccgacatcgtgctgcagctggaggacatcagacacgccatcgccatcgactacgaccccgtggagggctacatctactggaccgacgacgaggtgagagccatcagaagaagcttcatcgacggcagcggcagccagttcgtggtgaccgcccagatcgcccaccccgacggcatcgccgtggactgggtggccagaaacctgtactggaccgacaccggcaccgacagaatcgaggtgaccagactgaacggcaccatgagaaagatcctgatcagcgaggacctggaggagcccagagccatcgtgctggaccccatggtgggctacatgtactggaccgactggggcgagatccccaagatcgagagagccgccctggacggcagcgacagagtggtgctggtgaacaccagcctgggctggcccaacggcctggccctggactacgacgagggcaagatctactggggcgacgccaagaccgacaagatcgaggtgatgaacaccgacggcaccggcagaagagtgctggtggaggacaagatcccccacatcttcggcttcaccctgctgggcgactacgtgtactggaccgactggcagagaagaagcatcgagagagtgcacaagagaagcgccgagagagaggtgatcatcgaccagctgcccgacctgatgggcctgaaggccaccaacgtgcacagagtgatcggcagcaacccctgcgccgaggagaacggcggctgcagccacctgtgcctgtacagaccccagggcctgagatgcgcctgccccatcggcttcgagctgatcagcgacatgaagacctgcatcgtgcccgaggccttcctgctgttcagcagaagagccgacatcagaagaatcagcctggagaccaacaacaacaacgtggccatccccctgaccggcgtgaaggaggccagcgccctggacttcgacgtgaccgacaacagaatctactggaccgacatcagcctgaagaccatcagcagagccttcatgaacggcagcgccctggagcacgtggtggagttcggcctggactaccccgagggcatggccgtggactggctgggcaagaacctgtactgggccgacaccggcaccaacagaatcgaggtgagcaagctggacggccagcacagacaggtgctggtgtggaaggacctggacagccccagagccctggccctggaccccgccgagggcttcatgtactggaccgagtggggcggcaagcccaagatcgacagagccgccatggacggcagcgagagaaccaccctggtgcccaacgtgggcagagccaacggcctgaccatcgactacgccaagagaagactgtactggaccgacctggacaccaacctgatcgagagcagcaacatgctgggcctgaacagagaggtgatcgccgacgacctgccccaccccttcggcctgacccagtaccaggactacatctactggaccgactggagcagaagaagcatcgagagagccaacaagaccagcggccagaacagaaccatcatccagggccacctggactacgtgatggacatcctggtgttccacagcagcagacagagcggctggaacgagtgcgccagcagcaacggccactgcagccacctgtgcctggccgtgcccgtgggcggcttcgtgtgcggctgccccgcccactacagcctgaacgccgacaacagaacctgcagcgcccccaccaccttcctgctgttcagccagaagagcgccatcaacagaatggtgatcgacgagcagcagagccccgacatcatcctgcccatccacagcctgagaaacgtgagagccatcgactacgaccccctggacaagcagctgtactggatcgacagcagacagaacatgatcagaaaggcccaggaggacggcagccagggcttcaccgtggtggtgagcagcgtgcccagccagaacctggagatccagccctacgacctgagcatcgacatctacagcagatacatctactggacctgcgaggccaccaacgtgatcaacgtgaccagactggacggcagaagcgtgggcgtggtgctgaagggcgagcaggacagacccagagccgtggtggtgaaccccgagaagggctacatgtacttcaccaacctgcaggagagaagccccaagatcgagagagccgccctggacggcaccgagagagaggtgctgttcttcagcggcctgagcaagcccatcgccctggccctggacagcagactgggcaagctgttctgggccgacagcgacctgagaagaatcgagagcagcgacctgagcggcgccaacagaatcgtgctggaggacagcaacatcctgcagcccgtgggcctgaccgtgttcgagaactggctgtactggatcgacaagcagcagcagatgatcgagaagatcgacatgaccggcagagagggcagaaccaaggtgcaggccagaatcgcccagctgagcgacatccacgccgtgaaggagctgaacctgcaggagtacagacagcacccctgcgcccaggacaacggcggctgcagccacatctgcctggtgaagggcgacggcaccaccagatgcagctgccccatgcacctggtgctgctgcaggacgagctgagctgcggcgagccccccacctgcagcccccagcagttcacctgcttcaccggcgagatcgactgcatccccgtggcctggagatgcgacggcttcaccgagtgcgaggaccacagcgacgagctgaactgccccgtgtgcagcgagagccagttccagtgcgccagcggccagtgcatcgacggcgccctgagatgcaacggcgacgccaactgccaggacaagagcgacgagaagaactgcgaggtgctgtgcctgatcgaccagttcagatgcgccaacggccagtgcatcggcaagcacaagaagtgcgaccacaacgtggactgcagcgacaagagcgacgagctggactgctaccccaccgaggagcccgccccccaggccaccaacaccgtgggcagcgtgatcggcgtgatcgtgaccatcttcgtgagcggcaccgtgtacttcatctgccagagaatgctgtgccccagaatgaagggcgacggcgagaccatgaccaacgactacgtggtgcacggccccgccagcgtgcccctgggctacgtgccccaccccagcagcctgagcggcagcctgcccggcatgagcagaggcaagagcatgatcagcagcctgagcatcatgggcggcagcagcggccccccctacgacagagcccacgtgaccggcgccagcagcagcagcagcagcagcaccaagggcacctacttccccgccatcctgaaccccccccccagccccgccaccgagagaagccactacaccatggagttcggctacagcagcaacagccccagcacccacagaagctacagctacagaccctacagctacagacacttcgccccccccaccaccccctgcagcaccgacgtgtgcgacagcgactacgcccccagcagaagaatgaccagcgtggccaccgccaagggctacaccagcgacctgaactacgacagcgagcccgtgccccccccccccacccccagaagccagtacctgagcgccgaggagaactacgagagctgcccccccagcccctacaccgagagaagctacagccaccacctgtacccccccccccccagcccctgcaccgacagcagctag

SEQ ID NO: 87323 - DNA, 4437 bp, Artificial Sequence
  Description of Artificial Sequence: Synthetic coding sequence
tgactggaccagcccagagccatcgccctggaccccagcagcggcttcatgtactggaccgactggggcgaggtgcccaagatcgagagagccggcatggacggcagcagcagattcatcatcatcaacagcgagatctactggcccaacggcctgaccctggactacgaggagcagaagctgtactgggccgacgccaagctgaacttcatccacaagagcaacctggacggcaccaacagacaggccgtggtgaagggcagcctgccccaccccttcgccctgaccctgttcgaggacatcctgtactggaccgactggagcacccacagcatcctggcctgcaacaagtacaccggcgagggcctgagagagatccacagcgacatcttcagccccatggacatccacgccttcagccagcagagacagcccaacgccaccaacccctgcggcatcgacaacggcggctgcagccacctgtgcctgatgagccccgtgaagcccttctaccagtgcgcctgccccaccggcgtgaagctgctggagaacggcaagacctgcaaggacggcgccaccgagctgctgctgctggccagaagaaccgacctgagaagaatcagcctggacacccccgacttcaccgacatcgtgctgcagctggaggacatcagacacgccatcgccatcgactacgaccccgtggagggctacatctactggaccgacgacgaggtgagagccatcagaagaagcttcatcgacggcagcggcagccagttcgtggtgaccgcccagatcgcccaccccgacggcatcgccgtggactgggtggccagaaacctgtactggaccgacaccggcaccgacagaatcgaggtgaccagactgaacggcaccatgagaaagatcctgatcagcgaggacctggaggagcccagagccatcgtgctggaccccatggtgggctacatgtactggaccgactggggcgagatccccaagatcgagagagccgccctggacggcagcgacagagtggtgctggtgaacaccagcctgggctggcccaacggcctggccctggactacgacgagggcaagatctactggggcgacgccaagaccgacaagatcgaggtgatgaacaccgacggcaccggcagaagagtgctggtggaggacaagatcccccacatcttcggcttcaccctgctgggcgactacgtgtactggaccgactggcagagaagaagcatcgagagagtgcacaagagaagcgccgagagagaggtgatcatcgaccagctgcccgacctgatgggcctgaaggccaccaacgtgcacagagtgatcggcagcaacccctgcgccgaggagaacggcggctgcagccacctgtgcctgtacagaccccagggcctgagatgcgcctgccccatcggcttcgagctgatcagcgacatgaagacctgcatcgtgcccgaggccttcctgctgttcagcagaagagccgacatcagaagaatcagcctggagaccaacaacaacaacgtggccatccccctgaccggcgtgaaggaggccagcgccctggacttcgacgtgaccgacaacagaatctactggaccgacatcagcctgaagaccatcagcagagccttcatgaacggcagcgccctggagcacgtggtggagttcggcctggactaccccgagggcatggccgtggactggctgggcaagaacctgtactgggccgacaccggcaccaacagaatcgaggtgagcaagctggacggccagcacagacaggtgctggtgtggaaggacctggacagccccagagccctggccctggaccccgccgagggcttcatgtactggaccgagtggggcggcaagcccaagatcgacagagccgccatggacggcagcgagagaaccaccctggtgcccaacgtgggcagagccaacggcctgaccatcgactacgccaagagaagactgtactggaccgacctggacaccaacctgatcgagagcagcaacatgctgggcctgaacagagaggtgatcgccgacgacctgccccaccccttcggcctgacccagtaccaggactacatctactggaccgactggagcagaagaagcatcgagagagccaacaagaccagcggccagaacagaaccatcatccagggccacctggactacgtgatggacatcctggtgttccacagcagcagacagagcggctggaacgagtgcgccagcagcaacggccactgcagccacctgtgcctggccgtgcccgtgggcggcttcgtgtgcggctgccccgcccactacagcctgaacgccgacaacagaacctgcagcgcccccaccaccttcctgctgttcagccagaagagcgccatcaacagaatggtgatcgacgagcagcagagccccgacatcatcctgcccatccacagcctgagaaacgtgagagccatcgactacgaccccctggacaagcagctgtactggatcgacagcagacagaacatgatcagaaaggcccaggaggacggcagccagggcttcaccgtggtggtgagcagcgtgcccagccagaacctggagatccagccctacgacctgagcatcgacatctacagcagatacatctactggacctgcgaggccaccaacgtgatcaacgtgaccagactggacggcagaagcgtgggcgtggtgctgaagggcgagcaggacagacccagagccgtggtggtgaaccccgagaagggctacatgtacttcaccaacctgcaggagagaagccccaagatcgagagagccgccctggacggcaccgagagagaggtgctgttcttcagcggcctgagcaagcccatcgccctggccctggacagcagactgggcaagctgttctgggccgacagcgacctgagaagaatcgagagcagcgacctgagcggcgccaacagaatcgtgctggaggacagcaacatcctgcagcccgtgggcctgaccgtgttcgagaactggctgtactggatcgacaagcagcagcagatgatcgagaagatcgacatgaccggcagagagggcagaaccaaggtgcaggccagaatcgcccagctgagcgacatccacgccgtgaaggagctgaacctgcaggagtacagacagcacccctgcgcccaggacaacggcggctgcagccacatctgcctggtgaagggcgacggcaccaccagatgcagctgccccatgcacctggtgctgctgcaggacgagctgagctgcggcgagccccccacctgcagcccccagcagttcacctgcttcaccggcgagatcgactgcatccccgtggcctggagatgcgacggcttcaccgagtgcgaggaccacagcgacgagctgaactgccccgtgtgcagcgagagccagttccagtgcgccagcggccagtgcatcgacggcgccctgagatgcaacggcgacgccaactgccaggacaagagcgacgagaagaactgcgaggtgctgtgcctgatcgaccagttcagatgcgccaacggccagtgcatcggcaagcacaagaagtgcgaccacaacgtggactgcagcgacaagagcgacgagctggactgctaccccaccgaggagcccgccccccaggccaccaacaccgtgggcagcgtgatcggcgtgatcgtgaccatcttcgtgagcggcaccgtgtacttcatctgccagagaatgctgtgccccagaatgaagggcgacggcgagaccatgaccaacgactacgtggtgcacggccccgccagcgtgcccctgggctacgtgccccaccccagcagcctgagcggcagcctgcccggcatgagcagaggcaagagcatgatcagcagcctgagcatcatgggcggcagcagcggccccccctacgacagagcccacgtgaccggcgccagcagcagcagcagcagcagcaccaagggcacctacttccccgccatcctgaaccccccccccagccccgccaccgagagaagccactacaccatggagttcggctacagcagcaacagccccagcacccacagaagctacagctacagaccctacagctacagacacttcgccccccccaccaccccctgcagcaccgacgtgtgcgacagcgactacgcccccagcagaagaatgaccagcgtggccaccgccaagggctacaccagcgacctgaactacgacagcgagcccgtgccccccccccccacccccagaagccagtacctgagcgccgaggagaactacgagagctgcccccccagcccctacaccgagagaagctacagccaccacctgtacccccccccccccagcccctgcaccgacagcagctag

SEQ ID NO: 87324 - DNA, 2382 bp, Artificial Sequence
  Description of Artificial Sequence: Synthetic coding sequence
atgggcctgcccgagcccggccccctgagactgctggccctgctgctgctgctgctgctgctgctgctgctgcagctgcagcacctggccgccgccgccgccgaccccctgctgggcggccagggccccgccaaggactgcgagaaggaccagttccagtgcagaaacgagagatgcatccccagcgtgtggagatgcgacgaggacgacgactgcctggaccacagcgacgaggacgactgccccaagaagacctgcgccgacagcgacttcacctgcgacaacggccactgcatccacgagagatggaagtgcgacggcgaggaggagtgccccgacggcagcgacgagagcgaggccacctgcaccaagcaggtgtgccccgccgagaagctgagctgcggccccaccagccacaagtgcgtgcccgccagctggagatgcgacggcgagaaggactgcgagggcggcgccgacgaggccggctgcgccacctggctgaacgagtgcctgcacaacaacggcggctgcagccacatctgcaccgacctgaagatcggcttcgagtgcacctgccccgccggcttccagctgctggaccagaagacctgcggcgacatcgacgagtgcaaggaccccgacgcctgcagccagatctgcgtgaactacaagggctacttcaagtgcgagtgctaccccggctacgagatggacctgctgaccaagaactgcaaggccgccgccggcaagagccccagcctgatcttcaccaacagacacgaggtgagaagaatcgacctggtgaagagaaactacagcagactgatccccatgctgaagaacgtggtggccctggacgtggaggtggccaccaacagaatctactggtgcgacctgagctacagaaagatctacagcgcctacatggacaaggccagcgaccccaaggagcaggaggtgctgatcgacgagcagctgcacagccccgagggcctggccgtggactgggtgcacaagcacatctactggaccgacagcggcaacaagaccatcagcgtggccaccgtggacggcggcagaagaagaaccctgttcagcagaaacctgagcgagcccagagccatcgccgtggaccccctgagaggcttcatgtactggagcgactggggcgaccaggccaagatcgagaagagcggcctgaacggcgtggacagacagaccctggtgagcgacaacatcgagtggcccaacggcatcaccctggacctgctgagccagagactgtactgggtggacagcaagctgcaccagctgagcagcatcgacttcagcggcggcaacagaaagaccctgatcagcagcaccgacttcctgagccaccccttcggcatcgccgtgttcgaggacaaggtgttctggaccgacctggagaacgaggccatcttcagcgccaacagactgaacggcctggagatcagcatcctggccgagaacctgaacaacccccacgacatcgtgatcttccacgagctgaagcagcccagagcccccgacgcctgcgagctgagcgtgcagcccaacggcggctgcgagtacctgtgcctgcccgccccccagatcagcagccacagccccaagtacacctgcgcctgccccgacaccatgtggctgggccccgacatgaagagatgctacagagccccccagagcaccagcaccaccaccctggccagcaccatgaccagaaccgtgcccgccaccaccagagcccccggcaccaccgtgcacagaagcacctaccagaaccacagcaccgagacccccagcctgaccgccgccgtgcccagcagcgtgagcgtgcccagagcccccagcatcagccccagcaccctgagccccgccaccagcaaccacagccagcactacgccaacgaggacagcaagatgggcagcaccgtgaccgccgccgtgatcggcatcatcgtgcccatcgtggtgatcgccctgctgtgcatgagcggctacctgatctggagaaactggaagagaaagaacaccaagagcatgaacttcgacaaccccgtgtacagaaagaccaccgaggaggaggacgaggacgagctgcacatcggcagaaccgcccagatcggccacgtgtaccccgccgccatcagcagcttcgacagacccctgtgggccgagccctgcctgggcgagaccagagagcccgaggaccccgcccccgccctgaaggagctgttcgtgctgcccggcgagcccagaagccagctgcaccagctgcccaagaaccccctgagcgagctgcccgtggtgaagagcaagagagtggccctgagcctggaggacgacggcctgccctag

SEQ ID NO: 87325 - DNA, 2892 bp, Artificial Sequence
  Description of Artificial Sequence: Synthetic coding sequence
atgggcctgcccgagcccggccccctgagactgctggccctgctgctgctgctgctgctgctgctgctgctgcagctgcagcacctggccgccgccgccgccgaccccctgctgggcggccagggccccgccaaggactgcgagaaggaccagttccagtgcagaaacgagagatgcatccccagcgtgtggagatgcgacgaggacgacgactgcctggaccacagcgacgaggacgactgccccaagaagacctgcgccgacagcgacttcacctgcgacaacggccactgcatccacgagagatggaagtgcgacggcgaggaggagtgccccgacggcagcgacgagagcgaggccacctgcaccaagcaggtgtgccccgccgagaagctgagctgcggccccaccagccacaagtgcgtgcccgccagctggagatgcgacggcgagaaggactgcgagggcggcgccgacgaggccggctgcgccaccctgtgcgccccccacgagttccagtgcggcaacagaagctgcctggccgccgtgttcgtgtgcgacggcgacgacgactgcggcgacggcagcgacgagagaggctgcgccgaccccgcctgcggccccagagagttcagatgcggcggcgacggcggcggcgcctgcatccccgagagatgggtgtgcgacagacagttcgactgcgaggacagaagcgacgaggccgccgagctgtgcggcagacccggccccggcgccaccagcgcccccgccgcctgcgccaccgccagccagttcgcctgcagaagcggcgagtgcgtgcacctgggctggagatgcgacggcgacagagactgcaaggacaagagcgacgaggccgactgccccctgggcacctgcagaggcgacgagttccagtgcggcgacggcacctgcgtgctggccatcaagcactgcaaccaggagcaggactgccccgacggcagcgacgaggccggctgcctgcagggcctgaacgagtgcctgcacaacaacggcggctgcagccacatctgcaccgacctgaagatcggcttcgagtgcacctgccccgccggcttccagctgctggaccagaagacctgcggcgacatcgacgagtgcaaggaccccgacgcctgcagccagatctgcgtgaactacaagggctacttcaagtgcgagtgctaccccggctacgagatggacctgctgaccaagaactgcaaggccgccgccggcaagagccccagcctgatcttcaccaacagacacgaggtgagaagaatcgacctggtgaagagaaactacagcagactgatccccatgctgaagaacgtggtggccctggacgtggaggtggccaccaacagaatctactggtgcgacctgagctacagaaagatctacagcgcctacatggacaaggccagcgaccccaaggagcaggaggtgctgatcgacgagcagctgcacagccccgagggcctggccgtggactgggtgcacaagcacatctactggaccgacagcggcaacaagaccatcagcgtggccaccgtggacggcggcagaagaagaaccctgttcagcagaaacctgagcgagcccagagccatcgccgtggaccccctgagaggcttcatgtactggagcgactggggcgaccaggccaagatcgagaagagcggcctgaacggcgtggacagacagaccctggtgagcgacaacatcgagtggcccaacggcatcaccctggacctgctgagccagagactgtactgggtggacagcaagctgcaccagctgagcagcatcgacttcagcggcggcaacagaaagaccctgatcagcagcaccgacttcctgagccaccccttcggcatcgccgtgttcgaggacaaggtgttctggaccgacctggagaacgaggccatcttcagcgccaacagactgaacggcctggagatcagcatcctggccgagaacctgaacaacccccacgacatcgtgatcttccacgagctgaagcagcccagagcccccgacgcctgcgagctgagcgtgcagcccaacggcggctgcgagtacctgtgcctgcccgccccccagatcagcagccacagccccaagtacacctgcgcctgccccgacaccatgtggctgggccccgacatgaagagatgctacagagccccccagagcaccagcaccaccaccctggccagcaccatgaccagaaccgtgcccgccaccaccagagcccccggcaccaccgtgcacagaagcacctaccagaaccacagcaccgagacccccagcctgaccgccgccgtgcccagcagcgtgagcgtgcccagagcccccagcatcagccccagcaccctgagccccgccaccagcaaccacagccagcactacgccaacgaggacagcaagatgggcagcaccgtgaccgccgccgtgatcggcatcatcgtgcccatcgtggtgatcgccctgctgtgcatgagcggctacctgatctggagaaactggaagagaaagaacaccaagagcatgaacttcgacaaccccgtgtacagaaagaccaccgaggaggaggacgaggacgagctgcacatcggcagaaccgcccagatcggccacgtgtaccccgccgccatcagcagcttcgacagacccctgtgggccgagccctgcctgggcgagaccagagagcccgaggaccccgcccccgccctgaaggagctgttcgtgctgcccggcgagcccagaagccagctgcaccagctgcccaagaaccccctgagcgagctgcccgtggtgaagagcaagagagtggccctgagcctggaggacgacggcctgccctag

SEQ ID NO: 87326 - DNA, 2103 bp, Artificial Sequence
  Description of Artificial Sequence: Synthetic coding sequence
atgggcctgcccgagcccggccccctgagactgctggccctgctgctgctgctgctgctgctgctgctgctgcagctgcagcacctggccgccgccgccgccgaccccctgctgggcggccagggccccgccaaggactgcgagaaggaccagttccagtgcagaaacgagagatgcatccccagcgtgtggagatgcgacgaggacgacgactgcctggaccacagcgacgaggacgactgccccaagaagacctgcgccgacagcgacttcacctgcgacaacggccactgcatccacgagagatggaagtgcgacggcgaggaggagtgccccgacggcagcgacgagagcgaggccacctgcaccaagcaggtgtgccccgccgagaagctgagctgcggccccaccagccacaagtgcgtgcccgccagctggagatgcgacggcgagaaggactgcgagggcggcgccgacgaggccggctgcgccaccagcctgggcacctgcagaggcgacgagttccagtgcggcgacggcacctgcgtgctggccatcaagcactgcaaccaggagcaggactgccccgacggcagcgacgaggccggctgcctgcagggcctgaacgagtgcctgcacaacaacggcggctgcagccacatctgcaccgacctgaagatcggcttcgagtgcacctgccccgccggcttccagctgctggaccagaagacctgcggcgacatcgacgagtgcaaggaccccgacgcctgcagccagatctgcgtgaactacaagggctacttcaagtgcgagtgctaccccggctacgagatggacctgctgaccaagaactgcaaggccgccgccggcaagagccccagcctgatcttcaccaacagacacgaggtgagaagaatcgacctggtgaagagaaactacagcagactgatccccatgctgaagaacgtggtggccctggacgtggaggtggccaccaacagaatctactggtgcgacctgagctacagaaagatctacagcgcctacatggacaaggccagcgaccccaaggagcaggaggtgctgatcgacgagcagctgcacagccccgagggcctggccgtggactgggtgcacaagcacatctactggaccgacagcggcaacaagaccatcagcgtggccaccgtggacggcggcagaagaagaaccctgttcagcagaaacctgagcgagcccagagccatcgccgtggaccccctgagaggcttcatgtactggagcgactggggcgaccaggccaagatcgagaagagcggcctgaacggcgtggacagacagaccctggtgagcgacaacatcgagtggcccaacggcatcaccctggacctgctgagccagagactgtactgggtggacagcaagctgcaccagctgagcagcatcgacttcagcggcggcaacagaaagaccctgatcagcagcaccgacttcctgagccaccccttcggcatcgccgtgttcgaggacaaggtgttctggaccgacctggagaacgaggccatcttcagcgccaacagactgaacggcctggagatcagcatcctggccgagaacctgaacaacccccacgacatcgtgatcttccacgagctgaagcagcccagagcccccgacgcctgcgagctgagcgtgcagcccaacggcggctgcgagtacctgtgcctgcccgccccccagatcagcagccacagccccaagtacacctgcgcctgccccgacaccatgtggctgggccccgacatgaagagatgctacagagacgccaacgaggacagcaagatgggcagcaccgtgaccgccgccgtgatcggcatcatcgtgcccatcgtggtgatcgccctgctgtgcatgagcggctacctgatctggagaaactggaagagaaagaacaccaagagcatgaacttcgacaaccccgtgtacagaaagaccaccgaggaggaggacgaggacgagctgcacatcggcagaaccgcccagatcggccacgtgtaccccgccagagtggccctgagcctggaggacgacggcctgccctag

SEQ ID NO: 87327 - DNA, 2715 bp, Artificial Sequence
  Description of Artificial Sequence: Synthetic coding sequence
atgggcctgcccgagcccggccccctgagactgctggccctgctgctgctgctgctgctgctgctgctgctgcagctgcagcacctggccgccgccgccgccgaccccctgctgggcggccagggccccgccaaggactgcgagaaggaccagttccagtgcagaaacgagagatgcatccccagcgtgtggagatgcgacgaggacgacgactgcctggaccacagcgacgaggacgactgccccaagaagacctgcgccgacagcgacttcacctgcgacaacggccactgcatccacgagagatggaagtgcgacggcgaggaggagtgccccgacggcagcgacgagagcgaggccacctgcaccaagcaggtgtgccccgccgagaagctgagctgcggccccaccagccacaagtgcgtgcccgccagctggagatgcgacggcgagaaggactgcgagggcggcgccgacgaggccggctgcgccaccctgtgcgccccccacgagttccagtgcggcaacagaagctgcctggccgccgtgttcgtgtgcgacggcgacgacgactgcggcgacggcagcgacgagagaggctgcgccgaccccgcctgcggccccagagagttcagatgcggcggcgacggcggcggcgcctgcatccccgagagatgggtgtgcgacagacagttcgactgcgaggacagaagcgacgaggccgccgagctgtgcggcagacccggccccggcgccaccagcgcccccgccgcctgcgccaccgccagccagttcgcctgcagaagcggcgagtgcgtgcacctgggctggagatgcgacggcgacagagactgcaaggacaagagcgacgaggccgactgccccctgggcacctgcagaggcgacgagttccagtgcggcgacggcacctgcgtgctggccatcaagcactgcaaccaggagcaggactgccccgacggcagcgacgaggccggctgcctgcagggcctgaacgagtgcctgcacaacaacggcggctgcagccacatctgcaccgacctgaagatcggcttcgagtgcacctgccccgccggcttccagctgctggaccagaagacctgcggcgacatcgacgagtgcaaggaccccgacgcctgcagccagatctgcgtgaactacaagggctacttcaagtgcgagtgctaccccggctacgagatggacctgctgaccaagaactgcaaggccgccgccggcaagagccccagcctgatcttcaccaacagacacgaggtgagaagaatcgacctggtgaagagaaactacagcagactgatccccatgctgaagaacgtggtggccctggacgtggaggtggccaccaacagaatctactggtgcgacctgagctacagaaagatctacagcgcctacatggacaaggccagcgaccccaaggagcaggaggtgctgatcgacgagcagctgcacagccccgagggcctggccgtggactgggtgcacaagcacatctactggaccgacagcggcaacaagaccatcagcgtggccaccgtggacggcggcagaagaagaaccctgttcagcagaaacctgagcgagcccagagccatcgccgtggaccccctgagaggcttcatgtactggagcgactggggcgaccaggccaagatcgagaagagcggcctgaacggcgtggacagacagaccctggtgagcgacaacatcgagtggcccaacggcatcaccctggacctgctgagccagagactgtactgggtggacagcaagctgcaccagctgagcagcatcgacttcagcggcggcaacagaaagaccctgatcagcagcaccgacttcctgagccaccccttcggcatcgccgtgttcgaggacaaggtgttctggaccgacctggagaacgaggccatcttcagcgccaacagactgaacggcctggagatcagcatcctggccgagaacctgaacaacccccacgacatcgtgatcttccacgagctgaagcagcccagagcccccgacgcctgcgagctgagcgtgcagcccaacggcggctgcgagtacctgtgcctgcccgccccccagatcagcagccacagccccaagtacacctgcgcctgccccgacaccatgtggctgggccccgacatgaagagatgctacagagccccccagagcaccagcaccaccaccctggccagcaccatgaccagaaccgtgcccgccaccaccagagcccccggcaccaccgtgcacagaagcacctaccagaaccacagcaccgagacccccagcctgaccgccgccgtgcccagcagcgtgagcgtgcccagagcccccagcatcagccccagcaccctgagccccgccaccagcaaccacagccagcactacgccaacgaggacagcaagatgggcagcaccgtgaccgccgccgtgatcggcatcatcgtgcccatcgtggtgatcgccctgctgtgcatgagcggctacctgatctggagaaactggaagagaaagaacaccaagagcatgaacttcgacaaccccgtgtacagaaagaccaccgaggaggaggacgaggacgagctgcacatcggcagaaccgcccagatcggccacgtgtaccccgccagagtggccctgagcctggaggacgacggcctgccctag

SEQ ID NO: 87328 - DNA, 1074 bp, Artificial Sequence
  Description of Artificial Sequence: Synthetic coding sequence
atggcccccagaagagtgagaagcttcctgagaggcctgcccgccctgctgctgctgctgctgttcctgggcccctggcccgccgccagccacggcggcaagtacagcagagagaagaaccagcccaagcccagccccaagagagagagcggcgaggagttcagaatggagaagctgaaccagctgtgggagaaggcccagagactgcacctgccccccgtgagactggccgagctgcacgccgacctgaagatccaggagagagacgagctggcctggaagaagctgaagctggacggcctggacgaggacggcgagaaggaggccagactgatcagaaacctgaacgtgatcctggccaagtacggcctggacggcaagaaggacgccagacaggtgaccagcaacagcctgagcggcacccaggaggacggcctggacgaccccagactggagaagctgtggcacaaggccaagaccagcggcaagttcagcggcgaggagctggacaagctgtggagagagttcctgcaccacaaggagaaggtgcacgagtacaacgtgctgctggagaccctgagcagaaccgaggagatccacgagaacgtgatcagccccagcgacctgagcgacatcaagggcagcgtgctgcacagcagacacaccgagctgaaggagaagctgagaagcatcaaccagggcctggacagactgagaagagtgagccaccagggctacagcaccgaggccgagttcgaggagcccagagtgatcgacctgtgggacctggcccagagcgccaacctgaccgacaaggagctggaggccttcagagaggagctgaagcacttcgaggccaagatcgagaagcacaaccactaccagaagcagctggagatcgcccacgagaagctgagacacgccgagagcgtgggcgacggcgagagagtgagcagaagcagagagaagcacgccctgctggagggcagaaccaaggagctgggctacaccgtgaagaagcacctgcaggacctgagcggcagaatcagcagagccagacacaacgagctgtag

SEQ ID NO: 87329 - DNA, 402 bp, Artificial Sequence
  Description of Artificial Sequence: Synthetic coding sequence
atgaactacatgcccggcaccgccagcctgatcgaggacatcgacaagaagcacctggtgctgctgagagacggcagaaccctgatcggcttcctgagaagcatcgaccagttcgccaacctggtgctgcaccagaccgtggagagaatccacgtgggcaagaagtacggcgacatccccagaggcatcttcgtggtgagaggcgagaacgtggtgctgctgggcgagatcgacctggagaaggagagcgacacccccctgcagcaggtgagcatcgaggagatcctggaggagcagagagtggagcagcagaccaagctggaggccgagaagctgaaggtgcaggccctgaaggacagaggcctgagcatccccagagccgacaccctggacgagtactag

SEQ ID NO: 87330 - DNA, 588 bp, Artificial Sequence
  Description of Artificial Sequence: Synthetic coding sequence
atggccgccccccccggcgagtacttcagcgtgggcagccaggtgagctgcagaacctgccaggagcagagactgcagggcgaggtggtggccttcgactaccagagcaagatgctggccctgaagtgccccagcagcagcggcaagcccaaccacgccgacatcctgctgatcaacctgcagtacgtgagcgaggtggagatcatcaacgacagaaccgagacccccccccccctggccagcctgaacgtgagcaagctggccagcaaggccagaaccgagaaggaggagaagctgagccaggcctacgccatcagcgccggcgtgagcctggagggccagcagctgttccagaccatccacaagaccatcaaggactgcaagtggcaggagaagaacatcgtggtgatggaggaggtggtgatcacccccccctaccaggtggagaactgcaagggcaaggagggcagcgccctgagccacgtgagaaagatcgtggagaagcacttcagagacgtggagagccagaagatcctgcagagaagccaggcccagcagccccagaaggaggccgccctgagcagctag

SEQ ID NO: 87331 - DNA, 588 bp, Artificial Sequence; identical to SEQ ID NO: 87330
  Description of Artificial Sequence: Synthetic coding sequence

SEQ ID NO: 87332 - DNA, 288 bp, Artificial Sequence
  Description of Artificial Sequence: Synthetic coding sequence
atgctgttctacagcttcttcaagagcctggtgggcaaggacgtggtggtggagctgaagaacgacctgagcatctgcggcaccctgcacagcgtggaccagtacctgaacatcaagctgaccgacatcagcgtgaccgaccccgagaagtacccccacatgctgagcgtgaagaactgcttcatcagaggcagcgtggtgagatacgtgcagctgcccgccgacgaggtggacacccagctgctgcaggacgccgccagaaaggaggccctgcagcagaagcagtag

SEQ ID NO: 87333 - DNA, 288 bp, Artificial Sequence; identical to SEQ ID NO: 87332
  Description of Artificial Sequence: Synthetic coding sequence

SEQ ID NO: 87334 - DNA, 288 bp, Artificial Sequence; identical to SEQ ID NO: 87332
  Description of Artificial Sequence: Synthetic coding sequence

SEQ ID NO: 87335 - DNA, 288 bp, Artificial Sequence; identical to SEQ ID NO: 87332
  Description of Artificial Sequence: Synthetic coding sequence

SEQ ID NO: 87336 - DNA, 288 bp, Artificial Sequence; identical to SEQ ID NO: 87332
  Description of Artificial Sequence: Synthetic coding sequence

SEQ ID NO: 87337 - DNA, 288 bp, Artificial Sequence; identical to SEQ ID NO: 87332
  Description of Artificial Sequence: Synthetic coding sequence

SEQ ID NO: 87338 - DNA, 309 bp, Artificial Sequence
  Description of Artificial Sequence: Synthetic coding sequence
atggccgacgacgtggaccagcagcagaccaccaacaccgtggaggagcccctggacctgatcagactgagcctggacgagagaatctacgtgaagatgagaaacgacagagagctgagaggcagactgcacgcctacgaccagcacctgaacatgatcctgggcgacgtggaggagaccgtgaccaccatcgagatcgacgaggagacctacgaggagatctacaagagcaccaagagaaacatccccatgctgttcgtgagaggcgacggcgtggtgctggtggccccccccctgagagtgggctag

SEQ ID NO: 87339 - DNA, 420 bp, Artificial Sequence
  Description of Artificial Sequence: Synthetic coding sequence
atgctgcccctgagcctgctgaagaccgcccagaaccaccccatgctggtggagctgaagaacggcgagacctacaacggccacctggtgagctgcgacaactggatgaacatcaacctgagagaggtgatctgcaccagcagagacggcgacaagttctggagaatgcccgagtgctacatcagaggcagcaccatcaagtacctgagaatccccgacgagatcatcgacatggtgaaggaggaggtggtggccaagggcagaggcagaggcggcctgcagcagcagaagcagcagaagggcagaggcatgggcggcgccggcagaggcgtgttcggcggcagaggcagaggcggcatccccggcaccggcagaggccagcccgagaagaagcccggcagacaggccggcaagcagtag

SEQ ID NO: 87340 - DNA, 420 bp, Artificial Sequence; identical to SEQ ID NO: 87339
  Description of Artificial Sequence: Synthetic coding sequence

SEQ ID NO: 87341 - DNA, 276 bp, Artificial Sequence
  Description of Artificial Sequence: Synthetic coding sequence
atggccgccaacgccaccaccaaccccagccagctgctgcccctggagctggtggacaagtgcatcggcagcagaatccacatcgtgatgaagagcgacaaggagatcgtgggcaccctgctgggcttcgacgacttcgtgaacatggtgctggaggacgtgaccgagttcgagatcacccccgagggcagaagaatcaccaagctggaccagatcctgctgaacggcaacaacatcaccatgctggtgcccggcggcgagggccccgaggtgtag

SEQ ID NO: 87342 - DNA, 243 bp, Artificial Sequence
  Description of Artificial Sequence: Synthetic coding sequence
atgagcctgagaaagcagacccccagcgacttcctgaagcagatcatcggcagacccgtggtggtgaagctgaacagcggcgtggactacagaggcgtgctggcctgcctggacggctacatgaacatcgccctggagcagaccgaggagtacgtgaacggccagctgaagaacaagtacggcgacgccttcatcagaggcaacaacgtgctgtacatcagcacccagaagagaagaatgtag

SEQ ID NO: 87343 - DNA, 243 bp, Artificial Sequence; identical to SEQ ID NO: 87342
  Description of Artificial Sequence: Synthetic coding sequence

SEQ ID NO: 87344 - DNA, 243 bp, Artificial Sequence; identical to SEQ ID NO: 87342
  Description of Artificial Sequence: Synthetic coding sequence

SEQ ID NO: 87345 - DNA, 243 bp, Artificial Sequence; identical to SEQ ID NO: 87342
  Description of Artificial Sequence: Synthetic coding sequence

SEQ ID NO: 87346 - DNA, 312 bp, Artificial Sequence
  Description of Artificial Sequence: Synthetic coding sequence
atggccgacaaggagaagaagaagaaggagagcatcctggacctgagcaagtacatcgacaagaccatcagagtgaagttccagggcggcagagaggccagcggcatcctgaagggcttcgaccccctgctgaacctggtgctggacggcaccatcgagtacatgagagaccccgacgaccagtacaagctgaccgaggacaccagacagctgggcctggtggtgtgcagaggcaccagcgtggtgctgatctgcccccaggacggcatggaggccatccccaaccccttcatccagcagcaggacgcctag

SEQ ID NO: 87347 - DNA, 1116 bp, Artificial Sequence
  Description of Artificial Sequence: Synthetic coding sequence
atgagcgcccaggcccagatgagagccctgctggaccagctgatgggcaccgccagagacggcgacgagaccagacagagagtgaagttcaccgacgacagagtgtgcaagagccacctgctggactgctgcccccacgacatcctggccggcaccagaatggacctgggcgagtgcaccaagatccacgacctggccctgagagccgactacgagatcgccagcaaggagagagacctgttcttcgagctggacgccatggaccacctggagagcttcatcgccgagtgcgacagaagaaccgagctggccaagaagagactggccgagacccaggaggagatcagcgccgaggtgagcgccaaggccgagaaggtgcacgagctgaacgaggagatcggcaagctgctggccaaggccgagcagctgggcgccgagggcaacgtggacgagagccagaagatcctgatggaggtggagaaggtgagagccaagaagaaggaggccgaggaggagtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatccagatcagagagaagctggaccagctgagaaagaccgtggccgagaagcaggagaagagaaaccaggacagactgagaagaagagaggagagagagagagaggagagactgagcagaagaagcggcagcagaaccagagacagaagaagaagcagaagcagagacagaagaagaagaagaagcagaagcaccagcagagagagaagaaagctgagcagaagcagaagcagagacagacacagaagacacagaagcagaagcagaagccacagcagaggccacagaagagccagcagagacagaagcgccaagtacaagttcagcagagagagagccagcagagaggagagctgggagagcggcagaagcgagagaggcccccccgactggagactggagagcagcaacggcaagatggccagcagaagaagcgaggagaaggaggccggcgagatctag

SEQ ID NO: 87348 - DNA, 978 bp, Artificial Sequence
  Description of Artificial Sequence: Synthetic coding sequence
atgagcgcccaggcccagatgagagccctgctggaccagctgatgggcaccgccagagacggcgacgagaccagacagagagtgaagttcaccgacgacagagtgtgcaagagccacctgctggactgctgcccccacgacatcctggccggcaccagaatggacctgggcgagtgcaccaagatccacgacctggccctgagagccgactacgagatcgccagcaaggagagagacctgttcttcgagctggacgccatggaccacctggagagcttcatcgccgagtgcgacagaagaaccgagctggccaagaagagactggccgagacccaggaggagatcagcgccgaggtgagcgccaaggccgagaaggtgcacgagctgaacgaggagatcggcaagctgctggccaaggccgagcagctgggcgccgagggcaacgtggacgagagccagaagatcctgatggaggtggagaaggtgagagccaagaagaaggaggccgaggaggagtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatccagatcagagagaagctggaccagctgagaaagaccgtggccgagaagcaggagaagagaaaccaggacagactgagaagaagagaggagagagagagagaggagagactgagcagaagaagcggcagcagaaccagagacagaagaagaagcagaagcagagacagaagaagaagaagaagcagaagcaccagcagagagagaagaaagctgagcagaagcagaagcagagacagacacagaagacacagaagcagaagcagaagccacagcagaggccacagaagagccagcagagacagaagcgccaagtacaagtag

SEQ ID NO: 87349 - DNA, 819 bp, Artificial Sequence
  Description of Artificial Sequence: Synthetic coding sequence
atggacctgggcgagtgcaccaagatccacgacctggccctgagagccgactacgagatcgccagcaaggagagagacctgttcttcgagctggacgccatggaccacctggagagcttcatcgccgagtgcgacagaagaaccgagctggccaagaagagactggccgagacccaggaggagatcagcgccgaggtgagcgccaaggccgagaaggtgcacgagctgaacgaggagatcggcaagctgctggccaaggccgagcagctgggcgccgagggcaacgtggacgagagccagaagatcctgatggaggtggagaaggtgagagccaagaagaaggaggccgaggaggagtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatccagatcagagagaagctggaccagctgagaaagaccgtggccgagaagcaggagaagagaaaccaggacagactgagaagaagagaggagagagagagagaggagagactgagcagaagaagcggcagcagaaccagagacagaagaagaagcagaagcagagacagaagaagaagaagaagcagaagcaccagcagagagagaagaaagctgagcagaagcagaagcagagacagacacagaagacacagaagcagaagcagaagccacagcagaggccacagaagagccagcagagacagaagcgccaagtacaagtag

SEQ ID NO: 87350 - DNA, 978 bp, Artificial Sequence; identical to SEQ ID NO: 87348
  Description of Artificial Sequence: Synthetic coding sequence

SEQ ID NO: 87351 - DNA, 99 bp, Artificial Sequence
  Description of Artificial Sequence: Synthetic coding sequence
atggacctgggcgagtgcaccaagatccacgacctggccctgagagccgactacgagatcgccagcaaggagagagacctgttcttcgagctggactag

SEQ ID NO: 87352 - DNA, 549 bp, Artificial Sequence
  Description of Artificial Sequence: Synthetic coding sequence
atggaccacctggagagcttcatcgccgagtgcgacagaagaaccgagctggccaagaagagactggccgagacccaggaggagatcagcgccgaggtgagcgccaaggccgagaaggtgcacgagctgaacgaggagatcggcaagctgctggccaaggccgagcagctgggcgccgagggcaacgtggacgagagccagaagatcctgatggaggtggagaaggtgagagccaagaagaaggaggccgaggaggagtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatccagatcagagagaagctggaccagctgagaaagaccgtggccgagaagcaggagaagagaaaccaggacagactgagaagaagagaggagagagagagagaggagagactgagcagaagaagcggcagcagaaccagagacagaagatag

SEQ ID NO: 87353 - DNA, 183 bp, Artificial Sequence
  Description of Artificial Sequence: Synthetic coding sequence
tgaagaagaagaagcagaagcagagacagaagaagaagaagaagcagaagcaccagcagagagagaagaaagctgagcagaagcagaagcagagacagacacagaagacacagaagcagaagcagaagccacagcagaggccacagaagagccagcagagacagaagcgccaagtacaagtag

SEQ ID NO: 87354 - DNA, 255 bp, Artificial Sequence
  Description of Artificial Sequence: Synthetic coding sequence
atggaccacctggagagcttcatcgccgagtgcgacagaagaaccgagctggccaagaagagactggccgagacccaggaggagatcagcgccgaggtgagcgccaaggccgagaaggtgcacgagctgaacgaggagatcggcaagctgctggccaaggccgagcagctgggcgccgagggcaacgtggacgagagccagaagatcctgatggaggtggagaaggtgagagccaagaagaaggaggccgagtag

SEQ ID NO: 87355 - DNA, 1176 bp, Artificial Sequence
  Description of Artificial Sequence: Synthetic coding sequence
atgcccgcctacctgaacctgcagggcagcgtgagaaaggccccccacagccccagcagagacaccaccagacagagaatcaagttcagcgacgacagagtgtgcaagagccacctgctgaactgctgcccccacgacgtgctgagcggcaccagaatggacctgggcgagtgcctgaaggtgcacgacctggccctgagagccgactacgagatcgccagcaaggagcaggacttcttcttcgagctggacgccatggaccacctgcagagcttcatcgccgactgcgacagaagaaccgaggtggccaagaagagactggccgagacccaggaggagatcagcgccgaggtggccgccaaggccgagagagtgcacgagctgaacgaggagatcggcaagctgctggccaaggtggagcagctgggcgccgagggcaacgtggaggagagccagaaggtgatggacgaggtggagaaggccagagccaagaagagagaggccgaggaggtgtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatcgagatcagagagaagctggaggagctgaagagagtggtggccgagaagcaggagaagagaaaccaggagagactgaagagaagagaggagagagagagagaggagagagagaagctgagaagaagcagaagccacagcaagaaccccaagagaagcagaagcagagagcacagaagacacagaagcagaagcatgagcagagagagaaagagaagaaccagaagcaagagcagagagaagagacacagacacagaagcagaagcagcagcagaagcagaagcagaagccaccagagaagcagacacagcagcagagacagaagcagagagagaagcaagagaagaagcagcaaggagagattcagagaccaggacctggccagctgcgacagagacagaagcagcagagacagaagccccagagacagagacagaaaggacaagaagagaagctacgagagcgccaacggcagaagcgaggacagaagaagcagcgaggagagagaggccggcgagatctag

SEQ ID NO: 87356 - DNA, 1179 bp, Artificial Sequence
  Description of Artificial Sequence: Synthetic coding sequence
atgagcgcccaggcccagatgagagccatgctggaccagctgatgggcaccagcagagacggcgacaccaccagacagagaatcaagttcagcgacgacagagtgtgcaagagccacctgctgaactgctgcccccacgacgtgctgagcggcaccagaatggacctgggcgagtgcctgaaggtgcacgacctggccctgagagccgactacgagatcgccagcaaggagcaggacttcttcttcgagctggacgccatggaccacctgcagagcttcatcgccgactgcgacagaagaaccgaggtggccaagaagagactggccgagacccaggaggagatcagcgccgaggtggccgccaaggccgagagagtgcacgagctgaacgaggagatcggcaagctgctggccaaggtggagcagctgggcgccgagggcaacgtggaggagagccagaaggtgatggacgaggtggagaaggccagagccaagaagagagaggccgaggaggtgtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatcgagatcagagagaagctggaggagctgaagagagtggtggccgagaagcaggagaagagaaaccaggagagactgaagagaagagaggagagagagagagaggagagagagaagctgagaagaagcagaagccacagcaagaaccccaagagaagcagaagcagagagcacagaagacacagaagcagaagcatgagcagagagagaaagagaagaaccagaagcaagagcagagagaagagacacagacacagaagcagaagcagcagcagaagcagaagcagaagccaccagagaagcagacacagcagcagagacagaagcagagagagaagcaagagaagaagcagcaaggagagattcagagaccaggacctggccagctgcgacagagacagaagcagcagagacagaagccccagagacagagacagaaaggacaagaagagaagctacgagagcgccaacggcagaagcgaggacagaagaagcagcgaggagagagaggccggcgagatctag

SEQ ID NO: 87357 - DNA, 1170 bp, Artificial Sequence
  Description of Artificial Sequence: Synthetic coding sequence
atggtgatccacagccagctgaagaagatccagggcgccagcgagagaatgggcgacaccaccagacagagaatcaagttcagcgacgacagagtgtgcaagagccacctgctgaactgctgcccccacgacgtgctgagcggcaccagaatggacctgggcgagtgcctgaaggtgcacgacctggccctgagagccgactacgagatcgccagcaaggagcaggacttcttcttcgagctggacgccatggaccacctgcagagcttcatcgccgactgcgacagaagaaccgaggtggccaagaagagactggccgagacccaggaggagatcagcgccgaggtggccgccaaggccgagagagtgcacgagctgaacgaggagatcggcaagctgctggccaaggtggagcagctgggcgccgagggcaacgtggaggagagccagaaggtgatggacgaggtggagaaggccagagccaagaagagagaggccgaggaggtgtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatcgagatcagagagaagctggaggagctgaagagagtggtggccgagaagcaggagaagagaaaccaggagagactgaagagaagagaggagagagagagagaggagagagagaagctgagaagaagcagaagccacagcaagaaccccaagagaagcagaagcagagagcacagaagacacagaagcagaagcatgagcagagagagaaagagaagaaccagaagcaagagcagagagaagagacacagacacagaagcagaagcagcagcagaagcagaagcagaagccaccagagaagcagacacagcagcagagacagaagcagagagagaagcaagagaagaagcagcaaggagagattcagagaccaggacctggccagctgcgacagagacagaagcagcagagacagaagccccagagacagagacagaaaggacaagaagagaagctacgagagcgccaacggcagaagcgaggacagaagaagcagcgaggagagagaggccggcgagatctag

SEQ ID NO: 87358 - DNA, 1377 bp, Artificial Sequence
  Description of Artificial Sequence: Synthetic coding sequence
atggccgccctgggcagccccagccacaccttcagaggcctgctgagagagctgagatacctgagcgccgccaccggcagaccctacagagacaccgccgcctacagatacctggtgaaggccttcagagcccacagagtgaccagcgagaagctgtgcagagcccagcacgagctgcacttccaggccgccacctacctgtgcctgctgagaagcatcagaaagcacgtggccctgcaccaggagttccacggcaagggcgacaccaccagacagagaatcaagttcagcgacgacagagtgtgcaagagccacctgctgaactgctgcccccacgacgtgctgagcggcaccagaatggacctgggcgagtgcctgaaggtgcacgacctggccctgagagccgactacgagatcgccagcaaggagcaggacttcttcttcgagctggacgccatggaccacctgcagagcttcatcgccgactgcgacagaagaaccgaggtggccaagaagagactggccgagacccaggaggagatcagcgccgaggtggccgccaaggccgagagagtgcacgagctgaacgaggagatcggcaagctgctggccaaggtggagcagctgggcgccgagggcaacgtggaggagagccagaaggtgatggacgaggtggagaaggccagagccaagaagagagaggccgaggaggtgtacagaaacagcatgcccgccagcagcttccagcagcagaagctgagagtgtgcgaggtgtgcagcgcctacctgggcctgcacgacaacgacagaagactggccgaccacttcggcggcaagctgcacctgggcttcatcgagatcagagagaagctggaggagctgaagagagtggtggccgagaagcaggagaagagaaaccaggagagactgaagagaagagaggagagagagagagaggagagagagaagctgagaagaagcagaagccacagcaagaaccccaagagaagcagaagcagagagcacagaagacacagaagcagaagcatgagcagagagagaaagagaagaaccagaagcaagagcagagagaagagacacagacacagaagcagaagcagcagcagaagcagaagcagaagccaccagagaagcagacacagcagcagagacagaagcagagagagaagcaagagaagaagcagcaaggagagattcagagaccaggacctggccagctgcgacagagacagaagcagcagagacagaagccccagagacagagacagaaaggacaagaagagaagctacgagagcgccaacggcagaagcgaggacagaagaagcagcgaggagagagaggccggcgagatctag

SEQ ID NO: 87359 - DNA, 1179 bp, Artificial Sequence; identical to SEQ ID NO: 87356
  Description of Artificial Sequence: Synthetic coding sequence

SEQ ID NO: 87360 - DNA, 252 bp, Artificial Sequence
  Description of Artificial Sequence: Synthetic coding sequence
atgagcgcccaggcccagatgagagccatgctggaccagctgatgggcaccagcagagacggcagcatgtacctgtgcctgcccaccagcatctgcaagggcgtgagcgagagacccagaatcagacaggccgagatccagctggtgaacgagagcaacagcgtgatgaccgagtacgccagagtgaccttcagcaccgtggtgctgatgatgagcttcctggagctggagtggatcctggagaacgtgtag

SEQ ID NO: 87361 - DNA, 1299 bp, Artificial Sequence
  Description of Artificial Sequence: Synthetic coding sequence
atgatcagcgccgcccagctgctggacgagctgatgggcagagacagaaacctggcccccgacgagaagagaagcaacgtgagatgggaccacgagagcgtgtgcaagtactacctgtgcggcttctgccccgccgagctgttcaccaacaccagaagcgacctgggcccctgcgagaagatccacgacgagaacctgagaaagcagtacgagaagagcagcagattcatgaaggtgggctacgagagagacttcctgagatacctgcagagcctgctggccgaggtggagagaagaatcagaagaggccacgccagactggccctgagccagaaccagcagagcagcggcgccgccggccccaccggcaagaacgaggagaagatccaggtgctgaccgacaagatcgacgtgctgctgcagcagatcgaggagctgggcagcgagggcaaggtggaggaggcccagggcatgatgaagctggtggagcagctgaaggaggagagagagctgctgagaagcaccaccagcaccatcgagagcttcgccgcccaggagaagcagatggaggtgtgcgaggtgtgcggcgccttcctgatcgtgggcgacgcccagagcagagtggacgaccacctgatgggcaagcagcacatgggctacgccaagatcaaggccaccgtggaggagctgaaggagaagctgagaaagagaaccgaggagcccgacagagacgagagactgaagaaggagaagcaggagagagaggagagagagaaggagagagagagagagagagaggagagagagagaaagagaagaagagaggaggaggagagagagaaggagagagccagagacagagagagaagaaagagaagcagaagcagaagcagacacagcagcagaaccagcgacagaagatgcagcagaagcagagaccacaagagaagcagaagcagagagagaagaagaagcagaagcagagacagaagaagaagcagaagccacgacagaagcgagagaaagcacagaagcagaagcagagacagaagaagaagcaagagcagagacagaaagagctacaagcacagaagcaagagcagagacagagagcaggacagaaagagcaaggagaaggagaagagaggcagcgacgacaagaagagcagcgtgaagagcggcagcagagagaagcagagcgaggacaccaacaccgagagcaaggagagcgacaccaagaacgaggtgaacggcaccagcgaggacatcaagagcgagggcgacacccagagcaactag

SEQ ID NO: 87362 - DNA, 240 bp, Artificial Sequence
  Description of Artificial Sequence: Synthetic coding sequence
atgatcagcgccgcccagctgctggacgagctgatgggcagagacagaaacctggcccccgacgagaagagaagcaacgtgagatgggaccacgagagcgtgtgcaagtactacctgtgcggcttctgccccgccgagctgttcaccaacaccagaagcgacctggacgtgttcggcagaggcgacaacatcagagacgtgagcaagttcctggaggacgacaagtggatggaggagtag

SEQ ID NO: 87363 - DNA, 1299 bp, Artificial Sequence; identical to SEQ ID NO: 87361
  Description of Artificial Sequence: Synthetic coding sequence

SEQ ID NO: 87364 - DNA, 711 bp, Artificial Sequence
  Description of Artificial Sequence: Synthetic coding sequence
atgatcagcgccgcccagctgctggacgagctgatgggcagagacagaaacctggcccccgacgagaagagaagcaacgtgagatgggaccacgagagcgtgtgcaagtactacctgtgcggcttctgccccgccgagctgttcaccaacaccagaagcgacctgggcccctgcgagaagatccacgacgagaacctgagaaagcagtacgagaagagcagcagattcatgaaggtgggctacgagagagacttcctgagatacctgcagagcctgctggccgaggtggagagaagaatcagaagaggccacgccagactggccctgagccagaaccagcagagcagcggcgccgccggccccaccggcaagaacgaggagaagatccaggtgctgaccgacaagatcgacgtgctgctgcagcagatcgaggagctgggcagcgagggcaaggtggaggaggcccagggcatgatgaagctggtggagcagctgaaggaggagagagagctgctgagaagcaccaccagcaccatcgagagcttcgccgcccaggagaagcagatggaggtgtgcgaggtgtgcggcgccttcctgatcgtgggcgacgcccagagcagagtggacgaccacctgatgggcaagcagcacatgggctacgccaagatcaaggccaccgtggaggagaagaagaagaagaagaagaagtag

SEQ ID NO: 87365 - DNA, 1071 bp, Artificial Sequence
  Description of Artificial Sequence: Synthetic coding sequence
atgaaggtgggctacgagagagacttcctgagatacctgcagagcctgctggccgaggtggagagaagaatcagaagaggccacgccagactggccctgagccagaaccagcagagcagcggcgccgccggccccaccggcaagaacgaggagaagatccaggtgctgaccgacaagatcgacgtgctgctgcagcagatcgaggagctgggcagcgagggcaaggtggaggaggcccagggcatgatgaagctggtggagcagctgaaggaggagagagagctgctgagaagcaccaccagcaccatcgagagcttcgccgcccaggagaagcagatggaggtgtgcgaggtgtgcggcgccttcctgatcgtgggcgacgcccagagcagagtggacgaccacctgatgggcaagcagcacatgggctacgccaagatcaaggccaccgtggaggagctgaaggagaagctgagaaagagaaccgaggagcccgacagagacgagagactgaagaaggagaagcaggagagagaggagagagagaaggagagagagagagagagagaggagagagagagaaagagaagaagagaggaggaggagagagagaaggagagagccagagacagagagagaagaaagagaagcagaagcagaagcagacacagcagcagaaccagcgacagaagatgcagcagaagcagagaccacaagagaagcagaagcagagagagaagaagaagcagaagcagagacagaagaagaagcagaagccacgacagaagcgagagaaagcacagaagcagaagcagagacagaagaagaagcaagagcagagacagaaagagctacaagcacagaagcaagagcagagacagagagcaggacagaaagagcaaggagaaggagaagagaggcagcgacgacaagaagagcagcgtgaagagcggcagcagagagaagcagagcgaggacaccaacaccgagagcaaggagagcgacaccaagaacgaggtgaacggcaccagcgaggacatcaagagcgagggcctgttcgtgaccgtgtag

SEQ ID NO: 87366 - DNA, 1017 bp, Artificial Sequence
  Description of Artificial Sequence: Synthetic coding sequence
atgagcctgagcgccttcaccctgttcctggccctgatcggcggcaccagcggccagtactacgactacgacttccccctgagcatctacggccagagcagccccaactgcgcccccgagtgcaactgccccgagagctaccccagcgccatgtactgcgacgagctgaagctgaagagcgtgcccatggtgccccccggcatcaagtacctgtacctgagaaacaaccagatcgaccacatcgacgagaaggccttcgagaacgtgaccgacctgcagtggctgatcctggaccacaacctgctggagaacagcaagatcaagggcagagtgttcagcaagctgaagcagctgaagaagctgcacatcaaccacaacaacctgaccgagagcgtgggccccctgcccaagagcctggaggacctgcagctgacccacaacaagatcaccaagctgggcagcttcgagggcctggtgaacctgaccttcatccacctgcagcacaacagactgaaggaggacgccgtgagcgccgccttcaagggcctgaagagcctggagtacctggacctgagcttcaaccagatcgccagactgcccagcggcctgcccgtgagcctgctgaccctgtacctggacaacaacaagatcagcaacatccccgacgagtacttcaagagattcaacgccctgcagtacctgagactgagccacaacgagctggccgacagcggcatccccggcaacagcttcaacgtgagcagcctggtggagctggacctgagctacaacaagctgaagaacatccccaccgtgaacgagaacctggagaactactacctggaggtgaaccagctggagaagttcgacatcaagagcttctgcaagatcctgggccccctgagctacagcaagatcaagcacctgagactggacggcaacagaatcagcgagaccagcctgccccccgacatgtacgagtgcctgagagtggccaacgaggtgaccctgaactag

SEQ ID NO: 87367 - DNA, 2100 bp, Artificial Sequence
  Description of Artificial Sequence: Synthetic coding sequence
atgaagcagagattcagcgccctgcagctgctgaagctgctgctgctgctgcagccccccctgcccagagccctgagagaggccctgtgccccgagccctgcaactgcgtgcccgacggcgccctgagatgccccggccccaccgccggcctgaccagactgagcctggcctacctgcccgtgaaggtgatccccagccaggccttcagaggcctgaacgaggtgatcaagatcgagatcagccagatcgacagcctggagagaatcgaggccaacgccttcgacaacctgctgaacctgagcgagatcctgatccagaacaccaagaacctgagatacatcgagcccggcgccttcatcaacctgcccagactgaagtacctgagcatctgcaacaccggcatcagaaagttccccgacgtgaccaaggtgttcagcagcgagagcaacttcatcctggagatctgcgacaacctgcacatcaccaccatccccggcaacgccttccagggcatgaacaacgagagcgtgaccctgaagctgtacggcaacggcttcgaggaggtgcagagccacgccttcaacggcaccaccctgaccagcctggagctgaaggagaacgtgcacctggagaagatgcacaacggcgccttcagaggcgccaccggccccaagaccctggacatcagcagcaccaagctgcaggccctgcccagctacggcctggagagcatccagagactgatcgccaccagcagctacagcctgaagaagctgcccagcagagagaccttcgtgaacctgctggaggccaccctgacctaccccagccactgctgcgccttcagaaacctgcccaccaaggagcagaacttcagccacagcatcagcgagaacttcagcaagcagtgcgagagcaccgtgagaaaggtgaacaacaagaccctgtacagcagcatgctggccgagagcgagctgagcggctgggactacgagtacggcttctgcctgcccaagacccccagatgcgcccccgagcccgacgccttcaacccctgcgaggacatcatgggctacgacttcctgagagtgctgatctggctgatcaacatcctggccatcatgggcaacatgaccgtgctgttcgtgctgctgaccagcagatacaagctgaccgtgcccagattcctgatgtgcaacctgagcttcgccgacttctgcatgggcctgtacctgctgctgatcgccagcgtggacagccagaccaagggccagtactacaaccacgccatcgactggcagaccggcagcggctgcagcaccgccggcttcttcaccgtgttcgccagcgagctgagcgtgtacaccctgaccgtgatcaccctggagagatggcacaccatcacctacgccatccacctggaccagaagctgagactgagacacgccatcctgatcatgctgggcggctggctgttcagcagcctgatcgccatgctgcccctggtgggcgtgagcaactacatgaaggtgagcatctgcttccccatggacgtggagaccaccctgagccaggtgtacatcctgaccatcctgatcctgaacgtggtggccttcttcatcatctgcgcctgctacatcaagatctacttcgccgtgagaaaccccgagctgatggccaccaacaaggacaccaagatcgccaagaagatggccatcctgatcttcaccgacttcacctgcatggcccccatcagcttcttcgccatcagcgccgccttcaaggtgcccctgatcaccgtgaccaacagcaaggtgctgctggtgctgttctaccccatcaacagctgcgccaaccccttcctgtacgccatcttcaccaagaccttccagagagacttcttcctgctgctgagcaagttcggctgctgcaagagaagagccgagctgtacagaagaaaggacttcagcgcctacaccagcaactgcaagaacggcttcaccggcagcaacaagcccagccagagcaccctgaagctgagcaccctgcactgccagggcaccgccctgctggacaagaccagatacaccgagtgctag

SEQ ID NO: 87368 - DNA, 1914 bp, Artificial Sequence
  Description of Artificial Sequence: Synthetic coding sequence
atgaagcagagattcagcgccctgcagctgctgaagctgctgctgctgctgcagccccccctgcccagagccctgagagaggccctgtgccccgagccctgcaactgcgtgcccgacggcgccctgagatgccccggccccaccgccggcctgaccagactgagcctggcctacctgcccgtgaaggtgatccccagccaggccttcagaggcctgaacgaggtgatcaagatcgagatcagccagatcgacagcctggagagaatcgaggccaacgccttcgacaacctgctgaacctgagcgagatcctgatccagaacaccaagaacctgagatacatcgagcccggcgccttcatcaacctgcccagactgaagtacctgagcatctgcaacaccggcatcagaaagttccccgacgtgaccaaggtgttcagcagcgagagcaacttcatcctggagatctgcgacaacctgcacatcaccaccatccccggcaacgccttccagggcatgaacaacgagagcgtgaccctgaagctgtacggcaacggcttcgaggaggtgcagagccacgccttcaacggcaccaccctgaccagcctggagctgaaggagaacgtgcacctggagaagatgcacaacggcgccttcagaggcgccaccggccccaagaccctgcagaacttcagccacagcatcagcgagaacttcagcaagcagtgcgagagcaccgtgagaaaggtgaacaacaagaccctgtacagcagcatgctggccgagagcgagctgagcggctgggactacgagtacggcttctgcctgcccaagacccccagatgcgcccccgagcccgacgccttcaacccctgcgaggacatcatgggctacgacttcctgagagtgctgatctggctgatcaacatcctggccatcatgggcaacatgaccgtgctgttcgtgctgctgaccagcagatacaagctgaccgtgcccagattcctgatgtgcaacctgagcttcgccgacttctgcatgggcctgtacctgctgctgatcgccagcgtggacagccagaccaagggccagtactacaaccacgccatcgactggcagaccggcagcggctgcagcaccgccggcttcttcaccgtgttcgccagcgagctgagcgtgtacaccctgaccgtgatcaccctggagagatggcacaccatcacctacgccatccacctggaccagaagctgagactgagacacgccatcctgatcatgctgggcggctggctgttcagcagcctgatcgccatgctgcccctggtgggcgtgagcaactacatgaaggtgagcatctgcttccccatggacgtggagaccaccctgagccaggtgtacatcctgaccatcctgatcctgaacgtggtggccttcttcatcatctgcgcctgctacatcaagatctacttcgccgtgagaaaccccgagctgatggccaccaacaaggacaccaagatcgccaagaagatggccatcctgatcttcaccgacttcacctgcatggcccccatcagcttcttcgccatcagcgccgccttcaaggtgcccctgatcaccgtgaccaacagcaaggtgctgctggtgctgttctaccccatcaacagctgcgccaaccccttcctgtacgccatcttcaccaagaccttccagagagacttcttcctgctgctgagcaagttcggctgctgcaagagaagagccgagctgtacagaagaaaggacttcagcgcctacaccagcaactgcaagaacggcttcaccggcagcaacaagcccagccagagcaccctgaagctgagcaccctgcactgccagggcaccgccctgctggacaagaccagatacaccgagtgctag

SEQ ID NO: 87369 - DNA, 978 bp, Artificial Sequence
  Description of Artificial Sequence: Synthetic coding sequence
atgaagcagagattcagcgccctgcagctgctgaagctgctgctgctgctgcagccccccctgcccagagccctgagagaggccctgtgccccgagccctgcaactgcgtgcccgacggcgccctgagatgccccggccccaccgccggcctgaccagactgagcctggcctacctgcccgtgaaggtgatccccagccaggccttcagaggcctgaacgaggtgatcaagatcgagatcagccagatcgacagcctggagagaatcgaggccaacgccttcgacaacctgctgaacctgagcgagatcctgatccagaacaccaagaacctgagatacatcgagcccggcgccttcatcaacctgcccagactgaagtacctgagcatctgcaacaccggcatcagaaagttccccgacgtgaccaaggtgttcagcagcgagagcaacttcatcctggagatctgcgacaacctgcacatcaccaccatccccggcaacgccttccagggcatgaacaacgagagcgtgaccctgaagctgtacggcaacggcttcgaggaggtgcagagccacgccttcaacggcaccaccctgaccagcctggagctgaaggagaacgtgcacctggagaagatgcacaacggcgccttcagaggcgccaccggccccaagaccctggacatcagcagcaccaagctgcaggccctgcccagctacggcctggagagcatccagagactgatcgccaccagcagctacagcctgaagaagctgcccagcagagagaccttcgtgaacctgctggaggccaccctgacctaccccagccactgctgcgccttcagaaacctgcccaccaaggagcagaacttcagccacagcatcagcgagaacttcagcaagcagtgcgagagcaccgtgagaaaggtgaacaacaagaccctgagcaagcccagaatcaacggctaccagtag

SEQ ID NO: 87370 - DNA, 990 bp, Artificial Sequence
  Description of Artificial Sequence: Synthetic coding sequence
atgaagcagagattcagcgccctgcagctgctgaagctgctgctgctgctgcagccccccctgcccagagccctgagagaggccctgtgccccgagccctgcaactgcgtgcccgacggcgccctgagatgccccggccccaccgccggcctgaccagactgagcctggcctacctgcccgtgaaggtgatccccagccaggccttcagaggcctgaacgaggtgatcaagatcgagatcagccagatcgacagcctggagagaatcgaggccaacgccttcgacaacctgctgaacctgagcgagatcctgatccagaacaccaagaacctgagatacatcgagcccggcgccttcatcaacctgcccagactgaagtacctgagcatctgcaacaccggcatcagaaagttccccgacgtgaccaaggtgttcagcagcgagagcaacttcatcctggagatctgcgacaacctgcacatcaccaccatccccggcaacgccttccagggcatgaacaacgagagcgtgaccctgaagctgtacggcaacggcttcgaggaggtgcagagccacgccttcaacggcaccaccctgaccagcctggagctgaaggagaacgtgcacctggagaagatgcacaacggcgccttcagaggcgccaccggccccaagaccctggacatcagcagcaccaagctgcaggccctgcccagctacggcctggagagcatccagagactgatcgccaccagcagctacagcctgaagaagctgcccagcagagagaccttcgtgaacctgctggaggccaccctgacctaccccagccactgctgcgccttcagaaacctgcccaccaaggagcagaacttcagccacagcatcagcgagaacttcagcaagcagtgcgagagcaccgtgagaaaggtgaacaacaagaccctgctgctgcacggcgccctgagcgccgcccacagcctgagctag

SEQ ID NO: 87371 - DNA, 2019 bp, Artificial Sequence
  Description of Artificial Sequence: Synthetic coding sequence
atgaagcagagattcagcgccctgcagctgctgaagctgctgctgctgctgcagccccccctgcccagagccctgagagaggccctgtgccccgagccctgcaactgcgtgcccgacggcgccctgagatgccccggccccaccgccggcctgaccagactgagcctggcctacctgcccgtgaaggtgatccccagccaggccttcagaggcctgaacgaggtgatcaagatcgagatcagccagatcgacagcctggagagaatcgaggccaacgccttcgacaacctgctgaacctgagcgagatcctgatccagaacaccaagaacctgagatacatcgagcccggcgccttcatcaacctgcccagactgaagtacctgagcatctgcaacaccggcatcagaaagttccccgacgtgaccaaggtgttcagcagcgagagcaacttcatcctggagatctgcgacaacctgcacatcaccaccatccccggcaacgccttccagggcatgaacaacgagagcgtgaccctgaagctgtacggcaacggcttcgaggaggtgcagagccacgccttcaacggcaccaccctgaccagcctggagctgaaggagaacgtgcacctggagaagatgcacaacggcgccttcagaggcgccaccggccccaagaccctggacatcagcagcaccaagctgcaggccctgcccagctacggcctggagagcatccagagactgatcgccaccagcagctacagcctgaagaagctgcccagcagagagaccttcgtgaacctgctggaggccaccctgacctaccccagccactgctgcgccttcagaaacctgcccaccaaggactacagcagcatgctggccgagagcgagctgagcggctgggactacgagtacggcttctgcctgcccaagacccccagatgcgcccccgagcccgacgccttcaacccctgcgaggacatcatgggctacgacttcctgagagtgctgatctggctgatcaacatcctggccatcatgggcaacatgaccgtgctgttcgtgctgctgaccagcagatacaagctgaccgtgcccagattcctgatgtgcaacctgagcttcgccgacttctgcatgggcctgtacctgctgctgatcgccagcgtggacagccagaccaagggccagtactacaaccacgccatcgactggcagaccggcagcggctgcagcaccgccggcttcttcaccgtgttcgccagcgagctgagcgtgtacaccctgaccgtgatcaccctggagagatggcacaccatcacctacgccatccacctggaccagaagctgagactgagacacgccatcctgatcatgctgggcggctggctgttcagcagcctgatcgccatgctgcccctggtgggcgtgagcaactacatgaaggtgagcatctgcttccccatggacgtggagaccaccctgagccaggtgtacatcctgaccatcctgatcctgaacgtggtggccttcttcatcatctgcgcctgctacatcaagatctacttcgccgtgagaaaccccgagctgatggccaccaacaaggacaccaagatcgccaagaagatggccatcctgatcttcaccgacttcacctgcatggcccccatcagcttcttcgccatcagcgccgccttcaaggtgcccctgatcaccgtgaccaacagcaaggtgctgctggtgctgttctaccccatcaacagctgcgccaaccccttcctgtacgccatcttcaccaagaccttccagagagacttcttcctgctgctgagcaagttcggctgctgcaagagaagagccgagctgtacagaagaaaggacttcagcgcctacaccagcaactgcaagaacggcttcaccggcagcaacaagcccagccagagcaccctgaagctgagcaccctgcactgccagggcaccgccctgctggacaagaccagatacaccgagtgctag

SEQ ID NO: 87372 - DNA, 396 bp, Artificial Sequence
  Description of Artificial Sequence: Synthetic coding sequence
atgacccccctgctgaccctgatcctggtggtgctgatgggcctgcccctggcccaggccctggactgccacgtgtgcgcctacaacggcgacaactgcttcaaccccatgagatgccccgccatggtggcctactgcatgaccaccagaaccagcgccgccgaggccatctggtgccaccagtgcaccggcttcggcggctgcagccacggcagcagatgcctgagagacagcacccactgcgtgaccaccgccaccagagtgctgagcaacaccgaggacctgcccctggtgaccaagatgtgccacatcggctgccccgacatccccagcctgggcctgggcccctacgtgagcatcgcctgctgccagaccagcctgtgcaaccacgactag

SEQ ID NO: 87373 - DNA, 351 bp, Artificial Sequence
  Description of Artificial Sequence: Synthetic coding sequence
atgacccccctgctgaccctgatcctggtggtgctgatgggcctgcccctggcccaggccctggactgccacgtgtgcgcctacaacggcgacaactgcttcaaccccatgagatgccccgccatggtggcctactgcatgaccaccagaacctactacacccccaccagaatgaaggtgagcaagagctgcgtgcccagatgcttcgagaccgtgtacgacggctacagcaagcacgccagcaccaccagctgctgccagtacgacctgtgcaacggcaccggcctggccacccccgccaccctggccctggcccccatcctgctggccaccctgtggggcctgctgtag

SEQ ID NO: 87374 - DNA, 351 bp, Artificial Sequence; identical to SEQ ID NO: 87373
  Description of Artificial Sequence: Synthetic coding sequence

SEQ ID NO: 87375 - DNA, 351 bp, Artificial Sequence; identical to SEQ ID NO: 87373
  Description of Artificial Sequence: Synthetic coding sequence

SEQ ID NO: 87376 - DNA, 249 bp, Artificial Sequence
  Description of Artificial Sequence: Synthetic coding sequence
atgacccccctgctgaccctgatcctggtggtgctgatgggcctgcccctggcccaggccctggactgccacgtgtgcgcctacaacggcgacaactgcttcaaccccatgagatgccccgccatggtggcctactgcatgaccaccagaacctactacacccccaccagaatgaaggtgagcaagagctgcgtgcccagatgcttcgagaccgtgtacgacggctacagcaagcacgccagcacctag

SEQ ID NO: 87377 - DNA, 255 bp, Artificial Sequence
  Description of Artificial Sequence: Synthetic coding sequence
atgacccccctgctgaccctgatcctggtggtgctgatgggcctgcccctggcccaggccctggactgccacgtgtgcgcctacaacggcgacaactgcttcaaccccatgagatgccccgccatggtggcctactgcatgaccaccagaacctactacacccccaccagaatgaaggtgagcaagagctgcgtgcccagatgcttcgagaccgtgtacgacggctacagcaagcacgccagcaccaccagctag

SEQ ID NO: 87378 - DNA, 1041 bp, Artificial Sequence
  Description of Artificial Sequence: Synthetic coding sequence
atggaccccgccagaaaggccggcgcccaggccatgatctggaccgccggctggctgctgctgctgctgctgagaggcggcgcccaggccctggagtgctacagctgcgtgcagaaggccgacgacggctgcagccccaacaagatgaagaccgtgaagtgcgcccccggcgtggacgtgtgcaccgaggccgtgggcgccgtggagaccatccacggccagttcagcctggccgtgagaggctgcggcagcggcctgcccggcaagaacgacagaggcctggacctgcacggcctgctggccttcatccagctgcagcagtgcgcccaggacagatgcaacgccaagctgaacctgaccagcagagccctggaccccgccggcaacgagagcgcctacccccccaacggcgtggagtgctacagctgcgtgggcctgagcagagaggcctgccagggcaccagcccccccgtggtgagctgctacaacgccagcgaccacgtgtacaagggctgcttcgacggcaacgtgaccctgaccgccgccaacgtgaccgtgagcctgcccgtgagaggctgcgtgcaggacgagttctgcaccagagacggcgtgaccggccccggcttcaccctgagcggcagctgctgccagggcagcagatgcaacagcgacctgagaaacaagacctacttcagccccagaatcccccccctggtgagactgcccccccccgagcccaccaccgtggccagcaccaccagcgtgaccaccagcaccagcgcccccgtgagacccaccagcaccaccaagcccatgcccgcccccaccagccagacccccagacagggcgtggagcacgaggccagcagagacgaggagcccagactgaccggcggcgccgccggccaccaggacagaagcaacagcggccagtaccccgccaagggcggcccccagcagccccacaacaagggctgcgtggcccccaccgccggcctggccgccctgctgctggccgtggccgccggcgtgctgctgtag

SEQ ID NO: 87379 - DNA, 885 bp, Artificial Sequence
  Description of Artificial Sequence: Synthetic coding sequence
atggaccccgccagaaaggccggcgcccaggccatgatctggaccgccggctggctgctgctgctgctgctgagaggcggcgcccaggccctggagtgctacagctgcgtgcagaaggccgacgacggctgcagccccaacaagatgaagaccgtgaagtgcgcccccggcgtggacgtgtgcaccgaggccgtgggcgccgtggagaccatccacggccagttcagcctggccgtgagaggctgcggcagcggcctgcccggcaagaacgacagaggcctggacctgcacggcctgctggccttcatccagctgcagcagtgcgcccaggacagatgcaacgccaagctgaacctgaccagcagagccctggaccccgccgccgccgccaacgtgaccgtgagcctgcccgtgagaggctgcgtgcaggacgagttctgcaccagagacggcgtgaccggccccggcttcaccctgagcggcagctgctgccagggcagcagatgcaacagcgacctgagaaacaagacctacttcagccccagaatcccccccctggtgagactgcccccccccgagcccaccaccgtggccagcaccaccagcgtgaccaccagcaccagcgcccccgtgagacccaccagcaccaccaagcccatgcccgcccccaccagccagacccccagacagggcgtggagcacgaggccagcagagacgaggagcccagactgaccggcggcgccgccggccaccaggacagaagcaacagcggccagtaccccgccaagggcggcccccagcagccccacaacaagggctgcgtggcccccaccgccggcctggccgccctgctgctggccgtggccgccggcgtgctgctgtag

SEQ ID NO: 87380 - DNA, 516 bp, Artificial Sequence
  Description of Artificial Sequence: Synthetic coding sequence
atggagcccggccccgccctggcctggctgctgctgctgagcctgctggccgactgcctgaaggccgcccagagcagagacttcaccgtgaaggacatcatctacctgcaccccagcaccaccccctaccccggcggcttcaagtgcttcacctgcgagaaggccgccgacaactacgagtgcaacagatgggcccccgacatctactgccccagagagaccagatactgctacacccagcacaccatggaggtgaccggcaacagcatcagcgtgaccaagagatgcgtgcccctggaggagtgcctgagcaccggctgcagagacagcgagcacgagggccacaaggtgtgcaccagctgctgcgagggcaacatctgcaacctgcccctgcccagaaacgagaccgacgccaccttcgccaccaccagccccatcaaccagaccaacggccaccccagatgcatgagcgtgatcgtgagctgcctgtggctgtggctgggcctgatgctgtag

SEQ ID NO: 87381 - DNA, 516 bp, Artificial Sequence; identical to SEQ ID NO: 87380
  Description of Artificial Sequence: Synthetic coding sequence

SEQ ID NO: 87382 - DNA, 162 bp, Artificial Sequence
  Description of Artificial Sequence: Synthetic coding sequence
atggagcccggccccgccctggcctggctgctgctgctgagcctgctggccgactgcctgaaggccgcccagagcagagacttcaccgtgaaggacatcatctacctgcaccccagcaccaccccctaccccggcggcttcaagtgcttcacctgcgagtag

SEQ ID NO: 87383 - DNA, 969 bp, Artificial Sequence
  Description of Artificial Sequence: Synthetic coding sequence
atggccagatgcttcagcctggtgctgctgctgaccagcatctggaccaccagactgctggtgcagggcagcctgagagccgaggagctgagcatccaggtgagctgcagaatcatgggcatcaccctggtgagcaagaaggccaaccagcagctgaacttcaccgaggccaaggaggcctgcagactgctgggcctgagcctggccggcaaggaccaggtggagaccgccctgaaggccagcttcgagacctgcagctacggctgggtgggcgacggcttcgtggtgatcagcagaatcagccccaaccccaagtgcggcaagaacggcgtgggcgtgctgatctggaaggtgcccgtgagcagacagttcgccgcctactgctacaacagcagcgacacctggaccaacagctgcatccccgagatcatcaccaccaaggaccccatcttcaacacccagaccgccacccagaccaccgagttcatcgtgagcgacagcacctacagcgtggccagcccctacagcaccatccccgcccccaccaccaccccccccgcccccgccagcaccagcatccccagaagaaagaagctgatctgcgtgaccgaggtgttcatggagaccagcaccatgagcaccgagaccgagcccttcgtggagaacaaggccgccttcaagaacgaggccgccggcttcggcggcgtgcccaccgccctgctggtgctggccctgctgttcttcggcgccgccgccggcctgggcttctgctacgtgaagagatacgtgaaggccttccccttcaccaacaagaaccagcagaaggagatgatcgagaccaaggtggtgaaggaggagaaggccaacgacagcaaccccaacgaggagagcaagaagaccgacaagaaccccgaggagagcaagagccccagcaagaccaccgtgagatgcctggaggccgaggtgtag

SEQ ID NO: 87384 - DNA, 387 bp, Artificial Sequence
  Description of Artificial Sequence: Synthetic coding sequence
atgagaaccgccctgctgctgctggccgccctggccgtggccaccggccccgccctgaccctgagatgccacgtgtgcaccagcagcagcaactgcaagcacagcgtggtgtgccccgccagcagcagattctgcaagaccaccaacaccgtggagcccctgagaggcaacctggtgaagaaggactgcgccgagagctgcacccccagctacaccctgcagggccaggtgagcagcggcaccagcagcacccagtgctgccaggaggacctgtgcaacgagaagctgcacaacgccgcccccaccagaaccgccctggcccacagcgccctgagcctgggcctggccctgagcctgctggccgtgatcctggcccccagcctgtag

SEQ ID NO: 87385 - DNA, 396 bp, Artificial Sequence
  Description of Artificial Sequence: Synthetic coding sequence
atgaagatcttcctgcccgtgctgctggccgccctgctgggcgtggagagagccagcagcctgatgtgcttcagctgcctgaaccagaagagcaacctgtactgcctgaagcccaccatctgcagcgaccaggacaactactgcgtgaccgtgagcgccagcgccggcatcggcaacctggtgaccttcggccacagcctgagcaagacctgcagccccgcctgccccatccccgagggcgtgaacgtgggcgtggccagcatgggcatcagctgctgccagagcttcctgtgcaacttcagcgccgccgacggcggcctgagagccagcgtgaccctgctgggcgccggcctgctgctgagcctgctgcccgccctgctgagattcggcccctag

SEQ ID NO: 87386 - DNA, 396 bp, Artificial Sequence; identical to SEQ ID NO: 87385
  Description of Artificial Sequence: Synthetic coding sequence

SEQ ID NO: 87387 - DNA, 267 bp, Artificial Sequence
  Description of Artificial Sequence: Synthetic coding sequence
atgaagatcttcctgcccgtgctgctggccgccctgctgggcgtggagagagccagcagcctgatgtgcttcagctgcctgaaccagaagagcaacctgtactgcctgaagcccaccatctgcagcgaccaggacaactactgcgtgaccgtgagcgccagcgccggcatcggcaacctggtgaccttcggccacagcctgagcaagacctgcagccccgcctgccccatccccgagggcgtgaacgtgggcgtggccagcatgtag

SEQ ID NO: 87388 - DNA, 396 bp, Artificial Sequence; identical to SEQ ID NO: 87385
  Description of Artificial Sequence: Synthetic coding sequence

SEQ ID NO: 87389 - DNA, 396 bp, Artificial Sequence; identical to SEQ ID NO: 87385
  Description of Artificial Sequence: Synthetic coding sequence

SEQ ID NO: 87390 - DNA, 396 bp, Artificial Sequence; identical to SEQ ID NO: 87385
  Description of Artificial Sequence: Synthetic coding sequence

SEQ ID NO: 87391 - DNA, 396 bp, Artificial Sequence; identical to SEQ ID NO: 87385
  Description of Artificial Sequence: Synthetic coding sequence

SEQ ID NO: 87392 - DNA, 396 bp, Artificial Sequence; identical to SEQ ID NO: 87385
  Description of Artificial Sequence: Synthetic coding sequence

SEQ ID NO: 87393 - DNA, 402 bp, Artificial Sequence
  Description of Artificial Sequence: Synthetic coding sequence
atgaagccccagttcgtgggcatcctgctgagcagcctgctgggcgccgccctgggcaacagaatgagatgctacaactgcggcggcagccccagcagcagctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 87394 - DNA, 525 bp, Artificial Sequence
  Description of Artificial Sequence: Synthetic coding sequence
atgaagccccagttcgtgggcatcctgctgagcagcctgctgggcgccgccctgggcaacagaatgagatgctacaactgcggcggcagccccagcagcagctgcaaggaggccgtgaccacctgcggcgagggcagaccccagcccggcctggagcagatcaagctgcccggcaacagaagatgcttcctgagaggcctgaagatccccctgggcagcctgaagagccacctgctgtgccccagaagacaggtgctgaagcccggcgtgcagcaccccagcttcatcctgagcctgagccccagcgacctggacagccccaccagcagcctgagaagaagccccagcctgcagagcagcggcgacagagtgggcggcagaagagacctgagcagcccccagggcctgctgcccggcagacccgtgcagcagagaagaggcaagccctgcggcccctgcagacacttcggctgcagcagctacagacccgacctgagcctggccagaaccgtggagagaatctag

SEQ ID NO: 87395 - DNA, 402 bp, Artificial Sequence; identical to SEQ ID NO: 87393
  Description of Artificial Sequence: Synthetic coding sequence

SEQ ID NO: 87396 - DNA, 1149 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcaccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagaggcaacagaatgagatgctacaactgcggcggcagccccagcagcagctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 87397 - DNA, 402 bp, Artificial Sequence; identical to SEQ ID NO: 87393
  Description of Artificial Sequence: Synthetic coding sequence

SEQ ID NO: 87398 - DNA, 402 bp, Artificial Sequence; identical to SEQ ID NO: 87393
  Description of Artificial Sequence: Synthetic coding sequence

SEQ ID NO: 87399 - DNA, 1149 bp, Artificial Sequence
  Description of Artificial Sequence: Synthetic coding sequence
atggccgtgctgttcctgctgctgttcctgtgcggcaccccccaggccgccgacaacatgcaggccatctacgtggccctgggcgaggccgtggagctgccctgccccagcccccccaccctgcacggcgacgagcacctgagctggttctgcagccccgccgccggcagcttcaccaccctggtggcccaggtgcaggtgggcagacccgcccccgaccccggcaagcccggcagagagagcagactgagactgctgggcaactacagcctgtggctggagggcagcaaggaggaggacgccggcagatactggtgcgccgtgctgggccagcaccacaactaccagaactggagagtgtacgacgtgctggtgctgaagggcagccagctgagcgccagagccgccgacggcagcccctgcaacgtgctgctgtgcagcgtggtgcccagcagaagaatggacagcgtgacctggcaggagggcaagggccccgtgagaggcagagtgcagagcttctggggcagcgaggccgccctgctgctggtgtgccccggcgagggcctgagcgagcccagaagcagaagacccagaatcatcagatgcctgatgacccacaacaagggcgtgagcttcagcctggccgccagcatcgacgccagccccgccctgtgcgcccccagcaccggctgggacatgccctggatcctgatgctgctgctgaccatgggccagggcgtggtgatcctggccctgagcatcgtgctgtggagacagagagtgagaggcgcccccggcagaggcaacagaatgagatgctacaactgcggcggcagccccagcagcagctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 87400 - DNA, 402 bp, Artificial Sequence
  Description of Artificial Sequence: Synthetic coding sequence
atgaagccccagttcgtgggcatcctgctgagcagcctgctgggcgccgccctgggcaacagaatgagatgctacaactgcggcggcagccccagcagcacctgcaaggaggccgtgaccacctgcggcgagggcagaccccagcccggcctggagcagatcaagctgcccggcaacccccccgtgaccctgatccaccagcaccccgcctgcgtggccgcccaccactgcaaccaggtggagaccgagagcgtgggcgacgtgacctaccccgcccacagagactgctacctgggcgacctgtgcaacagcgccgtggccagccacgtggcccccgccggcatcctggccgccgccgccaccgccctgacctgcctgctgcccggcctgtggagcggctag

SEQ ID NO: 87401 - DNA, 402 bp, Artificial Sequence; identical to SEQ ID NO: 87393
  Description of Artificial Sequence: Synthetic coding sequence

SEQ ID NO: 87402 - DNA, 402 bp, Artificial Sequence; identical to SEQ ID NO: 87393
  Description of Artificial Sequence: Synthetic coding sequence

SEQ ID NO: 87403 - DNA, 525 bp, Artificial Sequence; identical to SEQ ID NO: 87394
  Description of Artificial Sequence: Synthetic coding sequence

SEQ ID NO: 87404 - DNA, 486 bp, Artificial Sequence
  Description of Artificial Sequence: Synthetic coding sequence
atgctggccccccagagaaccagagcccccagccccagagccgcccccagacccaccagaagcatgctgcccgccgccatgaagggcctgggcctggccctgctggccgtgctgctgtgcagcgcccccgcccacggcctgtggtgccaggactgcaccctgaccaccaacagcagccactgcacccccaagcagtgccagcccagcgacaccgtgtgcgccagcgtgagaatcaccgaccccagcagcagcagaaaggaccacagcgtgaacaagatgtgcgccagcagctgcgacttcgtgaagagacacttcttcagcgactacctgatgggcttcatcaacagcggcatcctgaaggtggacgtggactgctgcgagaaggacctgtgcaacggcgccgccggcgccggccacagcccctgggccctggccggcggcctgctgctgagcctgggccccgccctgctgtgggccggcccctag

SEQ ID NO: 87405 - DNA, 486 bp, Artificial Sequence; identical to SEQ ID NO: 87404
  Description of Artificial Sequence: Synthetic coding sequence

SEQ ID NO: 87406 - DNA, 423 bp, Artificial Sequence
  Description of Artificial Sequence: Synthetic coding sequence
atgctgcccgccgccatgaagggcctgggcctggccctgctggccgtgctgctgtgcagcgcccccgcccacggcctgtggtgccaggactgcaccctgaccaccaacagcagccactgcacccccaagcagtgccagcccagcgacaccgtgtgcgccagcgtgagaatcaccgaccccagcagcagcagaaaggaccacagcgtgaacaagatgtgcgccagcagctgcgacttcgtgaagagacacttcttcagcgactacctgatgggcttcatcaacagcggcatcctgaaggtggacgtggactgctgcgagaaggacctgtgcaacggcgccgccggcgccggccacagcccctgggccctggccggcggcctgctgctgagcctgggccccgccctgctgtgggccggcccctag

SEQ ID NO: 87407 - DNA, 1971 bp, Artificial Sequence
  Description of Artificial Sequence: Synthetic coding sequence
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 87408 - DNA, 1566 bp, Artificial Sequence
  Description of Artificial Sequence: Synthetic coding sequence
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagacccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagaaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtgccccccccccagcagaacgacctggagatccccgagagccccacctacgagaacttcacctag

SEQ ID NO: 87409 - DNA, 813 bp, Artificial Sequence
  Description of Artificial Sequence: Synthetic coding sequence
atgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcaggtggtgccccccccccagcagaacgacctggagatccccgagagccccacctacgagaacttcacctag

SEQ ID NO: 87410 - DNA, 813 bp, Artificial Sequence; identical to SEQ ID NO: 87409
  Description of Artificial Sequence: Synthetic coding sequence

SEQ ID NO: 87411 - DNA, 1968 bp, Artificial Sequence
  Description of Artificial Sequence: Synthetic coding sequence
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtgccccccccccagcagaacgacctggagatccccgagagccccacctacgagaacttcacctag

SEQ ID NO: 87412 - DNA, 1116 bp, Artificial Sequence
  Description of Artificial Sequence: Synthetic coding sequence
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagagagagcctgggcagagcccccatcaccagattcctgctgtag

SEQ ID NO: 87413 - DNA, 1809 bp, Artificial Sequence
  Description of Artificial Sequence: Synthetic coding sequence
atgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 87414 - DNA, 582 bp, Artificial Sequence
  Description of Artificial Sequence: Synthetic coding sequence
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgcccccttcatcgagaagctgagcgtgcacgtgatcgagggcgaccacagaaccctgctggagggcagcggcctggagagcatcatcagcaccctggccgagcccagagtgagcgtgagagagggctag

SEQ ID NO: 87415 - DNA, 1581 bp, Artificial Sequence
  Description of Artificial Sequence: Synthetic coding sequence
atgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagacccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 87416 - DNA, 1884 bp, Artificial Sequence
  Description of Artificial Sequence: Synthetic coding sequence
atggccagaggcagcgtgagcgacgaggagatgatggagctgagagaggccttcgccaaggtggacaccgacggcaacggctacatcagcttcaacgagctgaacgacctgttcaaggccgcctgcctgcccctgcccggctacagagtgagagagatcaccgagaacctgatggccaccggcgacctggaccaggacggcagaatcagcttcgacgagttcatcaagatcttccacggcctgaagagcaccgacgtggccaagaccttcagaaaggccatcaacaagaaggagggcatctgcgccatcggcggcaccagcgagcagagcagcgtgggcacccagcacagctacagcgaggaggagaagtacgccttcgtgaactggatcaacaaggccctggagaacgaccccgactgcagacacgtgatccccatgaaccccaacaccaacgacctgttcaacgccgtgggcgacggcatcgtgctgtgcaagatgatcaacctgagcgtgcccgacaccatcgacgagagaaccatcaacaagaagaagctgacccccttcaccatccaggagaacctgaacctggccctgaacagcgccagcgccatcggctgccacgtggtgaacatcggcgccgaggacctgaaggagggcaagccctacctggtgctgggcctgctgtggcaggtgatcaagatcggcctgttcgccgacatcgagctgagcagaaacgaggccctgatcgccctgctgagagagggcgagagcctggaggacctgatgaagctgagccccgaggagctgctgctgagatgggccaactaccacctggagaacgccggctgcaacaagatcggcaacttcagcaccgacatcaaggacagcaaggcctactaccacctgctggagcaggtggcccccaagggcgacgaggagggcgtgcccgccgtggtgatcgacatgagcggcctgagagagaaggacgacatccagagagccgagtgcatgctgcagcaggccgagagactgggctgcagacagttcgtgaccgccaccgacgtggtgagaggcaaccccaagctgaacctggccttcatcgccaacctgttcaacagataccccgccctgcacaagcccgagaaccaggacatcgactggggcgccctggagggcgagaccagagaggagagaaccttcagaaactggatgaacagcctgggcgtgaaccccagagtgaaccacctgtacagcgacctgagcgacgccctggtgatcttccagctgtacgagaagatcaaggtgcccgtggactggaacagagtgaacaagcccccctaccccaagctgggcggcaacatgaagaagctggagaactgcaactacgccgtggagctgggcaagaaccaggccaagttcagcctggtgggcatcggcggccaggacctgaacgagggcaacagaaccctgaccctggccctgatctggcagctgatgagaagatacaccctgaacatcctggaggagatcggcggcggccagaaggtgaacgacgacatcatcgtgaactgggtgaacgagaccctgagagaggccaagaagagcagcagcatcagcagcttcaaggaccccaagatcagcaccagcctgcccgtgctggacctgatcgacgccatccagcccggcagcatcaactacgacctgctgaagaccgagaacctgaacgacgacgagaagctgaacaacgccaagtacgccatcagcatggccagaaagatcggcgccagagtgtacgccctgcccgaggacctggtggaggtgaaccccaagatggtgatgaccgtgttcgcctgcctgatgggcaagggcatgaagagagtgtag

SEQ ID NO: 87417 - DNA, 1884 bp, Artificial Sequence; identical to SEQ ID NO: 87416
  Description of Artificial Sequence: Synthetic coding sequence

SEQ ID NO: 87418 - DNA, 741 bp, Artificial Sequence
  Description of Artificial Sequence: Synthetic coding sequence
atggccagaggcagcgtgagcgacgaggagatgatggagctgagagaggccttcgccaaggtggacaccgacggcaacggctacatcagcttcaacgagctgaacgacctgttcaaggccgcctgcctgcccctgcccggctacagagtgagagagatcaccgagaacctgatggccaccggcgacctggaccaggacggcagaatcagcttcgacgagttcatcaagatcttccacggcctgaagagcaccgacgtggccaagaccttcagaaaggccatcaacaagaaggagggcatctgcgccatcggcggcaccagcgagcagagcagcgtgggcacccagcacagctacagcgaggaggagaagtacgccttcgtgaactggatcaacaaggccctggagaacgaccccgactgcagacacgtgatccccatgaaccccaacaccaacgacctgttcaacgccgtgggcgacggcatcgtgctgtgcaagatgatcaacctgagcgtgcccgacaccatcgacgagagaaccatcaacaagaagaagctgacccccttcaccatccaggagaacctgaacctggccctgaacagcgccagcgccatcggctgccacgtggtgaacatcggcgccgaggacctgaaggagggcaagccctacctggtgctgggcctgctgtggcaggtgatcaagatcggcctgttcgccgacatcgagctgagcagaaacgagtag

SEQ ID NO: 87419 - DNA, 591 bp, Artificial Sequence
  Description of Artificial Sequence: Synthetic coding sequence
atgtgcgccgaggacggcgacagcaagttcagcatgagcatcagcatgaacagccccttcctggagatcctgcacctggagaactgcaactacgccgtggagctgggcaagaaccaggccaagttcagcctggtgggcatcggcggccaggacctgaacgagggcaacagaaccctgaccctggccctgatctggcagctgatgagaagatacaccctgaacatcctggaggagatcggcggcggccagaaggtgaacgacgacatcatcgtgaactgggtgaacgagaccctgagagaggccaagaagagcagcagcatcagcagcttcaaggaccccaagatcagcaccagcctgcccgtgctggacctgatcgacgccatccagcccggcagcatcaactacgacctgctgaagaccgagaacctgaacgacgacgagaagctgaacaacgccaagtacgccatcagcatggccagaaagatcggcgccagagtgtacgccctgcccgaggacctggtggaggtgaaccccaagatggtgatgaccgtgttcgcctgcctgatgggcaagggcatgaagagagtgtag

SEQ ID NO: 87420 - DNA, 201 bp, Artificial Sequence
  Description of Artificial Sequence: Synthetic coding sequence
atggccagaggcagcgtgagcgacgaggagatgatggagctgagagaggccttcgccaaggtggacaccgacggcaacggctacatcagcttcaacgagctgaacgacctgttcaaggccgcctgcctgcccctgcccggctacagagtgagagagatcaccgagaacctgatggccaccggcgacctggaccaggactag

SEQ ID NO: 87421 - DNA, 1602 bp, Artificial Sequence
  Description of Artificial Sequence: Synthetic coding sequence
atggccctgagaaacgtgcccttcagaagcgaggtgctgggctgggaccccgacagcctggccgactacttcaagaagctgaactacaaggactgcgagaaggccgtgaagaagtaccacatcgacggcgccagattcctgaacctgaccgagaacgacatccagaagttccccaagctgagagtgcccatcctgagcaagctgagccaggagatcaacaagaacgaggagagaagaagcatcttcaccagaaagccccaggtgcccagattccccgaggagaccgagagccacgaggaggacaacggcggctggagcagcttcgaggaggacgactacgagagccccaacgacgaccaggacggcgaggacgacggcgactacgagagccccaacgaggaggaggaggcccccgtggaggacgacgccgactacgagcccccccccagcaacgacgaggaggccctgcagaacagcatcctgcccgccaagcccttccccaacagcaacagcatgtacatcgacagaccccccagcggcaagaccccccagcagccccccgtgcccccccagagacccatggccgccctgccccccccccccgccggcagaaaccacagccccctgccccccccccagaccaaccacgaggagcccagcagaagcagaaaccacaagaccgccaagctgcccgcccccagcatcgacagaagcaccaagccccccctggacagaagcctggcccccttcgacagagagcccttcaccctgggcaagaagccccccttcagcgacaagcccagcatccccgccggcagaagcctgggcgagcacctgcccaagatccagaagccccccctgccccccaccaccgagagacacgagagaagcagccccctgcccggcaagaagccccccgtgcccaagcacggctggggccccgacagaagagagaacgacgaggacgacgtgcaccagagacccctgccccagcccgccctgctgcccatgagcagcaacaccttccccagcagaagcaccaagcccagccccatgaaccccctgcccagcagccacatgcccggcgccttcagcgagagcaacagcagcttcccccagagcgccagcctgcccccctacttcagccagggccccagcaacagaccccccatcagagccgagggcagaaacttccccctgcccctgcccaacaagcccagaccccccagccccgccgaggaggagaacagcctgaacgaggagtggtacgtgagctacatcaccagacccgaggccgaggccgccctgagaaagatcaaccaggacggcaccttcctggtgagagacagcagcaagaagaccaccaccaacccctacgtgctgatggtgctgtacaaggacaaggtgtacaacatccagatcagataccagaaggagagccaggtgtacctgctgggcaccggcctgagaggcaaggaggacttcctgagcgtgagcgacatcatcgactacttcagaaagatgcccctgctgctgatcgacggcaagaacagaggcagcagataccagtgcaccctgacccacgccgccggctacccctag

SEQ ID NO: 87422 - DNA, 1578 bp, Artificial Sequence
  Description of Artificial Sequence: Synthetic coding sequence
atgtgggaggcccagttcctgggcctgctgttcctgcagcccctgtgggtggcccccgtgaagcccctgcagcccggcgccgaggtgcccgtggtgtgggcccaggagggcgcccccgcccagctgccctgcagccccaccatccccctgcaggacctgagcctgctgagaagagccggcgtgacctggcagcaccagcccgacagcggcccccccgccgccgcccccggccaccccctggcccccggcccccaccccgccgcccccagcagctggggccccagacccagaagatacaccgtgctgagcgtgggccccggcggcctgagaagcggcagactgcccctgcagcccagagtgcagctggacgagagaggcagacagagaggcgacttcagcctgtggctgagacccgccagaagagccgacgccggcgagtacagagccgccgtgcacctgagagacagagccctgagctgcagactgagactgagactgggccaggccagcatgaccgccagcccccccggcagcctgagagccagcgactgggtgatcctgaactgcagcttcagcagacccgacagacccgccagcgtgcactggttcagaaacagaggccagggcagagtgcccgtgagagagagcccccaccaccacctggccgagagcttcctgttcctgccccaggtgagccccatggacagcggcccctggggctgcatcctgacctacagagacggcttcaacgtgagcatcatgtacaacctgaccgtgctgggcctggagccccccacccccctgaccgtgtacgccggcgccggcagcagagtgggcctgccctgcagactgcccgccggcgtgggcaccagaagcttcctgaccgccaagtggaccccccccggcggcggccccgacctgctggtgaccggcgacaacggcgacttcaccctgagactggaggacgtgagccaggcccaggccggcacctacacctgccacatccacctgcaggagcagcagctgaacgccaccgtgaccctggccatcatcaccgtgacccccaagagcttcggcagccccggcagcctgggcaagctgctgtgcgaggtgacccccgtgagcggccaggagagattcgtgtggagcagcctggacacccccagccagagaagcttcagcggcccctggctggaggcccaggaggcccagctgctgagccagccctggcagtgccagctgtaccagggcgagagactgctgggcgccgccgtgtacttcaccgagctgagcagccccggcgcccagagaagcggcagagcccccggcgccctgcccgccggccacctgctgctgttcctgatcctgggcgtgctgagcctgctgctgctggtgaccggcgccttcggcttccacctgtggagaagacagtggagacccagaagattcagcgccctggagcagggcatccaccccccccaggcccagagcaagatcgaggagctggagcaggagcccgagcccgagcccgagcccgagcccgagcccgagcccgagcccgagcccgagcagctgtag

SEQ ID NO: 87423 - DNA, 1020 bp, Artificial Sequence
  Description of Artificial Sequence: Synthetic coding sequence
atggccgaggccagcagcgaccccggcgccgaggagagagaggagctgctgggccccaccgcccagtggagcgtggaggacgaggaggaggccgtgcacgagcagtgccagcacgagagagacagacagctgcaggcccaggacgaggagggcggcggccacgtgcccgagagacccaagcaggagatgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagaaggaggacagcgacgaggtgcacctggaggagctgagcctgagcaaggagggccccggccccgaggacaccgtgcaggacaacctgggcgccgccggcgccgaggaggagcaggaggagcaccagaagtgccagcagcccagaacccccagccccctggtgctggagggcaccatcgagcagagcagcccccccctgagccccaccaccaagctgatcgacagaaccgagagcctgaacagaagcatcgagaagagcaacagcgtgaagaagagccagcccgacctgcccatcagcaagatcgaccagtggctggagcagtacacccaggccatcgagaccgccggcagaacccccaagctggccagacaggccagcatcgagctgcccagcatggccgtggccagcaccaagagcagatgggagaccggcgaggtgcaggcccagagcgccgccaagacccccagctgcaaggacatcgtggccggcgacatgagcaagaagagcctgtgggagcagaagggcggcagcaagaccagcagcaccatcaagagcacccccagcggcaagagatacaagttcgtggccaccggccacggcaagtacgagaaggtgctggtggagggcggccccgccccctag

SEQ ID NO: 87424 - DNA, 834 bp, Artificial Sequence
  Description of Artificial Sequence: Synthetic coding sequence
atgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagaaggaggacagcgacgaggtgcacctggaggagctgagcctgagcaaggagggccccggccccgaggacaccgtgcaggacaacctgggcgccgccggcgccgaggaggagcaggaggagcaccagaagtgccagcagcccagaacccccagccccctggtgctggagggcaccatcgagcagagcagcccccccctgagccccaccaccaagctgatcgacagaaccgagagcctgaacagaagcatcgagaagagcaacagcgtgaagaagagccagcccgacctgcccatcagcaagatcgaccagtggctggagcagtacacccaggccatcgagaccgccggcagaacccccaagctggccagacaggccagcatcgagctgcccagcatggccgtggccagcaccaagagcagatgggagaccggcgaggtgcaggcccagagcgccgccaagacccccagctgcaaggacatcgtggccggcgacatgagcaagaagagcctgtgggagcagaagggcggcagcaagaccagcagcaccatcaagagcacccccagcggcaagagatacaagttcgtggccaccggccacggcaagtacgagaaggtgctggtggagggcggccccgccccctag

SEQ ID NO: 87425 - DNA, 834 bp, Artificial Sequence; identical to SEQ ID NO: 87424
  Description of Artificial Sequence: Synthetic coding sequence

SEQ ID NO: 87426 - DNA, 669 bp, Artificial Sequence
  Description of Artificial Sequence: Synthetic coding sequence
atgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagaaggaggacagcgacgaggtgcacctggaggagctgagcctgagcaaggagggccccggccccgaggacaccgtgcaggacaacctgggcgccgccggcgccgaggaggagcaggaggagcaccagaagtgccagcagcccagaacccccagccccctggtgctggagggcaccatcgagcagagcagcccccccctgagccccaccaccaagctgatcgacagaaccgagagcctgaacagaagcatcgagaagagcaacagcgtgaagaagagccagcccgacctgcccatcagcaagatcgaccagtggctggagcagtacacccaggccatcgagaccgccggcagaacccccaagctggccagacaggccagcatcgagctgcccagcatggccgtggccagcaccaagagcagatgggagaccggcgaggtgcaggcccagagcgccgccaagacccccagctgcaagtag

SEQ ID NO: 87427 - DNA, 183 bp, Artificial Sequence
  Description of Artificial Sequence: Synthetic coding sequence
atgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgtag

SEQ ID NO: 87428 - DNA, 669 bp, Artificial Sequence; identical to SEQ ID NO: 87426
  Description of Artificial Sequence: Synthetic coding sequence

SEQ ID NO: 87429 - DNA, 381 bp, Artificial Sequence
  Description of Artificial Sequence: Synthetic coding sequence
atgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagaaggaggacagcgacgaggtgcacctggaggagctgagcctgagcaaggagggccccggccccgaggacaccgtgcaggacaacctgggcgccgccggcgccgaggaggagcaggaggagcaccagaagtgccagcagcccagaacccccagccccctggtgctggagggcaccatcgagcagagctag

SEQ ID NO: 87430 - DNA, 195 bp, Artificial Sequence
  Description of Artificial Sequence: Synthetic coding sequence
atgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagtag

SEQ ID NO: 87431 - DNA, 1404 bp, Artificial Sequence
  Description of Artificial Sequence: Synthetic coding sequence
atggcccccatctggagcccccccggcagagtgagcggctgccacctgagcagcggccccgcccccggcagcgccgtgggcccctggctgggcaccccccaccccagcctgcccctgcccctggccccccacaagccccccccccccggcctgcccggcagcgccggccagaccagcctgcccgcccagagagagtgcgtgttccccggcgacgccgccgtgcaccaggagctgtgcggcctgggcttcgaggagtgcctgggcagcatcccccaggcccaccagtgctacctgaccaacggccccaagagaagaaagtgcagccccagaagaagaggcagagcccccgcctggctgtgcggcggcagccccccctgccaccagggcctgggccacgagcaccccagcagcggccccagcaccaactgcagccccagacccaccgcccagtggagcgtggaggacgaggaggaggccgtgcacgagcagtgccagcacgagagagacagacagctgcaggcccaggacgaggagggcggcggccacgtgcccgagagacccaagcaggagatgctgctgagcctgaagcccagcgaggcccccgagctggacgaggacgagggcttcggcgactggagccagagacccgagcagagacagcagcacgagggcgcccagggcgccctggacagcggcgagcccccccagtgcagaagccccgagggcgagcaggaggacagacccggcctgcacgcctacgagaaggaggacagcgacgaggtgcacctggaggagctgagcctgagcaaggagggccccggccccgaggacaccgtgcaggacaacctgggcgccgccggcgccgaggaggagcaggaggagcaccagaagtgccagcagcccagaacccccagccccctggtgctggagggcaccatcgagcagagcagcccccccctgagccccaccaccaagctgatcgacagaaccgagagcctgaacagaagcatcgagaagagcaacagcgtgaagaagagccagcccgacctgcccatcagcaagatcgaccagtggctggagcagtacacccaggccatcgagaccgccggcagaacccccaagctggccagacaggccagcatcgagctgcccagcatggccgtggccagcaccaagagcagatgggagaccggcgaggtgcaggcccagagcgccgccaagacccccagctgcaaggacatcgtggccggcgacatgagcaagaagagcctgtgggagcagaagggcggcagcaagaccagcagcaccatcaagagcacccccagcggcaagagatacaagttcgtggccaccggccacggcaagtacgagaaggtgctggtggagggcggccccgccccctag

SEQ ID NO: 87432 - DNA, 618 bp, Artificial Sequence
  Description of Artificial Sequence: Synthetic coding sequence
atgaccccccccgagagactgttcctgcccagagtgtgcggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaacctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtaccccggcctgcaggagccctggctgcacagcatgtaccacggcgccgccttccagctgacccagggcgaccagctgagcacccacaccgacggcatcccccacctggtgctgagccccagcaccgtgttcttcggcgccttcgccctgtag

SEQ ID NO: 87433 - DNA, 618 bp, Artificial Sequence; identical to SEQ ID NO: 87432
  Description of Artificial Sequence: Synthetic coding sequence

SEQ ID NO: 87434 - DNA, 618 bp, Artificial Sequence
  Description of Artificial Sequence: Synthetic coding sequence
atgaccccccccgagagactgttcctgcccagagtgtgcggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtaccccggcctgcaggagccctggctgcacagcatgtaccacggcgccgccttccagctgacccagggcgaccagctgagcacccacaccgacggcatcccccacctggtgctgagccccagcaccgtgttcttcggcgccttcgccctgtag

SEQ ID NO: 87435 - DNA, 618 bp, Artificial Sequence; identical to SEQ ID NO: 87434
  Description of Artificial Sequence: Synthetic coding sequence

SEQ ID NO: 87436 - DNA, 618 bp, Artificial Sequence; identical to SEQ ID NO: 87434
  Description of Artificial Sequence: Synthetic coding sequence

SEQ ID NO: 87437 - DNA, 618 bp, Artificial Sequence
  Description of Artificial Sequence: Synthetic coding sequence
atgaccccccccgagagactgttcctgcccagagtgagaggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtaccccggcctgcaggagccctggctgcacagcatgtaccacggcgccgccttccagctgacccagggcgaccagctgagcacccacaccgacggcatcccccacctggtgctgagccccagcaccgtgttcttcggcgccttcgccctgtag

SEQ ID NO: 87438 - DNA, 618 bp, Artificial Sequence; identical to SEQ ID NO: 87434
  Description of Artificial Sequence: Synthetic coding sequence

SEQ ID NO: 87439 - DNA, 417 bp, Artificial Sequence
  Description of Artificial Sequence: Synthetic coding sequence
atgaccccccccgagagactgttcctgcccagagtgtgcggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccagggcagcagcccccccctgctgtggcccttccagcagctgaagagcagcctgatcaagagccccgagctgagcaagaagtag

SEQ ID NO: 87440 - DNA, 618 bp, Artificial Sequence; identical to SEQ ID NO: 87437
  Description of Artificial Sequence: Synthetic coding sequence

SEQ ID NO: 87441 - DNA, 618 bp, Artificial Sequence; identical to SEQ ID NO: 87437
  Description of Artificial Sequence: Synthetic coding sequence

SEQ ID NO: 87442 - DNA, 618 bp, Artificial Sequence; identical to SEQ ID NO: 87434
  Description of Artificial Sequence: Synthetic coding sequence

SEQ ID NO: 87443 - DNA, 618 bp, Artificial Sequence; identical to SEQ ID NO: 87434
  Description of Artificial Sequence: Synthetic coding sequence

SEQ ID NO: 87444 - DNA, 618 bp, Artificial Sequence; identical to SEQ ID NO: 87437
  Description of Artificial Sequence: Synthetic coding sequence

SEQ ID NO: 87445 - DNA, 417 bp, Artificial Sequence
  Description of Artificial Sequence: Synthetic coding sequence
atgaccccccccgagagactgttcctgcccagagtgagaggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaccctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccagggcagcagcccccccctgctgtggcccttccagcagctgaagagcagcctgatcaagagccccgagctgagcaagaagtag

SEQ ID NO: 87446 - DNA, 474 bp, Artificial Sequence
  Description of Artificial Sequence: Synthetic coding sequence
atgaccccccccgagagactgttcctgcccagagtgtgcggcaccaccctgcacctgctgctgctgggcctgctgctggtgctgctgcccggcgcccagggcctgcccggcgtgggcctgacccccagcgccgcccagaccgccagacagcaccccaagatgcacctggcccacagcaacctgaagcccgccgcccacctgatcggcgaccccagcaagcagaacagcctgctgtggagagccaacaccgacagagccttcctgcaggacggcttcagcctgagcaacaacagcctgctggtgcccaccagcggcatctacttcgtgtacagccagctgcccgaggacggcgtgagcagagccgccggcaccctggccgccctggacgtgcccagaggctgcgtgcccgcccaccccggcagacccgccatccacccccacagatggcaccccccccccagcccccagccctag

SEQ ID NO: 87447 - DNA, 417 bp, Artificial Sequence; identical to SEQ ID NO: 87439
  Description of Artificial Sequence: Synthetic coding sequence

SEQ ID NO: 87448 - DNA, 417 bp, Artificial Sequence; identical to SEQ ID NO: 87439
  Description of Artificial Sequence: Synthetic coding sequence

SEQ ID NO: 87449 - DNA, 417 bp, Artificial Sequence; identical to SEQ ID NO: 87445
  Description of Artificial Sequence: Synthetic coding sequence

SEQ ID NO: 87450 - DNA, 735 bp, Artificial Sequence
  Description of Artificial Sequence: Synthetic coding sequence
atgggcgccctgggcctggagggcagaggcggcagactgcagggcagaggcagcctgctgctggccgtggccggcgccaccagcctggtgaccctgctgctggccgtgcccatcaccgtgctggccgtgctggccctggtgccccaggaccagggcggcctggtgaccgagaccgccgaccccggcgcccaggcccagcagggcctgggcttccagaagctgcccgaggaggagcccgagaccgacctgagccccggcctgcccgccgcccacctgatcggcgcccccctgaagggccagggcctgggctgggagaccaccaaggagcaggccttcctgaccagcggcacccagttcagcgacgccgagggcctggccctgccccaggacggcctgtactacctgtactgcctggtgggctacagaggcagagccccccccggcggcggcgacccccagggcagaagcgtgaccctgagaagcagcctgtacagagccggcggcgcctacggccccggcacccccgagctgctgctggagggcgccgagaccgtgacccccgtgctggaccccgccagaagacagggctacggccccctgtggtacaccagcgtgggcttcggcggcctggtgcagctgagaagaggcgagagagtgtacgtgaacatcagccaccccgacatggtggacttcgccagaggcaagaccttcttcggcgccgtgatggtgggctag

SEQ ID NO: 87451 - DNA, 735 bp, Artificial Sequence; identical to SEQ ID NO: 87450
  Description of Artificial Sequence: Synthetic coding sequence

SEQ ID NO: 87452 - DNA, 735 bp, Artificial Sequence; identical to SEQ ID NO: 87450
  Description of Artificial Sequence: Synthetic coding sequence

SEQ ID NO: 87453 - DNA, 735 bp, Artificial Sequence; identical to SEQ ID NO: 87450
  Description of Artificial Sequence: Synthetic coding sequence

SEQ ID NO: 87454 - DNA, 735 bp, Artificial Sequence; identical to SEQ ID NO: 87450
  Description of Artificial Sequence: Synthetic coding sequence

SEQ ID NO: 87455 - DNA, 735 bp, Artificial Sequence; identical to SEQ ID NO: 87450
  Description of Artificial Sequence: Synthetic coding sequence

SEQ ID NO: 87456 - DNA, 234 bp, Artificial Sequence
  Description of Artificial Sequence: Synthetic coding sequence
atgggcgccctgggcctggagggcagaggcggcagactgcagggcagaggcagcctgctgctggccgtggccggcgccaccagcctggtgaccctgctgctggccgtgcccatcaccgtgctggccgtgctggccctggtgccccaggaccagggcggcctgggcttcagaagctgccagagaagaagccagaagcagatcagcgcccccggcagccagctgcccaccagctag

SEQ ID NO: 87457 - DNA, 735 bp, Artificial Sequence; identical to SEQ ID NO: 87450
  Description of Artificial Sequence: Synthetic coding sequence

SEQ ID NO: 87458 - DNA, 735 bp, Artificial Sequence; identical to SEQ ID NO: 87450
  Description of Artificial Sequence: Synthetic coding sequence

SEQ ID NO: 87459 - DNA, 276 bp, Artificial Sequence
  Description of Artificial Sequence: Synthetic coding sequence
atggccgccagcagcagagcccaggtgctgagcctgtacagagccatgctgagagagagcaagagattcagcgcctacaactacagaacctacgccgtgagaagaatcagagacgccttcagagagaacaagaacgtgaaggaccccgtggagatccagaccctggtgaacaaggccaagagagacctgggcgtgatcagaagacaggtgcacatcggccagctgtacagcaccgacaagctgatcatcgagaacagagacatgcccagaacctag

SEQ ID NO: 87460 - DNA, 393 bp, Artificial Sequence
  Description of Artificial Sequence: Synthetic coding sequence
atggccgccagcagcagagcccaggtgctgagcctgtacagagccatgctgagagagagcaagagattcagcgcctacaactacagaacctacgccgtgagaagaatcagagacgccttcagagagaacaagaacgtgaaggaccccgtggagatccagaccctggtgaacaaggccaagagagacctgggcgtgatcagaagacagatggacagccacagcgtggcccaggccggcgtgcactggaacgacctgagcagcctgcagcccctgcccccctggttcaagcagttcagctgcctgagcctgcccagcagctgggactacagaagaaccccccccagactggccaacttctgcatcctgagcagagacgtgatcagcctgtactag

SEQ ID NO: 87461 - DNA, 291 bp, Artificial Sequence
  Description of Artificial Sequence: Synthetic coding sequence
atggccgccagcagcagagcccaggtgctgagcctgtacagagccatgctgagagagagcaagagattcagcgcctacaactacagaacctacgccgtgagaagaatcagagacgccttcagagagaacaagaacgtgaaggaccccgtggagatccagaccctggtgaacaaggccaagagagacctgggcgtgatcagaagacaggtggccgagcagggcaccgccgccagaagaaagagcggcaacagcagcagaagcctgggcaagccctgcaccagctggccctag

SEQ ID NO: 87462 - DNA, 2559 bp, Artificial Sequence
  Description of Artificial Sequence: Synthetic coding sequence
atgctgagcggcaagaaggccgccgccgccgccgccgccgccgccgccgccgccaccggcaccgaggccggccccggcaccgccggcggcagcgagaacggcagcgaggtggccgcccagcccgccggcctgagcggccccgccgaggtgggccccggcgccgtgggcgagagaacccccagaaagaaggagccccccagagccagcccccccggcggcctggccgagccccccggcagcgccggcccccaggccggccccaccgtggtgcccggcagcgccacccccatggagaccggcatcgccgagacccccgagggcagaagaaccagcagaagaaagagagccaaggtggagtacagagagatggacgagagcctggccaacctgagcgaggacgagtactacagcgaggaggagagaaacgccaaggccgagaaggagaagaagctgccccccccccccccccaggccccccccgaggaggagaacgagagcgagcccgaggagcccagcggcgtggagggcgccgccttccagagcagactgccccacgacagaatgaccagccaggaggccgcctgcttccccgacatcatcagcggcccccagcagacccagaaggtgttcctgttcatcagaaacagaaccctgcagctgtggctggacaaccccaagatccagctgaccttcgaggccaccctgcagcagctggaggccccctacaacagcgacaccgtgctggtgcacagagtgcacagctacctggagagacacggcctgatcaacttcggcatctacaagagaatcaagcccctgcccaccaagaagaccggcaaggtgatcatcatcggcagcggcgtgagcggcctggccgccgccagacagctgcagagcttcggcatggacgtgaccctgctggaggccagagacagagtgggcggcagagtggccaccttcagaaagggcaactacgtggccgacctgggcgccatggtggtgaccggcctgggcggcaaccccatggccgtggtgagcaagcaggtgaacatggagctggccaagatcaagcagaagtgccccctgtacgaggccaacggccaggccgtgcccaaggagaaggacgagatggtggagcaggagttcaacagactgctggaggccaccagctacctgagccaccagctggacttcaacgtgctgaacaacaagcccgtgagcctgggccaggccctggaggtggtgatccagctgcaggagaagcacgtgaaggacgagcagatcgagcactggaagaagatcgtgaagacccaggaggagctgaaggagctgctgaacaagatggtgaacctgaaggagaagatcaaggagctgcaccagcagtacaaggaggccagcgaggtgaagccccccagagacatcaccgccgagttcctggtgaagagcaagcacagagacctgaccgccctgtgcaaggagtacgacgagctggccgagacccagggcaagctggaggagaagctgcaggagctggaggccaacccccccagcgacgtgtacctgagcagcagagacagacagatcctggactggcacttcgccaacctggagttcgccaacgccacccccctgagcaccctgagcctgaagcactgggaccaggacgacgacttcgagttcaccggcagccacctgaccgtgagaaacggctacagctgcgtgcccgtggccctggccgagggcctggacatcaagctgaacaccgccgtgagacaggtgagatacaccgccagcggctgcgaggtgatcgccgtgaacaccagaagcaccagccagaccttcatctacaagtgcgacgccgtgctgtgcaccctgcccctgggcgtgctgaagcagcagccccccgccgtgcagttcgtgccccccctgcccgagtggaagaccagcgccgtgcagagaatgggcttcggcaacctgaacaaggtggtgctgtgcttcgacagagtgttctgggaccccagcgtgaacctgttcggccacgtgggcagcaccaccgccagcagaggcgagctgttcctgttctggaacctgtacaaggcccccatcctgctggccctggtggccggcgaggccgccggcatcatggagaacatcagcgacgacgtgatcgtgggcagatgcctggccatcctgaagggcatcttcggcagcagcgccgtgccccagcccaaggagaccgtggtgagcagatggagagccgacccctgggccagaggcagctacagctacgtggccgccggcagcagcggcaacgactacgacctgatggcccagcccatcacccccggccccagcatccccggcgccccccagcccatccccagactgttcttcgccggcgagcacaccatcagaaactaccccgccaccgtgcacggcgccctgctgagcggcctgagagaggccggcagaatcgccgaccagttcctgggcgccatgtacaccctgcccagacaggccacccccggcgtgcccgcccagcagagccccagcatgtag

SEQ ID NO: 87463 - DNA, 2631 bp, Artificial Sequence
  Description of Artificial Sequence: Synthetic coding sequence
atgctgagcggcaagaaggccgccgccgccgccgccgccgccgccgccgccgccaccggcaccgaggccggccccggcaccgccggcggcagcgagaacggcagcgaggtggccgcccagcccgccggcctgagcggccccgccgaggtgggccccggcgccgtgggcgagagaacccccagaaagaaggagccccccagagccagcccccccggcggcctggccgagccccccggcagcgccggcccccaggccggccccaccgtggtgcccggcagcgccacccccatggagaccggcatcgccgagacccccgagggcagaagaaccagcagaagaaagagagccaaggtggagtacagagagatggacgagagcctggccaacctgagcgaggacgagtactacagcgaggaggagagaaacgccaaggccgagaaggagaagaagctgccccccccccccccccaggccccccccgaggaggagaacgagagcgagcccgaggagcccagcggccaggccggcggcctgcaggacgacagcagcggcggctacggcgacggccaggccagcggcgtggagggcgccgccttccagagcagactgccccacgacagaatgaccagccaggaggccgcctgcttccccgacatcatcagcggcccccagcagacccagaaggtgttcctgttcatcagaaacagaaccctgcagctgtggctggacaaccccaagatccagctgaccttcgaggccaccctgcagcagctggaggccccctacaacagcgacaccgtgctggtgcacagagtgcacagctacctggagagacacggcctgatcaacttcggcatctacaagagaatcaagcccctgcccaccaagaagaccggcaaggtgatcatcatcggcagcggcgtgagcggcctggccgccgccagacagctgcagagcttcggcatggacgtgaccctgctggaggccagagacagagtgggcggcagagtggccaccttcagaaagggcaactacgtggccgacctgggcgccatggtggtgaccggcctgggcggcaaccccatggccgtggtgagcaagcaggtgaacatggagctggccaagatcaagcagaagtgccccctgtacgaggccaacggccaggccgagagaatcatcgtgcccaaggagaaggacgagatggtggagcaggagttcaacagactgctggaggccaccagctacctgagccaccagctggacttcaacgtgctgaacaacaagcccgtgagcctgggccaggccctggaggtggtgatccagctgcaggagaagcacgtgaaggacgagcagatcgagcactggaagaagatcgtgaagacccaggaggagctgaaggagctgctgaacaagatggtgaacctgaaggagaagatcaaggagctgcaccagcagtacaaggaggccagcgaggtgaagccccccagagacatcaccgccgagttcctggtgaagagcaagcacagagacctgaccgccctgtgcaaggagtacgacgagctggccgagacccagggcaagctggaggagaagctgcaggagctggaggccaacccccccagcgacgtgtacctgagcagcagagacagacagatcctggactggcacttcgccaacctggagttcgccaacgccacccccctgagcaccctgagcctgaagcactgggaccaggacgacgacttcgagttcaccggcagccacctgaccgtgagaaacggctacagctgcgtgcccgtggccctggccgagggcctggacatcaagctgaacaccgccgtgagacaggtgagatacaccgccagcggctgcgaggtgatcgccgtgaacaccagaagcaccagccagaccttcatctacaagtgcgacgccgtgctgtgcaccctgcccctgggcgtgctgaagcagcagccccccgccgtgcagttcgtgccccccctgcccgagtggaagaccagcgccgtgcagagaatgggcttcggcaacctgaacaaggtggtgctgtgcttcgacagagtgttctgggaccccagcgtgaacctgttcggccacgtgggcagcaccaccgccagcagaggcgagctgttcctgttctggaacctgtacaaggcccccatcctgctggccctggtggccggcgaggccgccggcatcatggagaacatcagcgacgacgtgatcgtgggcagatgcctggccatcctgaagggcatcttcggcagcagcgccgtgccccagcccaaggagaccgtggtgagcagatggagagccgacccctgggccagaggcagctacagctacgtggccgccggcagcagcggcaacgactacgacctgatggcccagcccatcacccccggccccagcatccccggcgccccccagcccatccccagactgttcttcgccggcgagcacaccatcagaaactaccccgccaccgtgcacggcgccctgctgagcggcctgagagaggccggcagaatcgccgaccagttcctgggcgccatgtacaccctgcccagacaggccacccccggcgtgcccgcccagcagagccccagcatgtag

SEQ ID NO: 87464 - DNA, 2631 bp, Artificial Sequence
  Description of Artificial Sequence: Synthetic coding sequence
atgctgagcggcaagaaggccgccgccgccgccgccgccgccgccgccgccgccaccggcaccgaggccggccccggcaccgccggcggcagcgagaacggcagcgaggtggccgcccagcccgccggcctgagcggccccgccgaggtgggccccggcgccgtgggcgagagaacccccagaaagaaggagccccccagagccagcccccccggcggcctggccgagccccccggcagcgccggcccccaggccggccccaccgtggtgcccggcagcgccacccccatggagaccggcatcgccgagacccccgagggcagaagaaccagcagaagaaagagagccaaggtggagtacagagagatggacgagagcctggccaacctgagcgaggacgagtactacagcgaggaggagagaaacgccaaggccgagaaggagaagaagctgccccccccccccccccaggccccccccgaggaggagaacgagagcgagcccgaggagcccagcggccaggccggcggcctgcaggacgacagcagcggcggctacggcgacggccaggccagcggcgtggagggcgccgccttccagagcagactgccccacgacagaatgaccagccaggaggccgcctgcttccccgacatcatcagcggcccccagcagacccagaaggtgttcctgttcatcagaaacagaaccctgcagctgtggctggacaaccccaagatccagctgaccttcgaggccaccctgcagcagctggaggccccctacaacagcgacaccgtgctggtgcacagagtgcacagctacctggagagacacggcctgatcaacttcggcatctacaagagaatcaagcccctgcccaccaagaagaccggcaaggtgatcatcatcggcagcggcgtgagcggcctggccgccgccagacagctgcagagcttcggcatggacgtgaccctgctggaggccagagacagagtgggcggcagagtggccaccttcagaaagggcaactacgtggccgacctgggcgccatggtggtgaccggcctgggcggcaaccccatggccgtggtgagcaagcaggtgaacatggagctggccaagatcaagcagaagtgccccctgtacgaggccaacggccaggccgacaccgtgaaggtgcccaaggagaaggacgagatggtggagcaggagttcaacagactgctggaggccaccagctacctgagccaccagctggacttcaacgtgctgaacaacaagcccgtgagcctgggccaggccctggaggtggtgatccagctgcaggagaagcacgtgaaggacgagcagatcgagcactggaagaagatcgtgaagacccaggaggagctgaaggagctgctgaacaagatggtgaacctgaaggagaagatcaaggagctgcaccagcagtacaaggaggccagcgaggtgaagccccccagagacatcaccgccgagttcctggtgaagagcaagcacagagacctgaccgccctgtgcaaggagtacgacgagctggccgagacccagggcaagctggaggagaagctgcaggagctggaggccaacccccccagcgacgtgtacctgagcagcagagacagacagatcctggactggcacttcgccaacctggagttcgccaacgccacccccctgagcaccctgagcctgaagcactgggaccaggacgacgacttcgagttcaccggcagccacctgaccgtgagaaacggctacagctgcgtgcccgtggccctggccgagggcctggacatcaagctgaacaccgccgtgagacaggtgagatacaccgccagcggctgcgaggtgatcgccgtgaacaccagaagcaccagccagaccttcatctacaagtgcgacgccgtgctgtgcaccctgcccctgggcgtgctgaagcagcagccccccgccgtgcagttcgtgccccccctgcccgagtggaagaccagcgccgtgcagagaatgggcttcggcaacctgaacaaggtggtgctgtgcttcgacagagtgttctgggaccccagcgtgaacctgttcggccacgtgggcagcaccaccgccagcagaggcgagctgttcctgttctggaacctgtacaaggcccccatcctgctggccctggtggccggcgaggccgccggcatcatggagaacatcagcgacgacgtgatcgtgggcagatgcctggccatcctgaagggcatcttcggcagcagcgccgtgccccagcccaaggagaccgtggtgagcagatggagagccgacccctgggccagaggcagctacagctacgtggccgccggcagcagcggcaacgactacgacctgatggcccagcccatcacccccggccccagcatccccggcgccccccagcccatccccagactgttcttcgccggcgagcacaccatcagaaactaccccgccaccgtgcacggcgccctgctgagcggcctgagagaggccggcagaatcgccgaccagttcctgggcgccatgtacaccctgcccagacaggccacccccggcgtgcccgcccagcagagccccagcatgtag

SEQ ID NO: 87465 - DNA, 1773 bp, Artificial Sequence
  Description of Artificial Sequence: Synthetic coding sequence
atggccacccccagaggcagaaccaagaagaaggccagcttcgaccacagccccgacagcctgcccctgagaagcagcggcagacaggccaagaagaaggccaccgagaccaccgacgaggacgaggacggcggcagcgagaagaagtacagaaagtgcgagaaggccggctgcaccgccacctgccccgtgtgcttcgccagcgccagcgagagatgcgccaagaacggctacaccagcagatggtaccacctgagctgcggcgagcacttctgcaacgagtgcttcgaccactactacagaagccacaaggacggctacgacaagtacaccacctggaagaagatctggaccagcaacggcaagaccgagcccagccccaaggccttcatggccgaccagcagctgccctactgggtgcagtgcaccaagcccgagtgcagaaagtggagacagctgaccaaggagatccagctgaccccccagatcgccaagacctacagatgcggcatgaagcccaacaccgccatcaagcccgagaccagcgaccactgcagcctgcccgaggacctggaggccctgaccccccagaagtgcatcccccacatcatcgtgagaggcctggtgagaatcagatgcgtgcaggaggtggagagaatcctgtacttcatgaccagaaagggcctgatcaacaccggcgtgctgagcgtgggcgccgaccagtacctgctgcccaaggactaccacaacaagagcgtgatcatcatcggcgccggccccgccggcctggccgccgccagacagctgcacaacttcggcatcaaggtgaccgtgctggaggccaaggacagaatcggcggcagagtgtgggacgacaagagcttcaagggcgtgaccgtgggcagaggcgcccagatcgtgaacggctgcatcaacaaccccgtggccctgatgtgcgagcaggtgagcgccagaagctgggaccacaacgagttcttcgcccagttcgccggcgaccacaccctgctgacccccggctacagcgtgatcatcgagaagctggccgagggcctggacatccagctgaagagccccgtgcagtgcatcgactacagcggcgacgaggtgcaggtgaccaccaccgacggcaccggctacagcgcccagaaggtgctggtgaccgtgcccctggccctgctgcagaagggcgccatccagttcaacccccccctgagcgagaagaagatgaaggccatcaacagcctgggcgccggcatcatcgagaagatcgccctgcagttcccctacagattctgggacagcaaggtgcagggcgccgacttcttcggccacgtgccccccagcgccagcaagagaggcctgttcgccgtgttctacgacatggacccccagaagaagcacagcgtgctgatgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87466 - DNA, 2463 bp, Artificial Sequence
  Description of Artificial Sequence: Synthetic coding sequence
atggccacccccagaggcagaaccaagaagaaggccagcttcgaccacagccccgacagcctgcccctgagaagcagcggcagacaggccaagaagaaggccaccgagaccaccgacgaggacgaggacggcggcagcgagaagaagtacagaaagtgcgagaaggccggctgcaccgccacctgccccgtgtgcttcgccagcgccagcgagagatgcgccaagaacggctacaccagcagatggtaccacctgagctgcggcgagcacttctgcaacgagtgcttcgaccactactacagaagccacaaggacggctacgacaagtacaccacctggaagaagatctggaccagcaacggcaagaccgagcccagccccaaggccttcatggccgaccagcagctgccctactgggtgcagtgcaccaagcccgagtgcagaaagtggagacagctgaccaaggagatccagctgaccccccagatcgccaagacctacagatgcggcatgaagcccaacaccgccatcaagcccgagaccagcgaccactgcagcctgcccgaggacctgagagtgctggaggtgagcaaccactggtggtacagcatgctgatcctgccccccctgctgaaggacagcgtggccgcccccctgctgagcgcctactaccccgactgcgtgggcatgagccccagctgcaccagcaccaacagagccgccgccaccggcaacgccagccccggcaagctggagcacagcaaggccgccctgagcgtgcacgtgcccggcatgaacagatacttccagcccttctaccagcccaacgagtgcggcaaggccctgtgcgtgagacccgacgtgatggagctggacgagctgtacgagttccccgagtacagcagagaccccaccatgtacctggccctgagaaacctgatcctggccctgtggtacaccaactgcaaggaggccctgaccccccagaagtgcatcccccacatcatcgtgagaggcctggtgagaatcagatgcgtgcaggaggtggagagaatcctgtacttcatgaccagaaagggcctgatcaacaccggcgtgctgagcgtgggcgccgaccagtacctgctgcccaaggactaccacaacaagagcgtgatcatcatcggcgccggccccgccggcctggccgccgccagacagctgcacaacttcggcatcaaggtgaccgtgctggaggccaaggacagaatcggcggcagagtgtgggacgacaagagcttcaagggcgtgaccgtgggcagaggcgcccagatcgtgaacggctgcatcaacaaccccgtggccctgatgtgcgagcagctgggcatcagcatgcacaagttcggcgagagatgcgacctgatccaggagggcggcagaatcaccgaccccaccatcgacaagagaatggacttccacttcaacgccctgctggacgtggtgagcgagtggagaaaggacaagacccagctgcaggacgtgcccctgggcgagaagatcgaggagatctacaaggccttcatcaaggagagcggcatccagttcagcgagctggagggccaggtgctgcagttccacctgagcaacctggagtacgcctgcggcagcaacctgcaccaggtgagcgccagaagctgggaccacaacgagttcttcgcccagttcgccggcgaccacaccctgctgacccccggctacagcgtgatcatcgagaagctggccgagggcctggacatccagctgaagagccccgtgcagtgcatcgactacagcggcgacgaggtgcaggtgaccaccaccgacggcaccggctacagcgcccagaaggtgctggtgaccgtgcccctggccctgctgcagaagggcgccatccagttcaacccccccctgagcgagaagaagatgaaggccatcaacagcctgggcgccggcatcatcgagaagatcgccctgcagttcccctacagattctgggacagcaaggtgcagggcgccgacttcttcggccacgtgccccccagcgccagcaagagaggcctgttcgccgtgttctacgacatggacccccagcacagcgtgctgatgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87467 - DNA, 2472 bp, Artificial Sequence
  Description of Artificial Sequence: Synthetic coding sequence
atggccacccccagaggcagaaccaagaagaaggccagcttcgaccacagccccgacagcctgcccctgagaagcagcggcagacaggccaagaagaaggccaccgagaccaccgacgaggacgaggacggcggcagcgagaagaagtacagaaagtgcgagaaggccggctgcaccgccacctgccccgtgtgcttcgccagcgccagcgagagatgcgccaagaacggctacaccagcagatggtaccacctgagctgcggcgagcacttctgcaacgagtgcttcgaccactactacagaagccacaaggacggctacgacaagtacaccacctggaagaagatctggaccagcaacggcaagaccgagcccagccccaaggccttcatggccgaccagcagctgccctactgggtgcagtgcaccaagcccgagtgcagaaagtggagacagctgaccaaggagatccagctgaccccccagatcgccaagacctacagatgcggcatgaagcccaacaccgccatcaagcccgagaccagcgaccactgcagcctgcccgaggacctgagagtgctggaggtgagcaaccactggtggtacagcatgctgatcctgccccccctgctgaaggacagcgtggccgcccccctgctgagcgcctactaccccgactgcgtgggcatgagccccagctgcaccagcaccaacagagccgccgccaccggcaacgccagccccggcaagctggagcacagcaaggccgccctgagcgtgcacgtgcccggcatgaacagatacttccagcccttctaccagcccaacgagtgcggcaaggccctgtgcgtgagacccgacgtgatggagctggacgagctgtacgagttccccgagtacagcagagaccccaccatgtacctggccctgagaaacctgatcctggccctgtggtacaccaactgcaaggaggccctgaccccccagaagtgcatcccccacatcatcgtgagaggcctggtgagaatcagatgcgtgcaggaggtggagagaatcctgtacttcatgaccagaaagggcctgatcaacaccggcgtgctgagcgtgggcgccgaccagtacctgctgcccaaggactaccacaacaagagcgtgatcatcatcggcgccggccccgccggcctggccgccgccagacagctgcacaacttcggcatcaaggtgaccgtgctggaggccaaggacagaatcggcggcagagtgtgggacgacaagagcttcaagggcgtgaccgtgggcagaggcgcccagatcgtgaacggctgcatcaacaaccccgtggccctgatgtgcgagcagctgggcatcagcatgcacaagttcggcgagagatgcgacctgatccaggagggcggcagaatcaccgaccccaccatcgacaagagaatggacttccacttcaacgccctgctggacgtggtgagcgagtggagaaaggacaagacccagctgcaggacgtgcccctgggcgagaagatcgaggagatctacaaggccttcatcaaggagagcggcatccagttcagcgagctggagggccaggtgctgcagttccacctgagcaacctggagtacgcctgcggcagcaacctgcaccaggtgagcgccagaagctgggaccacaacgagttcttcgcccagttcgccggcgaccacaccctgctgacccccggctacagcgtgatcatcgagaagctggccgagggcctggacatccagctgaagagcccccaggtgcagtgcatcgactacagcggcgacgaggtgcaggtgaccaccaccgacggcaccggctacagcgcccagaaggtgctggtgaccgtgcccctggccctgctgcagaagggcgccatccagttcaacccccccctgagcgagaagaagatgaaggccatcaacagcctgggcgccggcatcatcgagaagatcgccctgcagttcccctacagattctgggacagcaaggtgcagggcgccgacttcttcggccacgtgccccccagcgccagcaagagaggcctgttcgccgtgttctacgacatggacccccagaagaagcacagcgtgctgatgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87468 - DNA, 1776 bp, Artificial Sequence
  Description of Artificial Sequence: Synthetic coding sequence
atggccacccccagaggcagaaccaagaagaaggccagcttcgaccacagccccgacagcctgcccctgagaagcagcggcagacaggccaagaagaaggccaccgagaccaccgacgaggacgaggacggcggcagcgagaagaagtacagaaagtgcgagaaggccggctgcaccgccacctgccccgtgtgcttcgccagcgccagcgagagatgcgccaagaacggctacaccagcagatggtaccacctgagctgcggcgagcacttctgcaacgagtgcttcgaccactactacagaagccacaaggacggctacgacaagtacaccacctggaagaagatctggaccagcaacggcaagaccgagcccagccccaaggccttcatggccgaccagcagctgccctactgggtgcagtgcaccaagcccgagtgcagaaagtggagacagctgaccaaggagatccagctgaccccccagatcgccaagacctacagatgcggcatgaagcccaacaccgccatcaagcccgagaccagcgaccactgcagcctgcccgaggacctggaggccctgaccccccagaagtgcatcccccacatcatcgtgagaggcctggtgagaatcagatgcgtgcaggaggtggagagaatcctgtacttcatgaccagaaagggcctgatcaacaccggcgtgctgagcgtgggcgccgaccagtacctgctgcccaaggactaccacaacaagagcgtgatcatcatcggcgccggccccgccggcctggccgccgccagacagctgcacaacttcggcatcaaggtgaccgtgctggaggccaaggacagaatcggcggcagagtgtgggacgacaagagcttcaagggcgtgaccgtgggcagaggcgcccagatcgtgaacggctgcatcaacaaccccgtggccctgatgtgcgagcaggtgagcgccagaagctgggaccacaacgagttcttcgcccagttcgccggcgaccacaccctgctgacccccggctacagcgtgatcatcgagaagctggccgagggcctggacatccagctgaagagcccccaggtgcagtgcatcgactacagcggcgacgaggtgcaggtgaccaccaccgacggcaccggctacagcgcccagaaggtgctggtgaccgtgcccctggccctgctgcagaagggcgccatccagttcaacccccccctgagcgagaagaagatgaaggccatcaacagcctgggcgccggcatcatcgagaagatcgccctgcagttcccctacagattctgggacagcaaggtgcagggcgccgacttcttcggccacgtgccccccagcgccagcaagagaggcctgttcgccgtgttctacgacatggacccccagaagaagcacagcgtgctgatgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87469 - DNA, 1923 bp, Artificial Sequence
  Description of Artificial Sequence: Synthetic coding sequence
tgatgcagcctgcccgaggacctgagagtgctggaggtgagcaaccactggtggtacagcatgctgatcctgccccccctgctgaaggacagcgtggccgcccccctgctgagcgcctactaccccgactgcgtgggcatgagccccagctgcaccagcaccaacagagccgccgccaccggcaacgccagccccggcaagctggagcacagcaaggccgccctgagcgtgcacgtgcccggcatgaacagatacttccagcccttctaccagcccaacgagtgcggcaaggccctgtgcgtgagacccgacgtgatggagctggacgagctgtacgagttccccgagtacagcagagaccccaccatgtacctggccctgagaaacctgatcctggccctgtggtacaccaactgcaaggaggccctgaccccccagaagtgcatcccccacatcatcgtgagaggcctggtgagaatcagatgcgtgcaggaggtggagagaatcctgtacttcatgaccagaaagggcctgatcaacaccggcgtgctgagcgtgggcgccgaccagtacctgctgcccaaggactaccacaacaagagcgtgatcatcatcggcgccggccccgccggcctggccgccgccagacagctgcacaacttcggcatcaaggtgaccgtgctggaggccaaggacagaatcggcggcagagtgtgggacgacaagagcttcaagggcgtgaccgtgggcagaggcgcccagatcgtgaacggctgcatcaacaaccccgtggccctgatgtgcgagcagctgggcatcagcatgcacaagttcggcgagagatgcgacctgatccaggagggcggcagaatcaccgaccccaccatcgacaagagaatggacttccacttcaacgccctgctggacgtggtgagcgagtggagaaaggacaagacccagctgcaggacgtgcccctgggcgagaagatcgaggagatctacaaggccttcatcaaggagagcggcatccagttcagcgagctggagggccaggtgctgcagttccacctgagcaacctggagtacgcctgcggcagcaacctgcaccaggtgagcgccagaagctgggaccacaacgagttcttcgcccagttcgccggcgaccacaccctgctgacccccggctacagcgtgatcatcgagaagctggccgagggcctggacatccagctgaagagcccccaggtgcagtgcatcgactacagcggcgacgaggtgcaggtgaccaccaccgacggcaccggctacagcgcccagaaggtgctggtgaccgtgcccctggccctgctgcagaagggcgccatccagttcaacccccccctgagcgagaagaagatgaaggccatcaacagcctgggcgccggcatcatcgagaagatcgccctgcagttcccctacagattctgggacagcaaggtgcagggcgccgacttcttcggccacgtgccccccagcgccagcaagagaggcctgttcgccgtgttctacgacatggacccccagaagaagcacagcgtgctgatgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87470 - DNA, 342 bp, Artificial Sequence
  Description of Artificial Sequence: Synthetic coding sequence
atgagcgtgatcgccggcgaggccgtggccagcgtgagaaccctggacgacaagcaggtgctgcagcagtgcatggccaccctgagagagctgttcaaggagcaggaggtgcccgaccccaccaagtacttcgtgaccagatggagcaccgacccctggatccagatggcctacagcttcgtgaagaccggcggcagcggcgaggcctacgacatcatcgccgaggacatccagggcaccgtgttcttcgccggcgaggccaccaacagacacttcccccagaccgtgaccggcgcctacctgagcggcgtgagagaggccagcaagatcgccgccttctag

SEQ ID NO: 87471 - DNA, 3966 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaaggtgtgcgtggagttcgacggcgagagctggagaaagagaagatggatcgaggtgtacagcctgctgagaagagccttcctggtggagcacaacctggtgctggccgagagaaagagccccgagatcagcgagagaatcgtgcagtggcccgccatcacctacaagcccctgctggacaaggccggcctgggcagcatcaccagcgtgagattcctgggcgaccagcagagagtgttcctgagcaaggacctgctgaagcccatccaggacgtgaacagcctgagactgagcctgaccgacaaccagatcgtgagcaaggagttccaggccctgatcgtgaagcacctggacgagagccacctgctgaagggcgacaagaacctggtgggcagcgaggtgaagatctacagcctggaccccagcacccagtggttcagcgccaccgtgatcaacggcaaccccgccagcaagaccctgcaggtgaactgcgaggagatccccgccctgaagatcgtggaccccagcctgatccacgtggaggtggtgcacgacaacctggtgacctgcggcaacagcgccagaatcggcgccgtgaagagaaagagcagcgagaacaacggcaccctggtgagcaagcaggccaagagctgcagcgaggccagccccagcatgtgccccgtgcagagcgtgcccaccaccgtgttcaaggagatcctgctgggctgcaccgccgccaccccccccagcaaggaccccagacagcagagcaccccccaggccgccaacagcccccccaacctgggcgccaagatcccccagggctgccacaagcagagcctgcccgaggagatcagcagctgcctgaacaccaagagcgaggccctgagaaccaagcccgacgtgtgcaaggccggcctgctgagcaagagcagccagatcggcaccggcgacctgaagatcctgaccgagcccaagggcagctgcacccagcccaagaccaacaccgaccaggagaacagactggagagcgtgccccaggccctgaccggcctgcccaaggagtgcctgcccaccaaggccagcagcaaggccgagctggagatcgccaacccccccgagctgcagaagcacctggagcacgcccccagccccagcgacgtgagcaacgcccccgaggtgaaggccggcgtgaacagcgacagccccaacaactgcagcggcaagaaggtggagcccagcgccctggcctgcagaagccagaacctgaaggagagcagcgtgaaggtggacaacgagagctgctgcagcagaagcaacaacaagatccagaacgcccccagcagaaagagcgtgctgaccgaccccgccaagctgaagaagctgcagcagagcggcgaggccttcgtgcaggacgacagctgcgtgaacatcgtggcccagctgcccaagtgcagagagtgcagactggacagcctgagaaaggacaaggagcagcagaaggacagccccgtgttctgcagattcttccacttcagaagactgcagttcaacaagcacggcgtgctgagagtggagggcttcctgacccccaacaagtacgacaacgaggccatcggcctgtggctgcccctgaccaagaacgtggtgggcatcgacctggacaccgccaagtacatcctggccaacatcggcgaccacttctgccagatggtgatcagcgagaaggaggccatgagcaccatcgagccccacagacaggtggcctggaagagagccgtgaagggcgtgagagagatgtgcgacgtgtgcgacaccaccatcttcaacctgcactgggtgtgccccagatgcggcttcggcgtgtgcgtggactgctacagaatgaagagaaagaactgccagcagggcgccgcctacaagaccttcagctggctgaagtgcgtgaagagccagatccacgagcccgagaacctgatgcccacccagatcatccccggcaaggccctgtacgacgtgggcgacatcgtgcacagcgtgagagccaagtggggcatcaaggccaactgcccctgcagcaacagacagttcaagctgttcagcaagcccgccagcaaggaggacctgaagcagaccagcctggccggcgagaagcccaccctgggcgccgtgctgcagcagaaccccagcgtgctggagcccgccgccgtgggcggcgaggccgccagcaagcccgccggcagcatgaagcccgcctgccccgccagcaccagccccctgaactggctggccgacctgaccagcggcaacgtgaacaaggagaacaaggagaagcagcccaccatgcccatcctgaagaacgagatcaagtgcctgccccccctgccccccctgagcaagagcagcaccgtgctgcacaccttcaacagcaccatcctgacccccgtgagcaacaacaacagcggcttcctgagaaacctgctgaacagcagcaccggcaagaccgagaacggcctgaagaacacccccaagatcctggacgacatcttcgccagcctggtgcagaacaagaccaccagcgacctgagcaagagaccccagggcctgaccatcaagcccagcatcctgggcttcgacaccccccactactggctgtgcgacaacagactgctgtgcctgcaggaccccaacaacaagagcaactggaacgtgttcagagagtgctggaagcagggccagcccgtgatggtgagcggcgtgcaccacaagctgaacagcgagctgtggaagcccgagagcttcagaaaggagttcggcgagcaggaggtggacctggtgaactgcagaaccaacgagatcatcaccggcgccaccgtgggcgacttctgggacggcttcgaggacgtgcccaacagactgaagaacgagaaggagcccatggtgctgaagctgaaggactggccccccggcgaggacttcagagacatgatgcccagcagattcgacgacctgatggccaacatccccctgcccgagtacaccagaagagacggcaagctgaacctggccagcagactgcccaactacttcgtgagacccgacctgggccccaagatgtacaacgcctacggcctgatcacccccgaggacagaaagtacggcaccaccaacctgcacctggacgtgagcgacgccgccaacgtgatggtgtacgtgggcatccccaagggccagtgcgagcaggaggaggaggtgctgaagaccatccaggacggcgacagcgacgagctgaccatcaagagattcatcgagggcaaggagaagcccggcgccctgtggcacatctacgccgccaaggacaccgagaagatcagagagttcctgaagaaggtgagcgaggagcagggccaggagaaccccgccgaccacgaccccatccacgaccagagctggtacctggacagaagcctgagaaagagactgcaccaggagtacggcgtgcagggctgggccatcgtgcagttcctgggcgacgtggtgttcatccccgccggcgccccccaccaggtgcacaacctgtacagctgcatcaaggtggccgaggacttcgtgagccccgagcacgtgaagcactgcttctggctgacccaggagttcagatacctgagccagacccacaccaaccacgaggacaagctgcaggtgaagaacgtgatctaccacgccgtgaaggacgccgtggccatgctgaaggccagcgagagcagcttcggcaagccctag

SEQ ID NO: 87472 - DNA, 3966 bp, Artificial Sequence; identical to SEQ ID NO: 87471
  Description of Artificial Sequence: Synthetic coding sequence

SEQ ID NO: 87473 - DNA, 3966 bp, Artificial Sequence; identical to SEQ ID NO: 87471
  Description of Artificial Sequence: Synthetic coding sequence

SEQ ID NO: 87474 - DNA, 513 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaaggtgtgcgtggagttcgacggcgagagctggagaaagagaagatggatcgaggtgtacagcctgctgagaagagccttcctggtggagcacaacctggtgctggccgagagaaagagccccgagatcagcgagagaatcgtgcagtggcccgccatcacctacaagcccctgctggacaaggccggcctgggcagcatcaccagcgtgagattcctgggcgaccagcagagagtgttcctgagcaaggacctgctgaagcccatccaggacgtgaacagcctgagactgagcctgaccgacaaccagatcgtgagcaaggagttctag

SEQ ID NO: 87475 - DNA, 2136 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaaggtgtgcgtggagttcgacggcgagagctggagaaagagaagatggatcgaggtgtacagcctgctgagaagagccttcctggtggagcacaacctggtgctggccgagagaaagagccccgagatcagcgagagaatcgtgcagtggcccgccatcacctacaagcccctgctggacaaggccggcctgggcagcatcaccagcgtgagattcctgggcgaccagcagagagtgttcctgagcaaggacctgctgaagcccatccaggacgtgaacagcctgagactgagcctgaccgacaaccagatcgtgagcaaggagttccaggccctgatcgtgaagcacctggacgagagccacctgctgaagggcgacaagaacctggtgggcagcgaggtgaagatctacagcctggaccccagcacccagtggttcagcgccaccgtgatcaacggcaaccccgccagcaagaccctgcaggtgaactgcgaggagatccccgccctgaagatcgtggaccccagcctgatccacgtggaggtggtgcacgacaacctggtgacctgcggcaacagcgccagaatcggcgccgtgaagagaaagagcagcgagaacaacggcaccctggtgagcaagcaggccaagagctgcagcgaggccagccccagcatgtgccccgtgcagagcgtgcccaccaccgtgttcaaggagatcctgctgggctgcaccgccgccaccccccccagcaaggaccccagacagcagagcaccccccaggccgccaacagcccccccaacctgggcgccaagatcccccagggctgccacaagcagagcctgcccgaggagatcagcagctgcctgaacaccaagagcgaggccctgagaaccaagcccgacgtgtgcaaggccggcctgctgagcaagagcagccagatcggcaccggcgacctgaagatcctgaccgagcccaagggcagctgcacccagcccaagaccaacaccgaccaggagaacagactggagagcgtgccccaggccctgaccggcctgcccaaggagtgcctgcccaccaaggccagcagcaaggccgagctggagatcgccaacccccccgagctgcagaagcacctggagcacgcccccagccccagcgacgtgagcaacgcccccgaggtgaaggccggcgtgaacagcgacagccccaacaactgcagcggcaagaaggtggagcccagcgccctggcctgcagaagccagaacctgaaggagagcagcgtgaaggtggacaacgagagctgctgcagcagaagcaacaacaagatccagaacgcccccagcagaaagagcgtgctgaccgaccccgccaagctgaagaagctgcagcagagcggcgaggccttcgtgcaggacgacagctgcgtgaacatcgtggcccagctgcccaagtgcagagagtgcagactggacagcctgagaaaggacaaggagcagcagaaggacagccccgtgttctgcagattcttccacttcagaagactgcagttcaacaagcacggcgtgctgagagtggagggcttcctgacccccaacaagtacgacaacgaggccatcggcctgtggctgcccctgaccaagaacgtggtgggcatcgacctggacaccgccaagtacatcctggccaacatcggcgaccacttctgccagatggtgatcagcgagaaggaggccatgagcaccatcgagccccacagacaggtggcctggaagagagccgtgaagggcgtgagagagatgtgcgacgtgtgcgacaccaccatcttcaacctgcactgggtgtgccccagatgcggcttcggcgtgtgcgtggactgctacagaatgaagagaaagaactgccagcagggcgagaacagattcgacagcccccccgcccccctgcacagctag

SEQ ID NO: 87476 - DNA, 366 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaaggtgtgcgtggagttcgacggcgagagctggagaaagagaagatggatcgaggtgtacagcctgctgagaagagccttcctggtggagcacaacctggtgctggccgagagaaagagccccgagatcagcgagagaatcgtgcagtggcccgccatcacctacaagcccctgctggactag

SEQ ID NO: 87477 - DNA, 3984 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaaggtgtgcgtggagttcgacggcgagagctggagaaagagaagatggatcgaggtgtacagcctgctgagaagagccttcctggtggagcacaacctggtgctggccgagagaaagagccccgagatcagcgagagaatcgtgcagtggcccgccatcacctacaagcccctgctggacaaggccggcctgggcagcatcaccagcgtgagattcctgggcgaccagcagagagtgttcctgagcaaggacctgctgaagcccatccaggacgtgaacagcctgagactgagcctgaccgacaaccagatcgtgagcaaggagttccaggccctgatcgtgaagcacctggacgagagccacctgctgaagggcgacaagaacctggtgggcagcgaggtgaagatctacagcctggaccccagcacccagtggttcagcgccaccgtgatcaacggcaaccccgccagcaagaccctgcaggtgaactgcgaggagatccccgccctgaagatcgtggaccccagcctgatccacgtggaggtggtgcacgacaacctggtgacctgcggcaacagcgccagaatcggcgccgtgaagagaaagagcagcgagaacaacggcaccctggtgagcaagcaggccaagagctgcagcgaggccagccccagcatgtgccccgtgcagagcgtgcccaccaccgtgttcaaggagatcctgctgggctgcaccgccgccaccccccccagcaaggaccccagacagcagagcaccccccaggccgccaacagcccccccaacctgggcgccaagatcccccagggctgccacaagcagagcctgcccgaggagatcagcagctgcctgaacaccaagagcgaggccctgagaaccaagcccgacgtgtgcaaggccggcctgctgagcaagagcagccagatcggcaccggcgacctgaagatcctgaccgagcccaagggcagctgcacccagcccaagaccaacaccgaccaggagaacagactggagagcgtgccccaggccctgaccggcctgcccaaggagtgcctgcccaccaaggccagcagcaaggccgagctggagatcgccaacccccccgagctgcagaagcacctggagcacgcccccagccccagcgacgtgagcaacgcccccgaggtgaaggccggcgtgaacagcgacagccccaacaactgcagcggcaagaaggtggagcccagcgccctggcctgcagaagccagaacctgaaggagagcagcgtgaaggtggacaacgagagctgctgcagcagaagcaacaacaagatccagaacgcccccagcagaaagagcgtgctgaccgaccccgccaagctgaagaagctgcagcagagcggcgaggccttcgtgcaggacgacagctgcgtgaacatcgtggcccagctgcccaagtgcagagagtgcagactggacagcctgagaaaggacaaggagcagcagaaggacagccccgtgttctgcagattcttccacttcagaagactgcagttcaacaagcacggcgtgctgagagtggagggcttcctgacccccaacaagtacgacaacgaggccatcggcctgtggctgcccctgaccaagaacgtggtgggcatcgacctggacaccgccaagtacatcctggccaacatcggcgaccacttctgccagatggtgatcagcgagaaggaggccatgagcaccatcgagccccacagacaggtggcctggaagagagccgtgaagggcgtgagagagatgtgcgacgtgtgcgacaccaccatcttcaacctgcactgggtgtgccccagatgcggcttcggcgtgtgcgtggactgctacagaatgaagagaaagaactgccagcagggcgccgcctacaagaccttcagctggctgaagtgcgtgaagagccagatccacgagcccgagaacctgatgcccacccagatcatccccggcaaggccctgtacgacgtgggcgacatcgtgcacagcgtgagagccaagtggggcatcaaggccaactgcccctgcagcaacagacagttcaagctgttcagcaagcccgccagcaaggaggacctgaagcagaccagcctggccggcgagaagcccaccctgggcgccgtgctgcagcagaaccccagcgtgctggagcccgccgccgtgggcggcgaggccgccagcaagcccgccggcagcatgaagcccgcctgccccgccagcaccagccccctgaactggctggccgacctgaccagcggcaacgtgaacaaggagaacaaggagaagcagcccaccatgcccatcctgaagaacgagatcaagtgcctgccccccctgccccccctgagcaagagcagcaccgtgctgcacaccttcaacagcaccatcctgacccccgtgagcaacaacaacagcggcttcctgagaaacctgctgaacagcagcaccggcaagaccgagaacggcctgaagaacacccccaagatcctggacgacatcttcgccagcctggtgcagaacaagaccaccagcgacctgagcaagagaccccagggcctgaccatcaagcccagcatcctgggcttcgacaccccccactactggctgtgcgacaacagactgctgtgcctgcaggaccccaacaacaagagcaactggaacgtgttcagagagtgctggaagcagggccagcccgtgatggtgagcggcgtgcaccacaagctgaacagcgagctgtggaagcccgagagcttcagaaaggagttcggcgagcaggaggtggacctggtgaactgcagaaccaacgagatcatcaccggcgccaccgtgggcgacttctgggacggcttcgaggacgtgcccaacagactgaagaacgagaaggagcccatggtgctgaagctgaaggactggccccccggcgaggacttcagagacatgatgcccagcagattcgacgacctgatggccaacatccccctgcccgagtacaccagaagagacggcaagctgaacctggccagcagactgcccaactacttcgtgagacccgacctgggccccaagatgtacaacgcctacggcctgatcacccccgaggacagaaagtacggcaccaccaacctgcacctggacgtgagcgacgccgccaacgtgatggtgtacgtgggcatccccaagggccagtgcgagcaggaggaggaggtgctgaagaccatccaggacggcgacagcgacgagctgaccatcaagagattcatcgagggcaaggagaagcccggcgccctgtggcacatctacgccgccaaggacaccgagaagatcagagagttcctgaagaaggtgagcgaggagcagggccaggagaaccccgccgaccacgaccccatccacgaccagagctggtacctggacagaagcctgagaaagagactgcaccaggagtacggcgtgcagggctgggccatcgtgcagttcctgggcgacgtggtgttcatccccgccggcgccccccaccaggtgcacaacctgtacagctgcatcaaggtggccgaggacttcgtgagccccgagcacgtgaagcactgcttctggctgacccaggagttcagatacctgagccagacccacaccaaccacgaggacaagctgcaggtgaagaacgtgatctaccacgccgtgaaggacgccgtggccatgctgaaggtgaaccccgtgctggccaacctgaacctgcccgcccactggaagtag

SEQ ID NO: 87478 - DNA, 3810 bp, Artificial Sequence
  Description of Artificial Sequence: Synthetic coding sequence
atggtgctgaccctgggcgagagctggcccgtgctggtgggcagaagattcctgagcctgagcgccgccgacggcagcgacggcagccacgacagctgggacgtggagagagtggccgagtggccctggctgagcggcaccatcagagccgtgagccacaccgacgtgaccaagaaggacctgaagacctacaagcccctgctggacaaggccggcctgggcagcatcaccagcgtgagattcctgggcgaccagcagagagtgttcctgagcaaggacctgctgaagcccatccaggacgtgaacagcctgagactgagcctgaccgacaaccagatcgtgagcaaggagttccaggccctgatcgtgaagcacctggacgagagccacctgctgaagggcgacaagaacctggtgggcagcgaggtgaagatctacagcctggaccccagcacccagtggttcagcgccaccgtgatcaacggcaaccccgccagcaagaccctgcaggtgaactgcgaggagatccccgccctgaagatcgtggaccccagcctgatccacgtggaggtggtgcacgacaacctggtgacctgcggcaacagcgccagaatcggcgccgtgaagagaaagagcagcgagaacaacggcaccctggtgagcaagcaggccaagagctgcagcgaggccagccccagcatgtgccccgtgcagagcgtgcccaccaccgtgttcaaggagatcctgctgggctgcaccgccgccaccccccccagcaaggaccccagacagcagagcaccccccaggccgccaacagcccccccaacctgggcgccaagatcccccagggctgccacaagcagagcctgcccgaggagatcagcagctgcctgaacaccaagagcgaggccctgagaaccaagcccgacgtgtgcaaggccggcctgctgagcaagagcagccagatcggcaccggcgacctgaagatcctgaccgagcccaagggcagctgcacccagcccaagaccaacaccgaccaggagaacagactggagagcgtgccccaggccctgaccggcctgcccaaggagtgcctgcccaccaaggccagcagcaaggccgagctggagatcgccaacccccccgagctgcagaagcacctggagcacgcccccagccccagcgacgtgagcaacgcccccgaggtgaaggccggcgtgaacagcgacagccccaacaactgcagcggcaagaaggtggagcccagcgccctggcctgcagaagccagaacctgaaggagagcagcgtgaaggtggacaacgagagctgctgcagcagaagcaacaacaagatccagaacgcccccagcagaaagagcgtgctgaccgaccccgccaagctgaagaagctgcagcagagcggcgaggccttcgtgcaggacgacagctgcgtgaacatcgtggcccagctgcccaagtgcagagagtgcagactggacagcctgagaaaggacaaggagcagcagaaggacagccccgtgttctgcagattcttccacttcagaagactgcagttcaacaagcacggcgtgctgagagtggagggcttcctgacccccaacaagtacgacaacgaggccatcggcctgtggctgcccctgaccaagaacgtggtgggcatcgacctggacaccgccaagtacatcctggccaacatcggcgaccacttctgccagatggtgatcagcgagaaggaggccatgagcaccatcgagccccacagacaggtggcctggaagagagccgtgaagggcgtgagagagatgtgcgacgtgtgcgacaccaccatcttcaacctgcactgggtgtgccccagatgcggcttcggcgtgtgcgtggactgctacagaatgaagagaaagaactgccagcagggcgccgcctacaagaccttcagctggctgaagtgcgtgaagagccagatccacgagcccgagaacctgatgcccacccagatcatccccggcaaggccctgtacgacgtgggcgacatcgtgcacagcgtgagagccaagtggggcatcaaggccaactgcccctgcagcaacagacagttcaagctgttcagcaagcccgccagcaaggaggacctgaagcagaccagcctggccggcgagaagcccaccctgggcgccgtgctgcagcagaaccccagcgtgctggagcccgccgccgtgggcggcgaggccgccagcaagcccgccggcagcatgaagcccgcctgccccgccagcaccagccccctgaactggctggccgacctgaccagcggcaacgtgaacaaggagaacaaggagaagcagcccaccatgcccatcctgaagaacgagatcaagtgcctgccccccctgccccccctgagcaagagcagcaccgtgctgcacaccttcaacagcaccatcctgacccccgtgagcaacaacaacagcggcttcctgagaaacctgctgaacagcagcaccggcaagaccgagaacggcctgaagaacacccccaagatcctggacgacatcttcgccagcctggtgcagaacaagaccaccagcgacctgagcaagagaccccagggcctgaccatcaagcccagcatcctgggcttcgacaccccccactactggctgtgcgacaacagactgctgtgcctgcaggaccccaacaacaagagcaactggaacgtgttcagagagtgctggaagcagggccagcccgtgatggtgagcggcgtgcaccacaagctgaacagcgagctgtggaagcccgagagcttcagaaaggagttcggcgagcaggaggtggacctggtgaactgcagaaccaacgagatcatcaccggcgccaccgtgggcgacttctgggacggcttcgaggacgtgcccaacagactgaagaacgagaaggagcccatggtgctgaagctgaaggactggccccccggcgaggacttcagagacatgatgcccagcagattcgacgacctgatggccaacatccccctgcccgagtacaccagaagagacggcaagctgaacctggccagcagactgcccaactacttcgtgagacccgacctgggccccaagatgtacaacgcctacggcctgatcacccccgaggacagaaagtacggcaccaccaacctgcacctggacgtgagcgacgccgccaacgtgatggtgtacgtgggcatccccaagggccagtgcgagcaggaggaggaggtgctgaagaccatccaggacggcgacagcgacgagctgaccatcaagagattcatcgagggcaaggagaagcccggcgccctgtggcacatctacgccgccaaggacaccgagaagatcagagagttcctgaagaaggtgagcgaggagcagggccaggagaaccccgccgaccacgaccccatccacgaccagagctggtacctggacagaagcctgagaaagagactgcaccaggagtacggcgtgcagggctgggccatcgtgcagttcctgggcgacgtggtgttcatccccgccggcgccccccaccaggtgcacaacctgtacagctgcatcaaggtggccgaggacttcgtgagccccgagcacgtgaagcactgcttctggctgacccaggagttcagatacctgagccagacccacaccaaccacgaggacaagctgcaggtgaagaacgtgatctaccacgccgtgaaggacgccgtggccatgctgaaggccagcgagagcagcttcggcaagccctag

SEQ ID NO: 87479 - DNA, 5286 bp, Artificial Sequence
  Description of Artificial Sequence: Synthetic coding sequence
atggccgacgccgccgccagccccgtgggcaagagactgctgctgctgttcgccgacaccgccgccagcgccagcgccagcgcccccgccgccgccgccgccagcggcgaccccggccccgccctgagaaccagagcctggagagccggcaccgtgagagccatgagcggcgccgtgccccaggacctggccatcttcgtggagttcgacggctgcaactggaagcagcacagctgggtgaaggtgcacgccgaggaggtgatcgtgctgctgctggagggcagcctggtgtgggcccccagagaggaccccgtgctgctgcagggcatcagagtgagcatcgcccagtggcccgccctgaccttcacccccctggtggacaagctgggcctgggcagcgtggtgcccgtggagtacctgctggacagagagctgagattcctgagcgacgccaacggcctgcacctgttccagatgggcaccgacagccagaaccagatcctgctggagcacgccgccctgagagagaccgtgaacgccctgatcagcgaccagaagctgcaggagatcttcagcagaggcccctacagcgtgcagggccacagagtgaagatctaccagcccgagggcgaggagggctggctgtacggcgtggtgagccaccaggacagcatcaccagactgatggaggtgagcgtgaccgagagcggcgagatcaagagcgtggaccccagactgatccacgtgatgctgatggacaacagcgccccccagagcgagggcggcaccctgaaggccgtgaagagcagcaagggcaagaagaagagagagagcatcgagggcaaggacggcagaagaagaaagagcgccagcgacagcggctgcgaccccgccagcaagaagctgaagggcgacagaggcgaggtggacagcaacggcagcgacggcggcgaggccagcagaggcccctggaagggcggcaacgccagcggcgagcccggcctggaccagagagccaagcagccccccagcaccttcgtgccccagatcaacagaaacatcagattcgccacctacaccaaggagaacggcagaaccctggtggtgcaggacgagcccgtgggcggcgacacccccgccagcttcaccccctacagcaccgccaccggccagacccccctggcccccgaggtgggcggcgccgagaacaaggaggccggcaagaccctggagcaggtgggccagggcatcgtggccagcgccgccgtggtgaccaccgccagcagcacccccaacaccgtgagaatcagcgacaccggcctggccgccggcaccgtgcccgagaagcagaagggcagcagaagccaggccagcggcgagaacagcagaaacagcatcctggccagcagcggcttcggcgcccccctgcccagcagcagccagcccctgaccttcggcagcggcagaagccagagcaacggcgtgctggccaccgagaacaagcccctgggcttcagcttcggctgcagcagcgcccaggaggcccagaaggacaccgacctgagcaagaacctgttcttccagtgcatgagccagaccctgcccaccagcaactacttcaccaccgtgagcgagagcctggccgacgacagcagcagcagagacagcttcaagcagagcctggagagcctgagcagcggcctgtgcaagggcagaagcgtgctgggcaccgacaccaagcccggcagcaaggccggcagcagcgtggacagaaaggtgcccgccgagagcatgcccaccctgacccccgccttccccagaagcctgctgaacgccagaacccccgagaaccacgagaacctgttcctgcagccccccaagctgagcagagaggagcccagcaaccccttcctggccttcgtggagaaggtggagcacagccccttcagcagcttcgccagccaggccagcggcagcagcagcagcgccaccaccgtgaccagcaaggtggcccccagctggcccgagagccacagcagcgccgacagcgccagcctggccaagaagaagcccctgttcatcaccaccgacagcagcaagctggtgagcggcgtgctgggcagcgccctgaccagcggcggccccagcctgagcgccatgggcaacggcagaagcagcagccccaccagcagcctgacccagcccatcgagatgcccaccctgagcagcagccccaccgaggagagacccaccgtgggccccggccagcaggacaaccccctgctgaagaccttcagcaacgtgttcggcagacacagcggcggcttcctgagcagccccgccgacttcagccaggagaacaaggcccccttcgaggccgtgaagagattcagcctggacgagagaagcctggcctgcagacaggacagcgacagcagcaccaacagcgacctgagcgacctgagcgacagcgaggagcagctgcaggccaagaccggcctgaagggcatccccgagcacctgatgggcaagctgggccccaacggcgagagaagcgccgagctgctgctgggcaagagcaagggcaagcaggcccccaagggcagacccagaaccgcccccctgaaggtgggccagagcgtgctgaaggacgtgagcaaggtgaagaagctgaagcagagcggcgagcccttcctgcaggacggcagctgcatcaacgtggccccccacctgcacaagtgcagagagtgcagactggagagatacagaaagttcaaggagcaggagcaggacgacagcaccgtggcctgcagattcttccacttcagaagactgatcttcaccagaaagggcgtgctgagagtggagggcttcctgagcccccagcagagcgaccccgacgccatgaacctgtggatccccagcagcagcctggccgagggcatcgacctggagaccagcaagtacatcctggccaacgtgggcgaccagttctgccagctggtgatgagcgagaaggaggccatgatgatggtggagccccaccagaaggtggcctggaagagagccgtgagaggcgtgagagagatgtgcgacgtgtgcgagaccaccctgttcaacatccactgggtgtgcagaaagtgcggcttcggcgtgtgcctggactgctacagactgagaaagagcagacccagaagcgagaccgaggagatgggcgacgaggaggtgttcagctggctgaagtgcgccaagggccagagccacgagcccgagaacctgatgcccacccagatcatccccggcaccgccctgtacaacatcggcgacatggtgcacgccgccagaggcaagtggggcatcaaggccaactgcccctgcatcagcagacagaacaagagcgtgctgagacccgccgtgaccaacggcatgagccagctgcccagcatcaaccccagcgccagcagcggcaacgagaccaccttcagcggcggcggcggccccgcccccgtgaccacccccgagcccgaccacgtgcccaaggccgacagcaccgacatcagaagcgaggagcccctgaagaccgacagcagcgccagcaacagcaacagcgagctgaaggccatcagacccccctgccccgacaccgccccccccagcagcgccctgcactggctggccgacctggccacccagaaggccaaggaggagaccaaggaggccggcagcctgagaagcgtgctgaacaaggagagccacagccccttcggcctggacagcttcaacagcaccgccaaggtgagccccctgacccccaagctgttcaacagcctgctgctgggccccaccgccagcaacaacaagaccgagggcagcagcctgagagacctgctgcacagcggccccggcaagctgccccagacccccctggacaccggcatccccttcccccccgtgttcagcaccagcagcgccggcgtgaagagcaaggccagcctgcccaacttcctggaccacatcatcgccagcgtggtggagaacaagaagaccagcgacgccagcaagagagcctgcaacctgaccgacacccagaaggaggtgaaggagatggtgatgggcctgaacgtgctggacccccacaccagccacagctggctgtgcgacggcagactgctgtgcctgcacgaccccagcaacaagaacaactggaagatcttcagagagtgctggaagcagggccagcccgtgctggtgagcggcgtgcacaagaagctgaagagcgagctgtggaagcccgaggccttcagccaggagttcggcgaccaggacgtggacctggtgaactgcagaaactgcgccatcatcagcgacgtgaaggtgagagacttctgggacggcttcgagatcatctgcaagagactgagaagcgaggacggccagcccatggtgctgaagctgaaggactggccccccggcgaggacttcagagacatgatgcccaccagattcgaggacctgatggagaacctgcccctgcccgagtacaccaagagagacggcagactgaacctggccagcagactgcccagctacttcgtgagacccgacctgggccccaagatgtacaacgcctacggcctgatcaccgccgaggacagaagagtgggcaccaccaacctgcacctggacgtgagcgacgccgtgaacgtgatggtgtacgtgggcatccccatcggcgagggcgcccacgacgaggaggtgctgaagaccatcgacgagggcgacgccgacgaggtgaccaagcagagaatccacgacggcaaggagaagcccggcgccctgtggcacatctacgccgccaaggacgccgagaagatcagagagctgctgagaaaggtgggcgaggagcagggccaggagaacccccccgaccacgaccccatccacgaccagagctggtacctggaccagaccctgagaaagagactgtacgaggagtacggcgtgcagggctgggccatcgtgcagttcctgggcgacgccgtgttcatccccgccggcgccccccaccaggtgcacaacctgtacagctgcatcaaggtggccgaggacttcgtgagccccgagcacgtgaagcactgcttcagactgacccaggagttcagacacctgagcaacacccacaccaaccacgaggacaagctgcaggtgaagaacatcatctaccacgccgtgaaggacgccgtgggcaccctgaaggcccacgagagcaagctggccagaagctag

SEQ ID NO: 87480 - DNA, 4254 bp, Artificial Sequence
  Description of Artificial Sequence: Synthetic coding sequence
atgggcgccatggagatcaacagaaacatcagattcgccacctacaccaaggagaacggcagaaccctggtggtgcaggacgagcccgtgggcggcgacacccccgccagcttcaccccctacagcaccgccaccggccagacccccctggcccccgaggtgggcggcgccgagaacaaggaggccggcaagaccctggagcaggtgggccagggcatcgtggccagcgccgccgtggtgaccaccgccagcagcacccccaacaccgtgagaatcagcgacaccggcctggccgccggcaccgtgcccgagaagcagaagggcagcagaagccaggccagcggcgagaacagcagaaacagcatcctggccagcagcggcttcggcgcccccctgcccagcagcagccagcccctgaccttcggcagcggcagaagccagagcaacggcgtgctggccaccgagaacaagcccctgggcttcagcttcggctgcagcagcgcccaggaggcccagaaggacaccgacctgagcaagaacctgttcttccagtgcatgagccagaccctgcccaccagcaactacttcaccaccgtgagcgagagcctggccgacgacagcagcagcagagacagcttcaagcagagcctggagagcctgagcagcggcctgtgcaagggcagaagcgtgctgggcaccgacaccaagcccggcagcaaggccggcagcagcgtggacagaaaggtgcccgccgagagcatgcccaccctgacccccgccttccccagaagcctgctgaacgccagaacccccgagaaccacgagaacctgttcctgcagccccccaagctgagcagagaggagcccagcaaccccttcctggccttcgtggagaaggtggagcacagccccttcagcagcttcgccagccaggccagcggcagcagcagcagcgccaccaccgtgaccagcaaggtggcccccagctggcccgagagccacagcagcgccgacagcgccagcctggccaagaagaagcccctgttcatcaccaccgacagcagcaagctggtgagcggcgtgctgggcagcgccctgaccagcggcggccccagcctgagcgccatgggcaacggcagaagcagcagccccaccagcagcctgacccagcccatcgagatgcccaccctgagcagcagccccaccgaggagagacccaccgtgggccccggccagcaggacaaccccctgctgaagaccttcagcaacgtgttcggcagacacagcggcggcttcctgagcagccccgccgacttcagccaggagaacaaggcccccttcgaggccgtgaagagattcagcctggacgagagaagcctggcctgcagacaggacagcgacagcagcaccaacagcgacctgagcgacctgagcgacagcgaggagcagctgcaggccaagaccggcctgaagggcatccccgagcacctgatgggcaagctgggccccaacggcgagagaagcgccgagctgctgctgggcaagagcaagggcaagcaggcccccaagggcagacccagaaccgcccccctgaaggtgggccagagcgtgctgaaggacgtgagcaaggtgaagaagctgaagcagagcggcgagcccttcctgcaggacggcagctgcatcaacgtggccccccacctgcacaagtgcagagagtgcagactggagagatacagaaagttcaaggagcaggagcaggacgacagcaccgtggcctgcagattcttccacttcagaagactgatcttcaccagaaagggcgtgctgagagtggagggcttcctgagcccccagcagagcgaccccgacgccatgaacctgtggatccccagcagcagcctggccgagggcatcgacctggagaccagcaagtacatcctggccaacgtgggcgaccagttctgccagctggtgatgagcgagaaggaggccatgatgatggtggagccccaccagaaggtggcctggaagagagccgtgagaggcgtgagagagatgtgcgacgtgtgcgagaccaccctgttcaacatccactgggtgtgcagaaagtgcggcttcggcgtgtgcctggactgctacagactgagaaagagcagacccagaagcgagaccgaggagatgggcgacgaggaggtgttcagctggctgaagtgcgccaagggccagagccacgagcccgagaacctgatgcccacccagatcatccccggcaccgccctgtacaacatcggcgacatggtgcacgccgccagaggcaagtggggcatcaaggccaactgcccctgcatcagcagacagaacaagagcgtgctgagacccgccgtgaccaacggcatgagccagctgcccagcatcaaccccagcgccagcagcggcaacgagaccaccttcagcggcggcggcggccccgcccccgtgaccacccccgagcccgaccacgtgcccaaggccgacagcaccgacatcagaagcgaggagcccctgaagaccgacagcagcgccagcaacagcaacagcgagctgaaggccatcagacccccctgccccgacaccgccccccccagcagcgccctgcactggctggccgacctggccacccagaaggccaaggaggagaccaaggaggccggcagcctgagaagcgtgctgaacaaggagagccacagccccttcggcctggacagcttcaacagcaccgccaaggtgagccccctgacccccaagctgttcaacagcctgctgctgggccccaccgccagcaacaacaagaccgagggcagcagcctgagagacctgctgcacagcggccccggcaagctgccccagacccccctggacaccggcatccccttcccccccgtgttcagcaccagcagcgccggcgtgaagagcaaggccagcctgcccaacttcctggaccacatcatcgccagcgtggtggagaacaagaagaccagcgacgccagcaagagagcctgcaacctgaccgacacccagaaggaggtgaaggagatggtgatgggcctgaacgtgctggacccccacaccagccacagctggctgtgcgacggcagactgctgtgcctgcacgaccccagcaacaagaacaactggaagatcttcagagagtgctggaagcagggccagcccgtgctggtgagcggcgtgcacaagaagctgaagagcgagctgtggaagcccgaggccttcagccaggagttcggcgaccaggacgtggacctggtgaactgcagaaactgcgccatcatcagcgacgtgaaggtgagagacttctgggacggcttcgagatcatctgcaagagactgagaagcgaggacggccagcccatggtgctgaagctgaaggactggccccccggcgaggacttcagagacatgatgcccaccagattcgaggacctgatggagaacctgcccctgcccgagtacaccaagagagacggcagactgaacctggccagcagactgcccagctacttcgtgagacccgacctgggccccaagatgtacaacgcctacggcctgatcaccgccgaggacagaagagtgggcaccaccaacctgcacctggacgtgagcgacgccgtgaacgtgatggtgtacgtgggcatccccatcggcgagggcgcccacgacgaggaggtgctgaagaccatcgacgagggcgacgccgacgaggtgaccaagcagagaatccacgacggcaaggagaagcccggcgccctgtggcacatctacgccgccaaggacgccgagaagatcagagagctgctgagaaaggtgggcgaggagcagggccaggagaacccccccgaccacgaccccatccacgaccagagctggtacctggaccagaccctgagaaagagactgtacgaggagtacggcgtgcagggctgggccatcgtgcagttcctgggcgacgccgtgttcatccccgccggcgccccccaccaggtgcacaacctgtacagctgcatcaaggtggccgaggacttcgtgagccccgagcacgtgaagcactgcttcagactgacccaggagttcagacacctgagcaacacccacaccaaccacgaggacaagctgcaggtgaagaacatcatctaccacgccgtgaaggacgccgtgggcaccctgaaggcccacgagagcaagctggccagaagctag

SEQ ID NO: 87481 - DNA, 2382 bp, Artificial Sequence
  Description of Artificial Sequence: Synthetic coding sequence
atgaacctgtggatccccagcagcagcctggccgagggcatcgacctggagaccagcaagtacatcctggccaacgtgggcgaccagttctgccagctggtgatgagcgagaaggaggccatgatgatggtggagccccaccagaaggtggcctggaagagagccgtgagaggcgtgagagagatgtgcgacgtgtgcgagaccaccctgttcaacatccactgggtgtgcagaaagtgcggcttcggcgtgtgcctggactgctacagactgagaaagagcagacccagaagcgagaccgaggagatgggcgacgaggaggtgttcagctggctgaagtgcgccaagggccagagccacgagcccgagaacctgatgcccacccagatcatccccggcaccgccctgtacaacatcggcgacatggtgcacgccgccagaggcaagtggggcatcaaggccaactgcccctgcatcagcagacagaacaagagcgtgctgagacccgccgtgaccaacggcatgagccagctgcccagcatcaaccccagcgccagcagcggcaacgagaccaccttcagcggcggcggcggccccgcccccgtgaccacccccgagcccgaccacgtgcccaaggccgacagcaccgacatcagaagcgaggagcccctgaagaccgacagcagcgccagcaacagcaacagcgagctgaaggccatcagacccccctgccccgacaccgccccccccagcagcgccctgcactggctggccgacctggccacccagaaggccaaggaggagaccaaggaggccggcagcctgagaagcgtgctgaacaaggagagccacagccccttcggcctggacagcttcaacagcaccgccaaggtgagccccctgacccccaagctgttcaacagcctgctgctgggccccaccgccagcaacaacaagaccgagggcagcagcctgagagacctgctgcacagcggccccggcaagctgccccagacccccctggacaccggcatccccttcccccccgtgttcagcaccagcagcgccggcgtgaagagcaaggccagcctgcccaacttcctggaccacatcatcgccagcgtggtggagaacaagaagaccagcgacgccagcaagagagcctgcaacctgaccgacacccagaaggaggtgaaggagatggtgatgggcctgaacgtgctggacccccacaccagccacagctggctgtgcgacggcagactgctgtgcctgcacgaccccagcaacaagaacaactggaagatcttcagagagtgctggaagcagggccagcccgtgctggtgagcggcgtgcacaagaagctgaagagcgagctgtggaagcccgaggccttcagccaggagttcggcgaccaggacgtggacctggtgaactgcagaaactgcgccatcatcagcgacgtgaaggtgagagacttctgggacggcttcgagatcatctgcaagagactgagaagcgaggacggccagcccatggtgctgaagctgaaggactggccccccggcgaggacttcagagacatgatgcccaccagattcgaggacctgatggagaacctgcccctgcccgagtacaccaagagagacggcagactgaacctggccagcagactgcccagctacttcgtgagacccgacctgggccccaagatgtacaacgcctacggcctgatcaccgccgaggacagaagagtgggcaccaccaacctgcacctggacgtgagcgacgccgtgaacgtgatggtgtacgtgggcatccccatcggcgagggcgcccacgacgaggaggtgctgaagaccatcgacgagggcgacgccgacgaggtgaccaagcagagaatccacgacggcaaggagaagcccggcgccctgtggcacatctacgccgccaaggacgccgagaagatcagagagctgctgagaaaggtgggcgaggagcagggccaggagaacccccccgaccacgaccccatccacgaccagagctggtacctggaccagaccctgagaaagagactgtacgaggagtacggcgtgcagggctgggccatcgtgcagttcctgggcgacgccgtgttcatccccgccggcgccccccaccaggtgcacaacctgtacagctgcatcaaggtggccgaggacttcgtgagccccgagcacgtgaagcactgcttcagactgacccaggagttcagacacctgagcaacacccacaccaaccacgaggacaagctgcaggtgaagaacatcatctaccacgccgtgaaggacgccgtgggcaccctgaaggcccacgagagcaagctggccagaagctag

SEQ ID NO: 87482 - DNA, 4656 bp, Artificial Sequence
  Description of Artificial Sequence: Synthetic coding sequence
ggctggagatggctgtacggcgtggtgagccaccaggacagcatcaccagactgatggaggtgagcgtgaccgagagcggcgagatcaagagcgtggaccccagactgatccacgtgatgctgatggacaacagcgccccccagagcgagggcggcaccctgaaggccgtgaagagcagcaagggcaagaagaagagagagagcatcgagggcaaggacggcagaagaagaaagagcgccagcgacagcggctgcgaccccgccagcaagaagctgaagggcgacagaggcgaggtggacagcaacggcagcgacggcggcgaggccagcagaggcccctggaagggcggcaacgccagcggcgagcccggcctggaccagagagccaagcagccccccagcaccttcgtgccccagatcaacagaaacatcagattcgccacctacaccaaggagaacggcagaaccctggtggtgcaggacgagcccgtgggcggcgacacccccgccagcttcaccccctacagcaccgccaccggccagacccccctggcccccgaggtgggcggcgccgagaacaaggaggccggcaagaccctggagcaggtgggccagggcatcgtggccagcgccgccgtggtgaccaccgccagcagcacccccaacaccgtgagaatcagcgacaccggcctggccgccggcaccgtgcccgagaagcagaagggcagcagaagccaggccagcggcgagaacagcagaaacagcatcctggccagcagcggcttcggcgcccccctgcccagcagcagccagcccctgaccttcggcagcggcagaagccagagcaacggcgtgctggccaccgagaacaagcccctgggcttcagcttcggctgcagcagcgcccaggaggcccagaaggacaccgacctgagcaagaacctgttcttccagtgcatgagccagaccctgcccaccagcaactacttcaccaccgtgagcgagagcctggccgacgacagcagcagcagagacagcttcaagcagagcctggagagcctgagcagcggcctgtgcaagggcagaagcgtgctgggcaccgacaccaagcccggcagcaaggccggcagcagcgtggacagaaaggtgcccgccgagagcatgcccaccctgacccccgccttccccagaagcctgctgaacgccagaacccccgagaaccacgagaacctgttcctgcagccccccaagctgagcagagaggagcccagcaaccccttcctggccttcgtggagaaggtggagcacagccccttcagcagcttcgccagccaggccagcggcagcagcagcagcgccaccaccgtgaccagcaaggtggcccccagctggcccgagagccacagcagcgccgacagcgccagcctggccaagaagaagcccctgttcatcaccaccgacagcagcaagctggtgagcggcgtgctgggcagcgccctgaccagcggcggccccagcctgagcgccatgggcaacggcagaagcagcagccccaccagcagcctgacccagcccatcgagatgcccaccctgagcagcagccccaccgaggagagacccaccgtgggccccggccagcaggacaaccccctgctgaagaccttcagcaacgtgttcggcagacacagcggcggcttcctgagcagccccgccgacttcagccaggagaacaaggcccccttcgaggccgtgaagagattcagcctggacgagagaagcctggcctgcagacaggacagcgacagcagcaccaacagcgacctgagcgacctgagcgacagcgaggagcagctgcaggccaagaccggcctgaagggcatccccgagcacctgatgggcaagctgggccccaacggcgagagaagcgccgagctgctgctgggcaagagcaagggcaagcaggcccccaagggcagacccagaaccgcccccctgaaggtgggccagagcgtgctgaaggacgtgagcaaggtgaagaagctgaagcagagcggcgagcccttcctgcaggacggcagctgcatcaacgtggccccccacctgcacaagtgcagagagtgcagactggagagatacagaaagttcaaggagcaggagcaggacgacagcaccgtggcctgcagattcttccacttcagaagactgatcttcaccagaaagggcgtgctgagagtggagggcttcctgagcccccagcagagcgaccccgacgccatgaacctgtggatccccagcagcagcctggccgagggcatcgacctggagaccagcaagtacatcctggccaacgtgggcgaccagttctgccagctggtgatgagcgagaaggaggccatgatgatggtggagccccaccagaaggtggcctggaagagagccgtgagaggcgtgagagagatgtgcgacgtgtgcgagaccaccctgttcaacatccactgggtgtgcagaaagtgcggcttcggcgtgtgcctggactgctacagactgagaaagagcagacccagaagcgagaccgaggagatgggcgacgaggaggtgttcagctggctgaagtgcgccaagggccagagccacgagcccgagaacctgatgcccacccagatcatccccggcaccgccctgtacaacatcggcgacatggtgcacgccgccagaggcaagtggggcatcaaggccaactgcccctgcatcagcagacagaacaagagcgtgctgagacccgccgtgaccaacggcatgagccagctgcccagcatcaaccccagcgccagcagcggcaacgagaccaccttcagcggcggcggcggccccgcccccgtgaccacccccgagcccgaccacgtgcccaaggccgacagcaccgacatcagaagcgaggagcccctgaagaccgacagcagcgccagcaacagcaacagcgagctgaaggccatcagacccccctgccccgacaccgccccccccagcagcgccctgcactggctggccgacctggccacccagaaggccaaggaggagaccaaggaggccggcagcctgagaagcgtgctgaacaaggagagccacagccccttcggcctggacagcttcaacagcaccgccaaggtgagccccctgacccccaagctgttcaacagcctgctgctgggccccaccgccagcaacaacaagaccgagggcagcagcctgagagacctgctgcacagcggccccggcaagctgccccagacccccctggacaccggcatccccttcccccccgtgttcagcaccagcagcgccggcgtgaagagcaaggccagcctgcccaacttcctggaccacatcatcgccagcgtggtggagaacaagaagaccagcgacgccagcaagagagcctgcaacctgaccgacacccagaaggaggtgaaggagatggtgatgggcctgaacgtgctggacccccacaccagccacagctggctgtgcgacggcagactgctgtgcctgcacgaccccagcaacaagaacaactggaagatcttcagagagtgctggaagcagggccagcccgtgctggtgagcggcgtgcacaagaagctgaagagcgagctgtggaagcccgaggccttcagccaggagttcggcgaccaggacgtggacctggtgaactgcagaaactgcgccatcatcagcgacgtgaaggtgagagacttctgggacggcttcgagatcatctgcaagagactgagaagcgaggacggccagcccatggtgctgaagctgaaggactggccccccggcgaggacttcagagacatgatgcccaccagattcgaggacctgatggagaacctgcccctgcccgagtacaccaagagagacggcagactgaacctggccagcagactgcccagctacttcgtgagacccgacctgggccccaagatgtacaacgcctacggcctgatcaccgccgaggacagaagagtgggcaccaccaacctgcacctggacgtgagcgacgccgtgaacgtgatggtgtacgtgggcatccccatcggcgagggcgcccacgacgaggaggtgctgaagaccatcgacgagggcgacgccgacgaggtgaccaagcagagaatccacgacggcaaggagaagcccggcgccctgtggcacatctacgccgccaaggacgccgagaagatcagagagctgctgagaaaggtgggcgaggagcagggccaggagaacccccccgaccacgaccccatccacgaccagagctggtacctggaccagaccctgagaaagagactgtacgaggagtacggcgtgcagggctgggccatcgtgcagttcctgggcgacgccgtgttcatccccgccggcgccccccaccaggtgcacaacctgtacagctgcatcaaggtggccgaggacttcgtgagccccgagcacgtgaagcactgcttcagactgacccaggagttcagacacctgagcaacacccacaccaaccacgaggacaagctgcaggtgaagaacatcatctaccacgccgtgaaggacgccgtgggcaccctgaaggcccacgagagcaagctggccagaagctag

SEQ ID NO: 87483 - DNA, 2148 bp, Artificial Sequence
  Description of Artificial Sequence: Synthetic coding sequence
atggccggcgtgggccccggcggctacgccgccgagttcgtgcccccccccgagtgccccgtgttcgagcccagctgggaggagttcaccgaccccctgagcttcatcggcagaatcagacccctggccgagaagaccggcatctgcaagatcagaccccccaaggagtacgccctgagcggctggaacctgaacaacatgcccgtgctggagcagagcgtgctggcccacatcaacgtggacatcagcggcatgaaggtgccctggctgtacgtgggcatgtgcttcagcagcttctgctggcacatcgaggaccactggagctacagcatcaactacctgcactggggcgagcccaagacctggtacggcgtgcccagccacgccgccgagcagctggaggaggtgatgagagagctggcccccgagctgttcgagagccagcccgacctgctgcaccagctggtgaccatcatgaaccccaacgtgctgatggagcacggcgtgcccgtgtacagaaccaaccagtgcgccggcgagttcgtggtgaccttccccagagcctaccacagcggcttcaaccagggctacaacttcgccgaggccgtgaacttctgcaccgccgactggctgcccatcggcagacagtgcgtgaaccactacagaagactgagaagacactgcgtgttcagccacgaggagctgatcttcaagatggccgccgaccccgagtgcctggacgtgggcctggccgccatggtgtgcaaggagctgaccctgatgaccgaggaggagaccagactgagagagagcgtggtgcagatgggcgtgctgatgagcgaggaggaggtgttcgagctggtgcccgacgacgagagacagtgcagcgcctgcagaaccacctgcttcctgagcgccctgacctgcagctgcaaccccgagagactggtgtgcctgtaccaccccaccgacctgtgcccctgccccatgcagaagaagtgcctgagatacagataccccctggaggacctgcccagcctgctgtacggcgtgaaggtgagagcccagagctacgacacctgggtgagcagagtgaccgaggccctgagcgccaacttcaaccacaagaaggacctgatcgagctgagagtgatgctggaggacgccgaggacagaaagtaccccgagaacgacctgttcagaaagctgagagacgccgtgaaggaggccgagacctgcgccagcgtggcccagctgctgctgagcaagaagcagaagcacagacagagccccgacagcggcagaaccagaaccaagctgaccgtggaggagctgaaggccttcgtgcagcagctgttcagcctgccctgcgtgatcagccaggccagacaggtgaagaacctgctggacgacgtggaggagttccacgagagagcccaggaggccatgatggacgagacccccgacagcagcaagctgcagatgctgatcgacatgggcagcagcctgtacgtggagctgcccgagctgcccagactgaagcaggagctgcagcaggccagatggctggacgaggtgagactgaccctgagcgacccccagcaggtgaccctggacgtgatgaagaagctgatcgacagcggcgtgggcctggccccccaccacgccgtggagaaggccatggccgagctgcaggagctgctgaccgtgagcgagagatgggaggagaaggccaaggtgtgcctgcaggccagacccagacacagcgtggccagcctggagagcatcgtgaacgaggccaagaacatccccgccttcctgcccaacgtgctgagcctgaaggaggccctgcagaaggccagagagtggaccgccaaggtggaggccatccagagcggcagcaactacgcctacctggagcagctggagagcctgagcgccaagggcagacccatccccgtgagactggaggccctgccccaggtggagagccaggtggccgccgccagagcctggagagagagaaccggcagaaccttcctgaagaagaacagcagccacaccctgctgcaggtgctgagccccagaaccgacatcggcgtgtacggcagcggcaagaacagaagaaagaaggtgaaggagctgtag

SEQ ID NO: 87484 - DNA, 4911 bp, Artificial Sequence
  Description of Artificial Sequence: Synthetic coding sequence
atggccggcgtgggccccggcggctacgccgccgagttcgtgcccccccccgagtgccccgtgttcgagcccagctgggaggagttcaccgaccccctgagcttcatcggcagaatcagacccctggccgagaagaccggcatctgcaagatcagaccccccaaggactggcagccccccttcgcctgcgaggtgaagagcttcagattcacccccagagtgcagagactgaacgagctggaggccatgaccagagtgagactggacttcctggaccagctggccaagttctgggagctgcagggcagcaccctgaagatccccgtggtggagagaaagatcctggacctgtacgccctgagcaagatcgtggccagcaagggcggcttcgagatggtgaccaaggagaagaagtggagcaaggtgggcagcagactgggctacctgcccggcaagggcaccggcagcctgctgaagagccactacgagagaatcctgtacccctacgagctgttccagagcggcgtgagcctgatgggcgtgcagatgcccaacctggacctgaaggagaaggtggagcccgaggtgctgagcaccgacacccagaccagccccgagcccggcaccagaatgaacatcctgcccaagagaaccagaagagtgaagacccagagcgagagcggcgacgtgagcagaaacaccgagctgaagaagctgcagatcttcggcgccggccccaaggtggtgggcctggccatgggcaccaaggacaaggaggacgaggtgaccagaagaagaaaggtgaccaacagaagcgacgccttcaacatgcagatgagacagagaaagggcaccctgagcgtgaacttcgtggacctgtacgtgtgcatgttctgcggcagaggcaacaacgaggacaagctgctgctgtgcgacggctgcgacgacagctaccacaccttctgcctgatcccccccctgcccgacgtgcccaagggcgactggagatgccccaagtgcgtggccgaggagtgcagcaagcccagagaggccttcggcttcgagcaggccgtgagagagtacaccctgcagagcttcggcgagatggccgacaacttcaagagcgactacttcaacatgcccgtgcacatggtgcccaccgagctggtggagaaggagttctggagactggtgagcagcatcgaggaggacgtgatcgtggagtacggcgccgacatcagcagcaaggacttcggcagcggcttccccgtgaaggacggcagaagaaagatcctgcccgaggaggaggagtacgccctgagcggctggaacctgaacaacatgcccgtgctggagcagagcgtgctggcccacatcaacgtggacatcagcggcatgaaggtgccctggctgtacgtgggcatgtgcttcagcagcttctgctggcacatcgaggaccactggagctacagcatcaactacctgcactggggcgagcccaagacctggtacggcgtgcccagccacgccgccgagcagctggaggaggtgatgagagagctggcccccgagctgttcgagagccagcccgacctgctgcaccagctggtgaccatcatgaaccccaacgtgctgatggagcacggcgtgcccgtgtacagaaccaaccagtgcgccggcgagttcgtggtgaccttccccagagcctaccacagcggcttcaaccagggctacaacttcgccgaggccgtgaacttctgcaccgccgactggctgcccatcggcagacagtgcgtgaaccactacagaagactgagaagacactgcgtgttcagccacgaggagctgatcttcaagatggccgccgaccccgagtgcctggacgtgggcctggccgccatggtgtgcaaggagctgaccctgatgaccgaggaggagaccagactgagagagagcgtggtgcagatgggcgtgctgatgagcgaggaggaggtgttcgagctggtgcccgacgacgagagacagtgcagcgcctgcagaaccacctgcttcctgagcgccctgacctgcagctgcaaccccgagagactggtgtgcctgtaccaccccaccgacctgtgcccctgccccatgcagaagaagtgcctgagatacagataccccctggaggacctgcccagcctgctgtacggcgtgaaggtgagagcccagagctacgacacctgggtgagcagagtgaccgaggccctgagcgccaacttcaaccacaagaaggacctgatcgagctgagagtgatgctggaggacgccgaggacagaaagtaccccgagaacgacctgttcagaaagctgagagacgccgtgaaggaggccgagacctgcgccagcgtggcccagctgctgctgagcaagaagcagaagcacagacagagccccgacagcggcagaaccagaaccaagctgaccgtggaggagctgaaggccttcgtgcagcagctgttcagcctgccctgcgtgatcagccaggccagacaggtgaagaacctgctggacgacgtggaggagttccacgagagagcccaggaggccatgatggacgagacccccgacagcagcaagctgcagatgctgatcgacatgggcagcagcctgtacgtggagctgcccgagctgcccagactgaagcaggagctgcagcaggccagatggctggacgaggtgagactgaccctgagcgacccccagcaggtgaccctggacgtgatgaagaagctgatcgacagcggcgtgggcctggccccccaccacgccgtggagaaggccatggccgagctgcaggagctgctgaccgtgagcgagagatgggaggagaaggccaaggtgtgcctgcaggccagacccagacacagcgtggccagcctggagagcatcgtgaacgaggccaagaacatccccgccttcctgcccaacgtgctgagcctgaaggaggccctgcagaaggccagagagtggaccgccaaggtggaggccatccagagcggcagcaactacgcctacctggagcagctggagagcctgagcgccaagggcagacccatccccgtgagactggaggccctgccccaggtggagagccaggtggccgccgccagagcctggagagagagaaccggcagaaccttcctgaagaagaacagcagccacaccctgctgcaggtgctgagccccagaaccgacatcggcgtgtacggcagcggcaagaacagaagaaagaaggtgaaggagctgatcgagaaggagaaggagaaggacctggacctggagcccctgagcgacctggaggagggcctggaggagaccagagacaccgccatggtggtggccgtgttcaaggagagagagcagaaggagatcgaggccatgcacagcctgagagccgccaacctggccaagatgaccatggtggacagaatcgaggaggtgaagttctgcatctgcagaaagaccgccagcggcttcatgctgcagtgcgagctgtgcaaggactggttccacaacagctgcgtgcccctgcccaagagcagcagccagaagaagggcagcagctggcaggccaaggaggtgaagttcctgtgccccctgtgcatgagaagcagaagacccagactggagaccatcctgagcctgctggtgagcctgcagaagctgcccgtgagactgcccgagggcgaggccctgcagtgcctgaccgagagagccatgagctggcaggacagagccagacaggccctggccaccgacgagctgagcagcgccctggccaagctgagcgtgctgagccagagaatggtggagcaggccgccagagagaagaccgagaagatcatcagcgccgagctgcagaaggccgccgccaaccccgacctgcagggccacctgcccagcttccagcagagcgccttcaacagagtggtgagcagcgtgagcagcagccccagacagaccatggactacgacgacgaggagaccgacagcgacgaggacatcagagagacctacggctacgacatgaaggacaccgccagcgtgaagagcagcagcagcctggagcccaacctgttctgcgacgaggagatccccatcaagagcgaggaggtggtgacccacatgtggaccgcccccagcttctgcgccgagcacgcctacagcagcgccagcaagagctgcagccagggcagcagcacccccagaaagcagcccagaaagagccccctggtgcccagaagcctggagccccccgtgctggagctgagccccggcgccaaggcccagctggaggagctgatgatggtgggcgacctgctggaggtgagcctggacgagacccagcacatctggagaatcctgcaggccacccacccccccagcgaggacagattcctgcacatcatggaggacgacagcatggaggagaagcccctgaaggtgaagggcaaggacagcagcgagaagaagagaaagagaaagctggagaaggtggagcagctgttcggcgagggcaagcagaagagcaaggagctgaagaagatggacaagcccagaaagaagaagctgaagctgggcgccgacaagagcaaggagctgaacaagctggccaagaagctggccaaggaggaggagagaaagaagaagaaggagaaggccgccgccgccaaggtggagctggtgaaggagagcaccgagaagaagagagagaagaaggtgctggacatccccagcaagtacgactggagcggcgccgaggagagcgacgacgagaacgccgtgtgcgccgcccagaactgccagagaccctgcaaggacaagggcgtggtgttcgtgaccgaggaggagaagaacaagaagtactag

SEQ ID NO: 87485 - DNA, 3150 bp, Artificial Sequence
  Description of Artificial Sequence: Synthetic coding sequence
atggccggcgtgggccccggcggctacgccgccgagttcgtgcccccccccgagtgccccgtgttcgagcccagctgggaggagttcaccgaccccctgagcttcatcggcagaatcagacccctggccgagaagaccggcatctgcaagatcagaccccccaaggactggcagccccccttcgcctgcgaggtgaagagcttcagattcacccccagagtgcagagactgaacgagctggagatcgtggccagcaagggcggcttcgagatggtgaccaaggagaagaagtggagcaaggtgggcagcagactgggctacctgcccggcaagggcaccggcagcctgctgaagagccactacgagagaatcctgtacccctacgagctgttccagagcggcgtgagcctgatgggcgtgcagatgcccaacctggacctgaaggagaaggtggagcccgaggtgctgagcaccgacacccagaccagccccgagcccggcaccagaatgaacatcctgcccaagagaaccagaagagtgaagacccagagcgagagcggcgacgtgagcagaaacaccgagctgaagaagctgcagatcttcggcgccggccccaaggtggtgggcctggccatgggcaccaaggacaaggaggacgaggtgaccagaagaagaaaggtgaccaacagaagcgacgccttcaacatgcagatgagacagagaaagggcaccctgagcgtgaacttcgtggacctgtacgtgtgcatgttctgcggcagaggcaacaacgaggacaagctgctgctgtgcgacggctgcgacgacagctaccacaccttctgcctgatcccccccctgcccgacgtgcccaagggcgactggagatgccccaagtgcgtggccgaggagtgcagcaagcccagagaggccttcggcttcgagcaggccgtgagagagtacaccctgcagagcttcggcgagatggccgacaacttcaagagcgactacttcaacatgcccgtgcacatggtgcccaccgagctggtggagaaggagttctggagactggtgagcagcatcgaggaggacgtgatcgtggagtacggcgccgacatcagcagcaaggacttcggcagcggcttccccgtgaaggacggcagaagaaagatcctgcccgaggaggaggagtacgccctgagcggctggaacctgaacaacatgcccgtgctggagcagagcgtgctggcccacatcaacgtggacatcagcggcatgaaggtgccctggctgtacgtgggcatgtgcttcagcagcttctgctggcacatcgaggaccactggagctacagcatcaactacctgcactggggcgagcccaagacctggtacggcgtgcccagccacgccgccgagcagctggaggaggtgatgagagagctggcccccgagctgttcgagagccagcccgacctgctgcaccagctggtgaccatcatgaaccccaacgtgctgatggagcacggcgtgcccgtgtacagaaccaaccagtgcgccggcgagttcgtggtgaccttccccagagcctaccacagcggcttcaaccagggctacaacttcgccgaggccgtgaacttctgcaccgccgactggctgcccatcggcagacagtgcgtgaaccactacagaagactgagaagacactgcgtgttcagccacgaggagctgatcttcaagatggccgccgaccccgagtgcctggacgtgggcctggccgccatggtgtgcaaggagctgaccctgatgaccgaggaggagaccagactgagagagagcgtggtgcagatgggcgtgctgatgagcgaggaggaggtgttcgagctggtgcccgacgacgagagacagtgcagcgcctgcagaaccacctgcttcctgagcgccctgacctgcagctgcaaccccgagagactggtgtgcctgtaccaccccaccgacctgtgcccctgccccatgcagaagaagtgcctgagatacagataccccctggaggacctgcccagcctgctgtacggcgtgaaggtgagagcccagagctacgacacctgggtgagcagagtgaccgaggccctgagcgccaacttcaaccacaagaaggacctgatcgagctgagagtgatgctggaggacgccgaggacagaaagtaccccgagaacgacctgttcagaaagctgagagacgccgtgaaggaggccgagacctgcgccagcgtggcccagctgctgctgagcaagaagcagaagcacagacagagccccgacagcggcagaaccagaaccaagctgaccgtggaggagctgaaggccttcgtgcagcagctgttcagcctgccctgcgtgatcagccaggccagacaggtgaagaacctgctggacgacgtggaggagttccacgagagagcccaggaggccatgatggacgagacccccgacagcagcaagctgcagatgctgatcgacatgggcagcagcctgtacgtggagctgcccgagctgcccagactgaagcaggagctgcagcaggccagatggctggacgaggtgagactgaccctgagcgacccccagcaggtgaccctggacgtgatgaagaagctgatcgacagcggcgtgggcctggccccccaccacgccgtggagaaggccatggccgagctgcaggagctgctgaccgtgagcgagagatgggaggagaaggccaaggtgtgcctgcaggccagacccagacacagcgtggccagcctggagagcatcgtgaacgaggccaagaacatccccgccttcctgcccaacgtgctgagcctgaaggaggccctgcagaaggccagagagtggaccgccaaggtggaggccatccagagcggcagcaactacgcctacctggagcagctggagagcctgagcgccaagggcagacccatccccgtgagactggaggccctgccccaggtggagagccaggtggccgccgccagagcctggagagagagaaccggcagaaccttcctgaagaagaacagcagccacaccctgctgcaggtgctgagccccagaaccgacatcggcgtgtacggcagcggcaagaacagaagatag

SEQ ID NO: 87486 - DNA, 5073 bp, Artificial Sequence
  Description of Artificial Sequence: Synthetic coding sequence
atggccggcgtgggccccggcggctacgccgccgagttcgtgcccccccccgagtgccccgtgttcgagcccagctgggaggagttcaccgaccccctgagcttcatcggcagaatcagacccctggccgagaagaccggcatctgcaagatcagaccccccaaggactggcagccccccttcgcctgcgaggtgaagagcttcagattcacccccagagtgcagagactgaacgagctggaggccatgaccagagtgagactggacttcctggaccagctggccaagttctgggagctgcagggcagcaccctgaagatccccgtggtggagagaaagatcctggacctgtacgccctgagcaagatcgtggccagcaagggcggcttcgagatggtgaccaaggagaagaagtggagcaaggtgggcagcagactgggctacctgcccggcaagggcaccggcagcctgctgaagagccactacgagagaatcctgtacccctacgagctgttccagagcggcgtgagcctgatgggcgtgcagatgcccaacctggacctgaaggagaaggtggagcccgaggtgctgagcaccgacacccagaccagccccgagcccggcaccagaatgaacatcctgcccaagagaaccagaagagtgaagacccagagcgagagcggcgacgtgagcagaaacaccgagctgaagaagctgcagatcttcggcgccggccccaaggtggtgggcctggccatgggcaccaaggacaaggaggacgaggtgaccagaagaagaaaggtgaccaacagaagcgacgccttcaacatgcagatgagacagagaaagggcaccctgagcgtgaacttcgtggacctgtacgtgtgcatgttctgcggcagaggcaacaacgaggacaagctgctgctgtgcgacggctgcgacgacagctaccacaccttctgcctgatcccccccctgcccgacgtgcccaagggcgactggagatgccccaagtgcgtggccgaggagtgcagcaagcccagagaggccttcggcttcgagcaggccgtgagagagtacaccctgcagagcttcggcgagatggccgacaacttcaagagcgactacttcaacatgcccgtgcacatggtgcccaccgagctggtggagaaggagttctggagactggtgagcagcatcgaggaggacgtgatcgtggagtacggcgccgacatcagcagcaaggacttcggcagcggcttccccgtgaaggacggcagaagaaagatcctgcccgaggaggaggagtacgccctgagcggctggaacctgaacaacatgcccgtgctggagcagagcgtgctggcccacatcaacgtggacatcagcggcatgaaggtgccctggctgtacgtgggcatgtgcttcagcagcttctgctggcacatcgaggaccactggagctacagcatcaactacctgcactggggcgagcccaagacctggtacggcgtgcccagccacgccgccgagcagctggaggaggtgatgagagagctggcccccgagctgttcgagagccagcccgacctgctgcaccagctggtgaccatcatgaaccccaacgtgctgatggagcacggcgtgcccgtgtacagaaccaaccagtgcgccggcgagttcgtggtgaccttccccagagcctaccacagcggcttcaaccagggctacaacttcgccgaggccgtgaacttctgcaccgccgactggctgcccatcggcagacagtgcgtgaaccactacagaagactgagaagacactgcgtgttcagccacgaggagctgatcttcaagatggccgccgaccccgagtgcctggacgtgggcctggccgccatggtgtgcaaggagctgaccctgatgaccgaggaggagaccagactgagagagagcgtggtgcagatgggcgtgctgatgagcgaggaggaggtgttcgagctggtgcccgacgacgagagacagtgcagcgcctgcagaaccacctgcttcctgagcgccctgacctgcagctgcaaccccgagagactggtgtgcctgtaccaccccaccgacctgtgcccctgccccatgcagaagaagtgcctgagatacagataccccctggaggacctgcccagcctgctgtacggcgtgaaggtgagagcccagagctacgacacctgggtgagcagagtgaccgaggccctgagcgccaacttcaaccacaagaaggacctgatcgagctgagagtgatgctggaggacgccgaggacagaaagtaccccgagaacgacctgttcagaaagctgagagacgccgtgaaggaggccgagacctgcgccagcgtggcccagctgctgctgagcaagaagcagaagcacagacagagccccgacagcggcagaaccagaaccaagctgaccgtggaggagctgaaggccttcgtgcagcagctgttcagcctgccctgcgtgatcagccaggccagacaggtgaagaacctgctggacgacgtggaggagttccacgagagagcccaggaggccatgatggacgagacccccgacagcagcaagctgcagatgctgatcgacatgggcagcagcctgtacgtggagctgcccgagctgcccagactgaagcaggagctgcagcaggccagatggctggacgaggtgagactgaccctgagcgacccccagcaggtgaccctggacgtgatgaagaagctgatcgacagcggcgtgggcctggccccccaccacgccgtggagaaggccatggccgagctgcaggagctgctgaccgtgagcgagagatgggaggagaaggccaaggtgtgcctgcaggccagacccagacacagcgtggccagcctggagagcatcgtgaacgaggccaagaacatccccgccttcctgcccaacgtgctgagcctgaaggaggccctgcagaaggccagagagtggaccgccaaggtggaggccatccagagcggcagcaactacgcctacctggagcagctggagagcctgagcgccaagggcagacccatccccgtgagactggaggccctgccccaggtggagagccaggtggccgccgccagagcctggagagagagaaccggcagaaccttcctgaagaagaacagcagccacaccctgctgcaggtgctgagccccagaaccgacatcggcgtgtacggcagcggcaagaacagaagaaagaaggtgaaggagctgatcgagaaggagaaggagaaggacctggacctggagcccctgagcgacctggaggagggcctggaggagaccagagacaccgccatggtggtggccgtgttcaaggagagagagcagaaggagatcgaggccatgcacagcctgagagccgccaacctggccaagatgaccatggtggacagaatcgaggaggtgaagttctgcatctgcagaaagaccgccagcggcttcatgctgcagtgcgagctgtgcaaggactggttccacaacagctgcgtgcccctgcccaagagcagcagccagaagaagggcagcagctggcaggccaaggaggtgaagttcctgtgccccctgtgcatgagaagcagaagacccagactggagaccatcctgagcctgctggtgagcctgcagaagctgcccgtgagactgcccgagggcgaggccctgcagtgcctgaccgagagagccatgagctggcaggacagagccagacaggccctggccaccgacgagctgagcagcgccctggccaagctgagcgtgctgagccagagaatggtggagcaggccgccagagagaagaccgagaagatcatcagcgccgagctgcagaaggccgccgccaaccccgacctgcagggccacctgcccagcttccagcagagcgccttcaacagagtggtgagcagcgtgagcagcagccccagacagaccatggactacgacgacgaggagaccgacagcgacgaggacatcagagagacctacggctacgacatgaaggacaccgccagcgtgaagagcagcagcagcctggagcccaacctgttctgcgacgaggagatccccatcaagagcgaggaggtggtgacccacatgtggaccgcccccagcttctgcgccgagcacgcctacagcagcgccagcaagagctgcagccagggcagcagcacccccagaaagcagcccagaaagagccccctggtgcccagaagcctggagccccccgtgctggagctgagccccggcgccaaggcccagctggaggagctgatgatggtgggcgacctgctggaggtgagcctggacgagacccagcacatctggagaatcctgcaggccacccacccccccagcgaggacagattcctgcacatcatggaggacgacagcatggaggagaagcccctgaaggtgaagggcaaggacagcagcgagaagaagagaaagagaaagctggagaaggtggagcagctgttcggcgagggcaagcagaagagcaaggagctgaagaagatggacaagcccagaaagaagaagctgaagctgggcgccgacaagagcaaggagctgaacaagctggccaagaagctggccaaggaggaggagagaaagaagaagaaggagaaggccgccgccgccaaggtggagctggtgaaggagagcaccgagaagaagagagagaagaaggtgctggacatccccagcaagtacgactggagcggcgccgaggagagcgacgacgagaacgccgtgtgcgccgcccagaactgccagagaccctgcaaggacaaggtggactgggtgcagtgcgacggcggctgcgacgagtggttccaccaggtgtgcgtgggcgtgagccccgagatggccgagaacgaggactacatctgcatcaactgcgccaagaagcagggccccgtgagccccggccccgcccccccccccagcttcatcatgagctacaagctgcccatggaggacctgaaggagaccagctag

SEQ ID NO: 87487 - DNA, 3828 bp, Artificial Sequence
  Description of Artificial Sequence: Synthetic coding sequence
atgggcttcgcccccggcaaggccgtgggcagccacatcagaggccactacgagagaatcctgaacccctacaacctgttcctgagcggcgacagcctgagatgcctgcagaagcccaacctgaccaccgacaccaaggacaaggagtacaagccccacgacatcccccagagacagagcgtgcagcccagcgagacctgcccccccgccagaagagccaagagaatgagagccgaggccatgaacatcaagatcgagcccgaggagaccaccgaggccagaacccacaacctgagaagaagaatgggctgccccacccccaagtgcgagaacgagaaggagatgaagagcagcatcaagcaggagcccatcgagagaaaggactacatcgtggagaacgagaaggagaagcccaagagcagaagcaagaaggccaccaacgccgtggacctgtacgtgtgcctgctgtgcggcagcggcaacgacgaggacagactgctgctgtgcgacggctgcgacgacagctaccacaccttctgcctgatcccccccctgcacgacgtgcccaagggcgactggagatgccccaagtgcctggcccaggagtgcagcaagccccaggaggccttcggcttcgagcaggccgccagagactacaccctgagaaccttcggcgagatggccgacgccttcaagagcgactacttcaacatgcccgtgcacatggtgcccaccgagctggtggagaaggagttctggagactggtgagcaccatcgaggaggacgtgaccgtggagtacggcgccgacatcgccagcaaggagttcggcagcggcttccccgtgagagacggcaagatcaagctgagccccgaggaggaggagtacctggacagcggctggaacctgaacaacatgcccgtgatggagcagagcgtgctggcccacatcaccgccgacatctgcggcatgaagctgccctggctgtacgtgggcatgtgcttcagcagcttctgctggcacatcgaggaccactggagctacagcatcaactacctgcactggggcgagcccaagacctggtacggcgtgcccggctacgccgccgagcagctggagaacgtgatgaagaagctggcccccgagctgttcgtgagccagcccgacctgctgcaccagctggtgaccatcatgaaccccaacaccctgatgacccacgaggtgcccgtgtacagaaccaaccagtgcgccggcgagttcgtgatcaccttccccagagcctaccacagcggcttcaaccagggcttcaacttcgccgaggccgtgaacttctgcaccgtggactggctgcccctgggcagacagtgcgtggagcactacagactgctgcacagatactgcgtgttcagccacgacgagatgatctgcaagatggccagcaaggccgacgtgctggacgtggtggtggccagcaccgtgcagaaggacatggccatcatgatcgaggacgagaaggccctgagagagaccgtgagaaagctgggcgtgatcgacagcgagagaatggacttcgagctgctgcccgacgacgagagacagtgcgtgaagtgcaagaccacctgcttcatgagcgccatcagctgcagctgcaagcccggcctgctggtgtgcctgcaccacgtgaaggagctgtgcagctgccccccctacaagtacaagctgagatacagatacaccctggacgacctgtaccccatgatgaacgccctgaagctgagagccgagagctacaacgagtgggccctgaacgtgaacgaggccctggaggccaagatcaacaagaagaagagcctggtgagcttcaaggccctgatcgaggagagcgagatgaagaagttccccgacaacgacctgctgagacacctgagactggtgacccaggacgccgagaagtgcgccagcgtggcccagcagctgctgaacggcaagagacagaccagatacagaagcggcggcggcaagagccagaaccagctgaccgtgaacgagctgagacagttcgtgacccagctgtacgccctgccctgcgtgctgagccagacccccctgctgaaggacctgctgaacagagtggaggacttccagcagcacagccagaagctgctgagcgaggagacccccagcgccgccgagctgcaggacctgctggacgtgagcttcgagttcgacgtggagctgccccagctggccgagatgagaatcagactggagcaggccagatggctggaggaggtgcagcaggcctgcctggaccccagcagcctgaccctggacgacatgagaagactgatcgacctgggcgtgggcctggccccctacagcgccgtggagaaggccatggccagactgcaggagctgctgaccgtgagcgagcactgggacgacaaggccaagagcctgctgaaggccagacccagacacagcctgaacagcctggccaccgccgtgaaggagatcgaggagatccccgcctacctgcccaacggcgccgccctgaaggacagcgtgcagagagccagagactggctgcaggacgtggagggcctgcaggccggcggcagagtgcccgtgctggacaccctgatcgagctggtgaccagaggcagaagcatccccgtgcacctgaacagcctgcccagactggagaccctggtggccgaggtgcaggcctggaaggagtgcgccgtgaacaccttcctgaccgagaacagcccctacagcctgctggaggtgctgtgccccagatgcgacatcggcctgctgggcctgaagagaaagcagagaaagctgaaggagcccctgcccaacggcaagaagaagagcaccaagctggagagcctgagcgacctggagagagccctgaccgagagcaaggagaccgccagcgccatggccaccctgggcgaggccagactgagagagatggaggccctgcagagcctgagactggccaacgagggcaagctgctgagccccctgcaggacgtggacatcaagatctgcctgtgccagaaggcccccgccgcccccatgatccagtgcgagctgtgcagagacgccttccacaccagctgcgtggccgtgcccagcatcagccagggcctgagaatctggctgtgcccccactgcagaagaagcgagaagccccccctggagaagatcctgcccctgctggccagcctgcagagaatcagagtgagactgcccgagggcgacgccctgagatacatgatcgagagaaccgtgaactggcagcacagagcccagcagctgctgagcagcggcaacctgaagttcgtgcaggacagagtgggcagcggcctgctgtacagcagatggcaggccagcgccggccaggtgagcgacaccaacaaggtgagccagccccccggcaccaccagcttcagcctgcccgacgactgggacaacagaaccagctacctgcacagccccttcagcaccggcagaagctgcatccccctgcacggcgtgagccccgaggtgaacgagctgctgatggaggcccagctgctgcaggtgagcctgcccgagatccaggagctgtaccagaccctgctggccaagcccagccccgcccagcagaccgacagaagcagccccgtgagacccagcagcgagaagaacgactgctgcagaggcaagagagacggcatcaacagcctggagagaaagctgaagagaagactggagagagagggcctgagcagcgagagatgggagagagtgaagaagatgagaaccccctag

SEQ ID NO: 87488 - DNA, 4743 bp, Artificial Sequence
  Description of Artificial Sequence: Synthetic coding sequence
atggaggccgccaccaccctgcaccccggccccagacccgccctgcccctgggcggccccggccccctgggcgagttcctgcccccccccgagtgccccgtgttcgagcccagctgggaggagttcgccgaccccttcgccttcatccacaagatcagacccatcgccgagcagaccggcatctgcaaggtgagacccccccccgactggcagccccccttcgcctgcgacgtggacaagctgcacttcacccccagaatccagagactgaacgagctggaggcccagaccagagtgaagctgaacttcctggaccagatcgccaagtactgggagctgcagggcagcaccctgaagatcccccacgtggagagaaagatcctggacctgttccagctgaacaagctggtggccgaggagggcggcttcgccgtggtgtgcaaggacagaaagtggaccaagatcgccaccaagatgggcttcgcccccggcaaggccgtgggcagccacatcagaggccactacgagagaatcctgaacccctacaacctgttcctgagcggcgacagcctgagatgcctgcagaagcccaacctgaccaccgacaccaaggacaaggagtacaagccccacgacatcccccagagacagagcgtgcagcccagcgagacctgcccccccgccagaagagccaagagaatgagagccgagagacagagcctggccgtgctgcccagactggagtgcagcggcgccatcctggcccactgcaacctgagactgctggacagcagcaacagcagcgccagcgccagccaggccatgaacatcaagatcgagcccgaggagaccaccgaggccagaacccacaacctgagaagaagaatgggctgccccacccccaagtgcgagaacgagaaggagatgaagagcagcatcaagcaggagcccatcgagagaaaggactacatcgtggagaacgagaaggagaagcccaagagcagaagcaagaaggccaccaacgccgtggacctgtacgtgtgcctgctgtgcggcagcggcaacgacgaggacagactgctgctgtgcgacggctgcgacgacagctaccacaccttctgcctgatcccccccctgcacgacgtgcccaagggcgactggagatgccccaagtgcctggcccaggagtgcagcaagccccaggaggccttcggcttcgagcaggccgccagagactacaccctgagaaccttcggcgagatggccgacgccttcaagagcgactacttcaacatgcccgtgcacatggtgcccaccgagctggtggagaaggagttctggagactggtgagcaccatcgaggaggacgtgaccgtggagtacggcgccgacatcgccagcaaggagttcggcagcggcttccccgtgagagacggcaagatcaagctgagccccgaggaggaggagtacctggacagcggctggaacctgaacaacatgcccgtgatggagcagagcgtgctggcccacatcaccgccgacatctgcggcatgaagctgccctggctgtacgtgggcatgtgcttcagcagcttctgctggcacatcgaggaccactggagctacagcatcaactacctgcactggggcgagcccaagacctggtacggcgtgcccggctacgccgccgagcagctggagaacgtgatgaagaagctggcccccgagctgttcgtgagccagcccgacctgctgcaccagctggtgaccatcatgaaccccaacaccctgatgacccacgaggtgcccgtgtacagaaccaaccagtgcgccggcgagttcgtgatcaccttccccagagcctaccacagcggcttcaaccagggcttcaacttcgccgaggccgtgaacttctgcaccgtggactggctgcccctgggcagacagtgcgtggagcactacagactgctgcacagatactgcgtgttcagccacgacgagatgatctgcaagatggccagcaaggccgacgtgctggacgtggtggtggccagcaccgtgcagaaggacatggccatcatgatcgaggacgagaaggccctgagagagaccgtgagaaagctgggcgtgatcgacagcgagagaatggacttcgagctgctgcccgacgacgagagacagtgcgtgaagtgcaagaccacctgcttcatgagcgccatcagctgcagctgcaagcccggcctgctggtgtgcctgcaccacgtgaaggagctgtgcagctgccccccctacaagtacaagctgagatacagatacaccctggacgacctgtaccccatgatgaacgccctgaagctgagagccgagagctacaacgagtgggccctgaacgtgaacgaggccctggaggccaagatcaacaagaagaagagcctggtgagcttcaaggccctgatcgaggagagcgagatgaagaagttccccgacaacgacctgctgagacacctgagactggtgacccaggacgccgagaagtgcgccagcgtggcccagcagctgctgaacggcaagagacagaccagatacagaagcggcggcggcaagagccagaaccagctgaccgtgaacgagctgagacagttcgtgacccagctgtacgccctgccctgcgtgctgagccagacccccctgctgaaggacctgctgaacagagtggaggacttccagcagcacagccagaagctgctgagcgaggagacccccagcgccgccgagctgcaggacctgctggacgtgagcttcgagttcgacgtggagctgccccagctggccgagatgagaatcagactggagcaggccagatggctggaggaggtgcagcaggcctgcctggaccccagcagcctgaccctggacgacatgagaagactgatcgacctgggcgtgggcctggccccctacagcgccgtggagaaggccatggccagactgcaggagctgctgaccgtgagcgagcactgggacgacaaggccaagagcctgctgaaggccagacccagacacagcctgaacagcctggccaccgccgtgaaggagatcgaggagatccccgcctacctgcccaacggcgccgccctgaaggacagcgtgcagagagccagagactggctgcaggacgtggagggcctgcaggccggcggcagagtgcccgtgctggacaccctgatcgagctggtgaccagaggcagaagcatccccgtgcacctgaacagcctgcccagactggagaccctggtggccgaggtgcaggcctggaaggagtgcgccgtgaacaccttcctgaccgagaacagcccctacagcctgctggaggtgctgtgccccagatgcgacatcggcctgctgggcctgaagagaaagcagagaaagctgaaggagcccctgcccaacggcaagaagaagagcaccaagctggagagcctgagcgacctggagagagccctgaccgagagcaaggagaccgccagcgccatggccaccctgggcgaggccagactgagagagatggaggccctgcagagcctgagactggccaacgagggcaagctgctgagccccctgcaggacgtggacatcaagatctgcctgtgccagaaggcccccgccgcccccatgatccagtgcgagctgtgcagagacgccttccacaccagctgcgtggccgtgcccagcatcagccagggcctgagaatctggctgtgcccccactgcagaagaagcgagaagccccccctggagaagatcctgcccctgctggccagcctgcagagaatcagagtgagactgcccgagggcgacgccctgagatacatgatcgagagaaccgtgaactggcagcacagagcccagcagctgctgagcagcggcaacctgaagttcgtgcaggacagagtgggcagcggcctgctgtacagcagatggcaggccagcgccggccaggtgagcgacaccaacaaggtgagccagccccccggcaccaccagcttcagcctgcccgacgactgggacaacagaaccagctacctgcacagccccttcagcaccggcagaagctgcatccccctgcacggcgtgagccccgaggtgaacgagctgctgatggaggcccagctgctgcaggtgagcctgcccgagatccaggagctgtaccagaccctgctggccaagcccagccccgcccagcagaccgacagaagcagccccgtgagacccagcagcgagaagaacgactgctgcagaggcaagagagacggcatcaacagcctggagagaaagctgaagagaagactggagagagagggcctgagcagcgagagatgggagagagtgaagaagatgagaacccccaagaagaagaagatcaagctgagccaccccaaggacatgaacaacttcaagctggagagagagagaagctacgagctggtgagaagcgccgagacccacagcctgcccagcgacaccagctacagcgagcaggaggacagcgaggacgaggacgccatctgccccgccgtgagctgcctgcagcccgagggcgacgaggtggactgggtgcagtgcgacggcagctgcaaccagtggttccaccaggtgtgcgtgggcgtgagccccgagatggccgagaaggaggactacatctgcgtgagatgcaccgtgaaggacgcccccagcagaaagtag

SEQ ID NO: 87489 - DNA, 4635 bp, Artificial Sequence
  Description of Artificial Sequence: Synthetic coding sequence
atggaggccgccaccaccctgcaccccggccccagacccgccctgcccctgggcggccccggccccctgggcgagttcctgcccccccccgagtgccccgtgttcgagcccagctgggaggagttcgccgaccccttcgccttcatccacaagatcagacccatcgccgagcagaccggcatctgcaaggtgagacccccccccgactggcagccccccttcgcctgcgacgtggacaagctgcacttcacccccagaatccagagactgaacgagctggaggcccagaccagagtgaagctgaacttcctggaccagatcgccaagtactgggagctgcagggcagcaccctgaagatcccccacgtggagagaaagatcctggacctgttccagctgaacaagctggtggccgaggagggcggcttcgccgtggtgtgcaaggacagaaagtggaccaagatcgccaccaagatgggcttcgcccccggcaaggccgtgggcagccacatcagaggccactacgagagaatcctgaacccctacaacctgttcctgagcggcgacagcctgagatgcctgcagaagcccaacctgaccaccgacaccaaggacaaggagtacaagccccacgacatcccccagagacagagcgtgcagcccagcgagacctgcccccccgccagaagagccaagagaatgagagccgaggccatgaacatcaagatcgagcccgaggagaccaccgaggccagaacccacaacctgagaagaagaatgggctgccccacccccaagtgcgagaacgagaaggagatgaagagcagcatcaagcaggagcccatcgagagaaaggactacatcgtggagaacgagaaggagaagcccaagagcagaagcaagaaggccaccaacgccgtggacctgtacgtgtgcctgctgtgcggcagcggcaacgacgaggacagactgctgctgtgcgacggctgcgacgacagctaccacaccttctgcctgatcccccccctgcacgacgtgcccaagggcgactggagatgccccaagtgcctggcccaggagtgcagcaagccccaggaggccttcggcttcgagcaggccgccagagactacaccctgagaaccttcggcgagatggccgacgccttcaagagcgactacttcaacatgcccgtgcacatggtgcccaccgagctggtggagaaggagttctggagactggtgagcaccatcgaggaggacgtgaccgtggagtacggcgccgacatcgccagcaaggagttcggcagcggcttccccgtgagagacggcaagatcaagctgagccccgaggaggaggagtacctggacagcggctggaacctgaacaacatgcccgtgatggagcagagcgtgctggcccacatcaccgccgacatctgcggcatgaagctgccctggctgtacgtgggcatgtgcttcagcagcttctgctggcacatcgaggaccactggagctacagcatcaactacctgcactggggcgagcccaagacctggtacggcgtgcccggctacgccgccgagcagctggagaacgtgatgaagaagctggcccccgagctgttcgtgagccagcccgacctgctgcaccagctggtgaccatcatgaaccccaacaccctgatgacccacgaggtgcccgtgtacagaaccaaccagtgcgccggcgagttcgtgatcaccttccccagagcctaccacagcggcttcaaccagggcttcaacttcgccgaggccgtgaacttctgcaccgtggactggctgcccctgggcagacagtgcgtggagcactacagactgctgcacagatactgcgtgttcagccacgacgagatgatctgcaagatggccagcaaggccgacgtgctggacgtggtggtggccagcaccgtgcagaaggacatggccatcatgatcgaggacgagaaggccctgagagagaccgtgagaaagctgggcgtgatcgacagcgagagaatggacttcgagctgctgcccgacgacgagagacagtgcgtgaagtgcaagaccacctgcttcatgagcgccatcagctgcagctgcaagcccggcctgctggtgtgcctgcaccacgtgaaggagctgtgcagctgccccccctacaagtacaagctgagatacagatacaccctggacgacctgtaccccatgatgaacgccctgaagctgagagccgagagctacaacgagtgggccctgaacgtgaacgaggccctggaggccaagatcaacaagaagaagagcctggtgagcttcaaggccctgatcgaggagagcgagatgaagaagttccccgacaacgacctgctgagacacctgagactggtgacccaggacgccgagaagtgcgccagcgtggcccagcagctgctgaacggcaagagacagaccagatacagaagcggcggcggcaagagccagaaccagctgaccgtgaacgagctgagacagttcgtgacccagctgtacgccctgccctgcgtgctgagccagacccccctgctgaaggacctgctgaacagagtggaggacttccagcagcacagccagaagctgctgagcgaggagacccccagcgccgccgagctgcaggacctgctggacgtgagcttcgagttcgacgtggagctgccccagctggccgagatgagaatcagactggagcaggccagatggctggaggaggtgcagcaggcctgcctggaccccagcagcctgaccctggacgacatgagaagactgatcgacctgggcgtgggcctggccccctacagcgccgtggagaaggccatggccagactgcaggagctgctgaccgtgagcgagcactgggacgacaaggccaagagcctgctgaaggccagacccagacacagcctgaacagcctggccaccgccgtgaaggagatcgaggagatccccgcctacctgcccaacggcgccgccctgaaggacagcgtgcagagagccagagactggctgcaggacgtggagggcctgcaggccggcggcagagtgcccgtgctggacaccctgatcgagctggtgaccagaggcagaagcatccccgtgcacctgaacagcctgcccagactggagaccctggtggccgaggtgcaggcctggaaggagtgcgccgtgaacaccttcctgaccgagaacagcccctacagcctgctggaggtgctgtgccccagatgcgacatcggcctgctgggcctgaagagaaagcagagaaagctgaaggagcccctgcccaacggcaagaagaagagcaccaagctggagagcctgagcgacctggagagagccctgaccgagagcaaggagaccgccagcgccatggccaccctgggcgaggccagactgagagagatggaggccctgcagagcctgagactggccaacgagggcaagctgctgagccccctgcaggacgtggacatcaagatctgcctgtgccagaaggcccccgccgcccccatgatccagtgcgagctgtgcagagacgccttccacaccagctgcgtggccgtgcccagcatcagccagggcctgagaatctggctgtgcccccactgcagaagaagcgagaagccccccctggagaagatcctgcccctgctggccagcctgcagagaatcagagtgagactgcccgagggcgacgccctgagatacatgatcgagagaaccgtgaactggcagcacagagcccagcagctgctgagcagcggcaacctgaagttcgtgcaggacagagtgggcagcggcctgctgtacagcagatggcaggccagcgccggccaggtgagcgacaccaacaaggtgagccagccccccggcaccaccagcttcagcctgcccgacgactgggacaacagaaccagctacctgcacagccccttcagcaccggcagaagctgcatccccctgcacggcgtgagccccgaggtgaacgagctgctgatggaggcccagctgctgcaggtgagcctgcccgagatccaggagctgtaccagaccctgctggccaagcccagccccgcccagcagaccgacagaagcagccccgtgagacccagcagcgagaagaacgactgctgcagaggcaagagagacggcatcaacagcctggagagaaagctgaagagaagactggagagagagggcctgagcagcgagagatgggagagagtgaagaagatgagaacccccaagaagaagaagatcaagctgagccaccccaaggacatgaacaacttcaagctggagagagagagaagctacgagctggtgagaagcgccgagacccacagcctgcccagcgacaccagctacagcgagcaggaggacagcgaggacgaggacgccatctgccccgccgtgagctgcctgcagcccgagggcgacgaggtggactgggtgcagtgcgacggcagctgcaaccagtggttccaccaggtgtgcgtgggcgtgagccccgagatggccgagaaggaggactacatctgcgtgagatgcaccgtgaaggacgcccccagcagaaagtag

SEQ ID NO: 87490 - DNA, 4161 bp, Artificial Sequence
  Description of Artificial Sequence: Synthetic coding sequence
atgggcttcgcccccggcaaggccgtgggcagccacatcagaggccactacgagagaatcctgaacccctacaacctgttcctgagcggcgacagcctgagatgcctgcagaagcccaacctgaccaccgacaccaaggacaaggagtacaagccccacgacatcccccagagacagagcgtgcagcccagcgagacctgcccccccgccagaagagccaagagaatgagagccgaggccatgaacatcaagatcgagcccgaggagaccaccgaggccagaacccacaacctgagaagaagaatgggctgccccacccccaagtgcgagaacgagaaggagatgaagagcagcatcaagcaggagcccatcgagagaaaggactacatcgtggagaacgagaaggagaagcccaagagcagaagcaagaaggccaccaacgccgtggacctgtacgtgtgcctgctgtgcggcagcggcaacgacgaggacagactgctgctgtgcgacggctgcgacgacagctaccacaccttctgcctgatcccccccctgcacgacgtgcccaagggcgactggagatgccccaagtgcctggcccaggagtgcagcaagccccaggaggccttcggcttcgagcaggccgccagagactacaccctgagaaccttcggcgagatggccgacgccttcaagagcgactacttcaacatgcccgtgcacatggtgcccaccgagctggtggagaaggagttctggagactggtgagcaccatcgaggaggacgtgaccgtggagtacggcgccgacatcgccagcaaggagttcggcagcggcttccccgtgagagacggcaagatcaagctgagccccgaggaggaggagtacctggacagcggctggaacctgaacaacatgcccgtgatggagcagagcgtgctggcccacatcaccgccgacatctgcggcatgaagctgccctggctgtacgtgggcatgtgcttcagcagcttctgctggcacatcgaggaccactggagctacagcatcaactacctgcactggggcgagcccaagacctggtacggcgtgcccggctacgccgccgagcagctggagaacgtgatgaagaagctggcccccgagctgttcgtgagccagcccgacctgctgcaccagctggtgaccatcatgaaccccaacaccctgatgacccacgaggtgcccgtgtacagaaccaaccagtgcgccggcgagttcgtgatcaccttccccagagcctaccacagcggcttcaaccagggcttcaacttcgccgaggccgtgaacttctgcaccgtggactggctgcccctgggcagacagtgcgtggagcactacagactgctgcacagatactgcgtgttcagccacgacgagatgatctgcaagatggccagcaaggccgacgtgctggacgtggtggtggccagcaccgtgcagaaggacatggccatcatgatcgaggacgagaaggccctgagagagaccgtgagaaagctgggcgtgatcgacagcgagagaatggacttcgagctgctgcccgacgacgagagacagtgcgtgaagtgcaagaccacctgcttcatgagcgccatcagctgcagctgcaagcccggcctgctggtgtgcctgcaccacgtgaaggagctgtgcagctgccccccctacaagtacaagctgagatacagatacaccctggacgacctgtaccccatgatgaacgccctgaagctgagagccgagagctacaacgagtgggccctgaacgtgaacgaggccctggaggccaagatcaacaagaagaagagcctggtgagcttcaaggccctgatcgaggagagcgagatgaagaagttccccgacaacgacctgctgagacacctgagactggtgacccaggacgccgagaagtgcgccagcgtggcccagcagctgctgaacggcaagagacagaccagatacagaagcggcggcggcaagagccagaaccagctgaccgtgaacgagctgagacagttcgtgacccagctgtacgccctgccctgcgtgctgagccagacccccctgctgaaggacctgctgaacagagtggaggacttccagcagcacagccagaagctgctgagcgaggagacccccagcgccgccgagctgcaggacctgctggacgtgagcttcgagttcgacgtggagctgccccagctggccgagatgagaatcagactggagcaggccagatggctggaggaggtgcagcaggcctgcctggaccccagcagcctgaccctggacgacatgagaagactgatcgacctgggcgtgggcctggccccctacagcgccgtggagaaggccatggccagactgcaggagctgctgaccgtgagcgagcactgggacgacaaggccaagagcctgctgaaggccagacccagacacagcctgaacagcctggccaccgccgtgaaggagatcgaggagatccccgcctacctgcccaacggcgccgccctgaaggacagcgtgcagagagccagagactggctgcaggacgtggagggcctgcaggccggcggcagagtgcccgtgctggacaccctgatcgagctggtgaccagaggcagaagcatccccgtgcacctgaacagcctgcccagactggagaccctggtggccgaggtgcaggcctggaaggagtgcgccgtgaacaccttcctgaccgagaacagcccctacagcctgctggaggtgctgtgccccagatgcgacatcggcctgctgggcctgaagagaaagcagagaaagctgaaggagcccctgcccaacggcaagaagaagagcaccaagctggagagcctgagcgacctggagagagccctgaccgagagcaaggagaccgccagcgccatggccaccctgggcgaggccagactgagagagatggaggccctgcagagcctgagactggccaacgagggcaagctgctgagccccctgcaggacgtggacatcaagatctgcctgtgccagaaggcccccgccgcccccatgatccagtgcgagctgtgcagagacgccttccacaccagctgcgtggccgtgcccagcatcagccagggcctgagaatctggctgtgcccccactgcagaagaagcgagaagccccccctggagaagatcctgcccctgctggccagcctgcagagaatcagagtgagactgcccgagggcgacgccctgagatacatgatcgagagaaccgtgaactggcagcacagagcccagcagctgctgagcagcggcaacctgaagttcgtgcaggacagagtgggcagcggcctgctgtacagcagatggcaggccagcgccggccaggtgagcgacaccaacaaggtgagccagccccccggcaccaccagcttcagcctgcccgacgactgggacaacagaaccagctacctgcacagccccttcagcaccggcagaagctgcatccccctgcacggcgtgagccccgaggtgaacgagctgctgatggaggcccagctgctgcaggtgagcctgcccgagatccaggagctgtaccagaccctgctggccaagcccagccccgcccagcagaccgacagaagcagccccgtgagacccagcagcgagaagaacgactgctgcagaggcaagagagacggcatcaacagcctggagagaaagctgaagagaagactggagagagagggcctgagcagcgagagatgggagagagtgaagaagatgagaacccccaagaagaagaagatcaagctgagccaccccaaggacatgaacaacttcaagctggagagagagagaagctacgagctggtgagaagcgccgagacccacagcctgcccagcgacaccagctacagcgagcaggaggacagcgaggacgaggacgccatctgccccgccgtgagctgcctgcagcccgagggcgacgaggtggactgggtgcagtgcgacggcagctgcaaccagtggttccaccaggtgtgcgtgggcgtgagccccgagatggccgagaaggaggactacatctgcgtgagatgcaccgtgaaggacgcccccagcagaaagtag

SEQ ID NO: 87491 - DNA, 933 bp, Artificial Sequence
  Description of Artificial Sequence: Synthetic coding sequence
atgatctgcaagatggccagcaaggccgacgtgctggacgtggtggtggccagcaccgtgcagaaggacatggccatcatgatcgaggacgagaaggccctgagagagaccgtgagaaagctgggcgtgatcgacagcgagagaatggacttcgagctgctgcccgacgacgagagacagtgcgtgaagtgcaagaccacctgcttcatgagcgccatcagctgcagctgcaagcccggcctgctggtgtgcctgcaccacgtgaaggagctgtgcagctgccccccctacaagtacaagctgagatacagatacaccctggacgacctgtaccccatgatgaacgccctgaagctgagagccgagagctacaacgagtgggccctgaacgtgaacgaggccctggaggccaagatcaacaagaagaagagcctggtgagcttcaaggccctgatcgaggagagcgagatgaagaagttccccgacaacgacctgctgagacacctgagactggtgacccaggacgccgagaagtgcgccagcgtggcccagcagctgctgaacggcaagagacagaccagatacagaagcggcggcggcaagagccagaaccagctgaccgtgaacgagctgagacagttcgtgacccagctgtacgccctgccctgcgtgctgagccagacccccctgctgaaggacctgctgaacagagtggaggacttccagcagcacagccagaagctgctgagcgaggagacccccagcgccgccgagctgcaggacctgctggacgtgagcttcgagttcgacgtggagctgccccagctggccgagatgagaatcagactggagcaggccagatggctggaggaggtgcagcaggcctgcctggaccccagcagcctgaccctggacgacatgagagtgagctag

SEQ ID NO: 87492 - DNA, 4674 bp, Artificial Sequence
  Description of Artificial Sequence: Synthetic coding sequence
atggagcccggcagcgacgacttcctgcccccccccgagtgccccgtgttcgagcccagctgggccgagttcagagaccccctgggctacatcgccaagatcagacccatcgccgagaagagcggcatctgcaagatcagaccccccgccgactggcagccccccttcgccgtggaggtggacaacttcagattcacccccagaatccagagactgaacgagctggaggcccagaccagagtgaagctgaactacctggaccagatcgccaagttctgggagatccagggcagcagcctgaagatccccaacgtggagagaagaatcctggacctgtacagcctgagcaagatcgtggtggaggagggcggctacgaggccatctgcaaggacagaagatgggccagagtggcccagagactgaactacccccccggcaagaacatcggcagcctgctgagaagccactacgagagaatcgtgtacccctacgagatgtaccagagcggcgccaacctggtgcagtgcaacaccagacccttcgacaacgaggagaaggacaaggagtacaagccccacagcatccccctgagacagagcgtgcagcccagcaagttcaacagctacggcagaagagccaagagactgcagcccgaccccgagcccaccgaggaggacatcgagaagaaccccgagctgaagaagctgcagatctacggcgccggccccaagatgatgggcctgggcctgatggccaaggacaagaccctgagaaagaaggacaaggagggccccgagtgcccccccaccgtggtggtgaaggaggagctgggcggcgacgtgaaggtggagagcaccagccccaagaccttcctggagagcaaggaggagctgagccacagccccgagccctgcaccaagatgaccatgagactgagaagaaaccacagcaacgcccagttcatcgagagctacgtgtgcagaatgtgcagcagaggcgacgaggacgacaagctgctgctgtgcgacggctgcgacgacaactaccacatcttctgcctgctgccccccctgcccgagatccccaagggcgtgtggagatgccccaagtgcgtgatggccgagtgcaagagaccccccgaggccttcggcttcgagcaggccaccagagagtacaccctgcagagcttcggcgagatggccgacagcttcaaggccgactacttcaacatgcccgtgcacatggtgcccaccgagctggtggagaaggagttctggagactggtgaacagcatcgaggaggacgtgaccgtggagtacggcgccgacatccacagcaaggagttcggcagcggcttccccgtgagcgacagcaagagacacctgacccccgaggaggaggagtacgccaccagcggctggaacctgaacgtgatgcccgtgctggagcagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagaagctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgcctgccccgagaagctggacctgaacctggccgccgccgtgcacaaggagatgttcatcatggtgcaggaggagagaagactgagaaaggccctgctggagaagggcatcaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccgccatgctgcacaagctgaaggtgagagccgagagcttcgacacctgggccaacaaggtgagagtggccctggaggtggaggacggcagaaagagaagcctggaggagctgagagccctggagagcgaggccagagagagaagattccccaacagcgagctgctgcagcagctgaagaactgcctgagcgaggccgaggcctgcgtgagcagagccctgggcctggtgagcggccaggaggccggcccccacagagtggccggcctgcagatgaccctgaccgagctgagagccttcctggaccagatgaacaacctgccctgcgccatgcaccagatcggcgacgtgaagggcgtgctggagcaggtggaggcctaccaggccgaggccagagaggccctggccagcctgcccagcagccccggcctgctgcagagcctgctggagagaggcagacagctgggcgtggaggtgcccgaggcccagcagctgcagagacaggtggagcaggccagatggctggacgaggtgaagagaaccctggcccccagcgccagaagaggcaccctggccgtgatgagaggcctgctggtggccggcgccagcgtggcccccagccccgccgtggacaaggcccaggccgagctgcaggagctgctgaccatcgccgagagatgggaggagaaggcccacctgtgcctggaggccagacagaagcacccccccgccaccctggaggccatcatcagagaggccgagaacatccccgtgcacctgcccaacatccaggccctgaaggaggccctggccaaggccagagcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggagctgggcctgtacaagagcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggccagcagcagcaccgccagcagcaccaccagcatctgcgtgtgcggccaggtgctggccggcgccggcgccctgcagtgcgacctgtgccaggactggttccacggcagatgcgtgagcgtgcccagactgctgagcagccccagacccaaccccaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcagctggcagggcagagccagacaggccctggccagcgaggacgtgaccgccctgctgggcagactggccgagctgagacagagactgcaggccgagcccagacccgaggagccccccaactaccccgccgcccccgccagcgaccccctgagagagggcagcggcaaggacatgcccaaggtgcagggcctgctggagaacggcgacagcgtgaccagccccgagaaggtggcccccgaggagggcagcgacctggagctgctgagcagcctgctgccccagctgaccggccccgtgctggagctgcccgaggccaccagagcccccctggaggagctgatgatggagggcgacctgctggaggtgaccctggacgagaaccacagcatctggcagctgctgcaggccggccagccccccgacctggagagaatcagaaccctgctggagctggagaaggccgagagacacggcagcagagccagaggcagagccctggagagaagaagaagaagaaaggtggacagaggcggcgagggcgacgaccccgccagagaggagctggagcccaagagagtgagaagcagcggccccgaggccgaggaggtgcaggaggaggaggagctggaggaggagaccggcggcgagggcccccccgcccccatccccaccaccggcagccccagcacccaggagaaccagaacggcctggagcccgccgagggcaccaccagcggccccagcgcccccttcagcaccctgacccccagactgcacctgccctgcccccagcagcccccccagcagcagctgtag

SEQ ID NO: 87493 - DNA, 4551 bp, Artificial Sequence
  Description of Artificial Sequence: Synthetic coding sequence
atggagcccggcagcgacgacttcctgcccccccccgagtgccccgtgttcgagcccagctgggccgagttcagagaccccctgggctacatcgccaagatcagacccatcgccgagaagagcggcatctgcaagatcagaccccccgccgactggcagccccccttcgccgtggaggtggacaacttcagattcacccccagaatccagagactgaacgagctggagatcgtggtggaggagggcggctacgaggccatctgcaaggacagaagatgggccagagtggcccagagactgaactacccccccggcaagaacatcggcagcctgctgagaagccactacgagagaatcgtgtacccctacgagatgtaccagagcggcgccaacctggtgcagtgcaacaccagacccttcgacaacgaggagaaggacaaggagtacaagccccacagcatccccctgagacagagcgtgcagcccagcaagttcaacagctacggcagaagagccaagagactgcagcccgaccccgagcccaccgaggaggacatcgagaagaaccccgagctgaagaagctgcagatctacggcgccggccccaagatgatgggcctgggcctgatggccaaggacaagaccctgagaaagaaggacaaggagggccccgagtgcccccccaccgtggtggtgaaggaggagctgggcggcgacgtgaaggtggagagcaccagccccaagaccttcctggagagcaaggaggagctgagccacagccccgagccctgcaccaagatgaccatgagactgagaagaaaccacagcaacgcccagttcatcgagagctacgtgtgcagaatgtgcagcagaggcgacgaggacgacaagctgctgctgtgcgacggctgcgacgacaactaccacatcttctgcctgctgccccccctgcccgagatccccaagggcgtgtggagatgccccaagtgcgtgatggccgagtgcaagagaccccccgaggccttcggcttcgagcaggccaccagagagtacaccctgcagagcttcggcgagatggccgacagcttcaaggccgactacttcaacatgcccgtgcacatggtgcccaccgagctggtggagaaggagttctggagactggtgaacagcatcgaggaggacgtgaccgtggagtacggcgccgacatccacagcaaggagttcggcagcggcttccccgtgagcgacagcaagagacacctgacccccgaggaggaggagtacgccaccagcggctggaacctgaacgtgatgcccgtgctggagcagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagaagctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgcctgccccgagaagctggacctgaacctggccgccgccgtgcacaaggagatgttcatcatggtgcaggaggagagaagactgagaaaggccctgctggagaagggcatcaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccgccatgctgcacaagctgaaggtgagagccgagagcttcgacacctgggccaacaaggtgagagtggccctggaggtggaggacggcagaaagagaagcctggaggagctgagagccctggagagcgaggccagagagagaagattccccaacagcgagctgctgcagcagctgaagaactgcctgagcgaggccgaggcctgcgtgagcagagccctgggcctggtgagcggccaggaggccggcccccacagagtggccggcctgcagatgaccctgaccgagctgagagccttcctggaccagatgaacaacctgccctgcgccatgcaccagatcggcgacgtgaagggcgtgctggagcaggtggaggcctaccaggccgaggccagagaggccctggccagcctgcccagcagccccggcctgctgcagagcctgctggagagaggcagacagctgggcgtggaggtgcccgaggcccagcagctgcagagacaggtggagcaggccagatggctggacgaggtgaagagaaccctggcccccagcgccagaagaggcaccctggccgtgatgagaggcctgctggtggccggcgccagcgtggcccccagccccgccgtggacaaggcccaggccgagctgcaggagctgctgaccatcgccgagagatgggaggagaaggcccacctgtgcctggaggccagacagaagcacccccccgccaccctggaggccatcatcagagaggccgagaacatccccgtgcacctgcccaacatccaggccctgaaggaggccctggccaaggccagagcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggagctgggcctgtacaagagcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggccagcagcagcaccgccagcagcaccaccagcatctgcgtgtgcggccaggtgctggccggcgccggcgccctgcagtgcgacctgtgccaggactggttccacggcagatgcgtgagcgtgcccagactgctgagcagccccagacccaaccccaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcagctggcagggcagagccagacaggccctggccagcgaggacgtgaccgccctgctgggcagactggccgagctgagacagagactgcaggccgagcccagacccgaggagccccccaactaccccgccgcccccgccagcgaccccctgagagagggcagcggcaaggacatgcccaaggtgcagggcctgctggagaacggcgacagcgtgaccagccccgagaaggtggcccccgaggagggcagcgacctggagctgctgagcagcctgctgccccagctgaccggccccgtgctggagctgcccgaggccaccagagcccccctggaggagctgatgatggagggcgacctgctggaggtgaccctggacgagaaccacagcatctggcagctgctgcaggccggccagccccccgacctggagagaatcagaaccctgctggagctggagaaggccgagagacacggcagcagagccagaggcagagccctggagagaagaagaagaagaaaggtggacagaggcggcgagggcgacgaccccgccagagaggagctggagcccaagagagtgagaagcagcggccccgaggccgaggaggtgcaggaggaggaggagctggaggaggagaccggcggcgagggcccccccgcccccatccccaccaccggcagccccagcacccaggagaaccagaacggcctggagcccgccgagggcaccaccagcggccccagcgcccccttcagcaccctgacccccagactgcacctgccctgcccccagcagcccccccagcagcagctgtag

SEQ ID NO: 87494 - DNA, 4683 bp, Artificial Sequence
  Description of Artificial Sequence: Synthetic coding sequence
atggagcccggcagcgacgacttcctgcccccccccgagtgccccgtgttcgagcccagctgggccgagttcagagaccccctgggctacatcgccaagatcagacccatcgccgagaagagcggcatctgcaagatcagaccccccgccgactggcagccccccttcgccgtggaggtggacaacttcagattcacccccagaatccagagactgaacgagctggaggcccagaccagagtgaagctgaactacctggaccagatcgccaagttctgggagatccagggcagcagcctgaagatccccaacgtggagagaagaatcctggacctgtacagcctgagcaagatcgtggtggaggagggcggctacgaggccatctgcaaggacagaagatgggccagagtggcccagagactgaactacccccccggcaagaacatcggcagcctgctgagaagccactacgagagaatcgtgtacccctacgagatgtaccagagcggcgccaacctggtgcagtgcaacaccagacccttcgacaacgaggagaaggacaaggagtacaagccccacagcatccccctgagacagagcgtgcagcccagcaagttcaacagctacggcagaagagccaagagactgcagcccgaccccgagcccaccgaggaggacatcgagaagaaccccgagctgaagaagctgcagatctacggcgccggccccaagatgatgggcctgggcctgatggccaaggacaagaccctgagaaagaaggacaaggagggccccgagtgcccccccaccgtggtggtgaaggaggagctgggcggcgacgtgaaggtggagagcaccagccccaagaccttcctggagagcaaggaggagctgagccacagccccgagccctgcaccaagatgaccatgagactgagaagaaaccacagcaacgcccagttcatcgagagctacgtgtgcagaatgtgcagcagaggcgacgaggacgacaagctgctgctgtgcgacggctgcgacgacaactaccacatcttctgcctgctgccccccctgcccgagatccccaagggcgtgtggagatgccccaagtgcgtgatggccgagtgcaagagaccccccgaggccttcggcttcgagcaggccaccagagagtacaccctgcagagcttcggcgagatggccgacagcttcaaggccgactacttcaacatgcccgtgcacatggtgcccaccgagctggtggagaaggagttctggagactggtgaacagcatcgaggaggacgtgaccgtggagtacggcgccgacatccacagcaaggagttcggcagcggcttccccgtgagcgacagcaagagacacctgacccccgaggaggaggagtacgccaccagcggctggaacctgaacgtgatgcccgtgctggagcagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagaagctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgcctgccccgagaagctggacctgaacctggccgccgccgtgcacaaggagatgttcatcatggtgcaggaggagagaagactgagaaaggccctgctggagaagggcatcaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccgccatgctgcacaagctgaaggtgagagccgagagcttcgacacctgggccaacaaggtgagagtggccctggaggtggaggacggcagaaagagaagcctggaggagctgagagccctggagagcgaggccagagagagaagattccccaacagcgagctgctgcagcagctgaagaactgcctgagcgaggccgaggcctgcgtgagcagagccctgggcctggtgagcggccaggaggccggcccccacagagtggccggcctgcagatgaccctgaccgagctgagagccttcctggaccagatgaacaacctgccctgcgccatgcaccagatcggcgacgtgaagggcgtgctggagcaggtggaggcctaccaggccgaggccagagaggccctggccagcctgcccagcagccccggcctgctgcagagcctgctggagagaggcagacagctgggcgtggaggtgcccgaggcccagcagctgcagagacaggtggagcaggccagatggctggacgaggtgaagagaaccctggcccccagcgccagaagaggcaccctggccgtgatgagaggcctgctggtggccggcgccagcgtggcccccagccccgccgtggacaaggcccaggccgagctgcaggagctgctgaccatcgccgagagatgggaggagaaggcccacctgtgcctggaggccagacagaagcacccccccgccaccctggaggccatcatcagagaggccgagaacatccccgtgcacctgcccaacatccaggccctgaaggaggccctggccaaggccagagcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggagctgggcctgtacaagagcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggccagcagcagcaccgccagcagcaccaccagcatctgcgtgtgcggccaggtgctggccggcgccggcgccctgcagtgcgacctgtgccaggactggttccacggcagatgcgtgagcgtgcccagactgctgagcagccccagacccaaccccaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcagctggcagggcagagccagacaggccctggccagcgaggacgtgaccgccctgctgggcagactggccgagctgagacagagactgcaggccgagcccagacccgaggagccccccaactaccccgccgcccccgccagcgaccccctgagagagggcagcggcaaggacatgcccaaggtgcagggcctgctggagaacggcgacagcgtgaccagccccgagaaggtggcccccgaggagggcagcggcaagagagacctggagctgctgagcagcctgctgccccagctgaccggccccgtgctggagctgcccgaggccaccagagcccccctggaggagctgatgatggagggcgacctgctggaggtgaccctggacgagaaccacagcatctggcagctgctgcaggccggccagccccccgacctggagagaatcagaaccctgctggagctggagaaggccgagagacacggcagcagagccagaggcagagccctggagagaagaagaagaagaaaggtggacagaggcggcgagggcgacgaccccgccagagaggagctggagcccaagagagtgagaagcagcggccccgaggccgaggaggtgcaggaggaggaggagctggaggaggagaccggcggcgagggcccccccgcccccatccccaccaccggcagccccagcacccaggagaaccagaacggcctggagcccgccgagggcaccaccagcggccccagcgcccccttcagcaccctgacccccagactgcacctgccctgcccccagcagcccccccagcagcagctgtag

SEQ ID NO: 87495 - DNA, 4680 bp, Artificial Sequence
  Description of Artificial Sequence: Synthetic coding sequence
atggagcccggcagcgacgacttcctgcccccccccgagtgccccgtgttcgagcccagctgggccgagttcagagaccccctgggctacatcgccaagatcagacccatcgccgagaagagcggcatctgcaagatcagaccccccgccgactggcagccccccttcgccgtggaggtggacaacttcagattcacccccagaatccagagactgaacgagctggaggcccagaccagagtgaagctgaactacctggaccagatcgccaagttctgggagatccagggcagcagcctgaagatccccaacgtggagagaagaatcctggacctgtacagcctgagcaagatcgtggtggaggagggcggctacgaggccatctgcaaggacagaagatgggccagagtggcccagagactgaactacccccccggcaagaacatcggcagcctgctgagaagccactacgagagaatcgtgtacccctacgagatgtaccagagcggcgccaacctggtgtgcaacaccagacccttcgacaacgaggagaaggacaaggagtacaagccccacagcatccccctgagacagagcgtgcagcccagcaagttcaacagctacggcagaagagccaagagactgcagcccgaccccgagcccaccgaggaggacatcgagaagaaccccgagctgaagaagctgcagatctacggcgccggccccaagatgatgggcctgggcctgatggccaaggacaagaccctgagaaagaaggacaaggagggccccgagtgcccccccaccgtggtggtgaaggaggagctgggcggcgacgtgaaggtggagagcaccagccccaagaccttcctggagagcaaggaggagctgagccacagccccgagccctgcaccaagatgaccatgagactgagaagaaaccacagcaacgcccagttcatcgagagctacgtgtgcagaatgtgcagcagaggcgacgaggacgacaagctgctgctgtgcgacggctgcgacgacaactaccacatcttctgcctgctgccccccctgcccgagatccccaagggcgtgtggagatgccccaagtgcgtgatggccgagtgcaagagaccccccgaggccttcggcttcgagcaggccaccagagagtacaccctgcagagcttcggcgagatggccgacagcttcaaggccgactacttcaacatgcccgtgcacatggtgcccaccgagctggtggagaaggagttctggagactggtgaacagcatcgaggaggacgtgaccgtggagtacggcgccgacatccacagcaaggagttcggcagcggcttccccgtgagcgacagcaagagacacctgacccccgaggaggaggagtacgccaccagcggctggaacctgaacgtgatgcccgtgctggagcagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagaagctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgcctgccccgagaagctggacctgaacctggccgccgccgtgcacaaggagatgttcatcatggtgcaggaggagagaagactgagaaaggccctgctggagaagggcatcaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccgccatgctgcacaagctgaaggtgagagccgagagcttcgacacctgggccaacaaggtgagagtggccctggaggtggaggacggcagaaagagaagcctggaggagctgagagccctggagagcgaggccagagagagaagattccccaacagcgagctgctgcagcagctgaagaactgcctgagcgaggccgaggcctgcgtgagcagagccctgggcctggtgagcggccaggaggccggcccccacagagtggccggcctgcagatgaccctgaccgagctgagagccttcctggaccagatgaacaacctgccctgcgccatgcaccagatcggcgacgtgaagggcgtgctggagcaggtggaggcctaccaggccgaggccagagaggccctggccagcctgcccagcagccccggcctgctgcagagcctgctggagagaggcagacagctgggcgtggaggtgcccgaggcccagcagctgcagagacaggtggagcaggccagatggctggacgaggtgaagagaaccctggcccccagcgccagaagaggcaccctggccgtgatgagaggcctgctggtggccggcgccagcgtggcccccagccccgccgtggacaaggcccaggccgagctgcaggagctgctgaccatcgccgagagatgggaggagaaggcccacctgtgcctggaggccagacagaagcacccccccgccaccctggaggccatcatcagagaggccgagaacatccccgtgcacctgcccaacatccaggccctgaaggaggccctggccaaggccagagcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggagctgggcctgtacaagagcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggccagcagcagcaccgccagcagcaccaccagcatctgcgtgtgcggccaggtgctggccggcgccggcgccctgcagtgcgacctgtgccaggactggttccacggcagatgcgtgagcgtgcccagactgctgagcagccccagacccaaccccaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcagctggcagggcagagccagacaggccctggccagcgaggacgtgaccgccctgctgggcagactggccgagctgagacagagactgcaggccgagcccagacccgaggagccccccaactaccccgccgcccccgccagcgaccccctgagagagggcagcggcaaggacatgcccaaggtgcagggcctgctggagaacggcgacagcgtgaccagccccgagaaggtggcccccgaggagggcagcggcaagagagacctggagctgctgagcagcctgctgccccagctgaccggccccgtgctggagctgcccgaggccaccagagcccccctggaggagctgatgatggagggcgacctgctggaggtgaccctggacgagaaccacagcatctggcagctgctgcaggccggccagccccccgacctggagagaatcagaaccctgctggagctggagaaggccgagagacacggcagcagagccagaggcagagccctggagagaagaagaagaagaaaggtggacagaggcggcgagggcgacgaccccgccagagaggagctggagcccaagagagtgagaagcagcggccccgaggccgaggaggtgcaggaggaggaggagctggaggaggagaccggcggcgagggcccccccgcccccatccccaccaccggcagccccagcacccaggagaaccagaacggcctggagcccgccgagggcaccaccagcggccccagcgcccccttcagcaccctgacccccagactgcacctgccctgcccccagcagcccccccagcagcagctgtag

SEQ ID NO: 87496 - DNA, 4140 bp, Artificial Sequence
  Description of Artificial Sequence: Synthetic coding sequence
atggagcccggcagcgacgacttcctgcccccccccgagtgccccgtgttcgagcccagctgggccgagttcagagaccccctgggctacatcgccaagatcagacccatcgccgagaagagcggcatctgcaagatcagaccccccgccatcgtggtggaggagggcggctacgaggccatctgcaaggacagaagatgggccagagtggcccagagactgaactacccccccggcaagaacatcggcagcctgctgagaagccactacgagagaatcgtgtacccctacgagatgtaccagagcggcgccaacctggtgcagtgcaacaccagacccttcgacaacgaggagaaggacaaggagtacaagccccacagcatccccctgagacagagcgtgcagcccagcaagttcaacagctacggcagaagagccaagagactgcagcccgaccccgagcccaccgaggaggacatcgagaagaaccccgagctgaagaagctgcagatctacggcgccggccccaagatgatgggcctgggcctgatggccaaggacaagaccctgagaaagaaggacaaggagggccccgagtgcccccccaccgtggtggtgaaggaggagctgggcggcgacgtgaaggtggagagcaccagccccaagaccttcctggagagcaaggaggagctgagccacagccccgagccctgcaccaagatgaccatgagactgagaagaaaccacagcaacgcccagttcatcgagagctacgtgtgcagaatgtgcagcagaggcgacgaggacgacaagctgctgctgtgcgacggctgcgacgacaactaccacatcttctgcctgctgccccccctgcccgagatccccaagggcgtgtggagatgccccaagtgcgtgatggccgagtgcaagagaccccccgaggccttcggcttcgagcaggccaccagagagtacaccctgcagagcttcggcgagatggccgacagcttcaaggccgactacttcaacatgcccgtgcacatggtgcccaccgagctggtggagaaggagttctggagactggtgaacagcatcgaggaggacgtgaccgtggagtacggcgccgacatccacagcaaggagttcggcagcggcttccccgtgagcgacagcaagagacacctgacccccgaggaggaggagtacgccaccagcggctggaacctgaacgtgatgcccgtgctggagcagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagaagctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgcctgccccgagaagctggacctgaacctggccgccgccgtgcacaaggagatgttcatcatggtgcaggaggagagaagactgagaaaggccctgctggagaagggcatcaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccgccatgctgcacaagctgaaggtgagagccgagagcttcgacacctgggccaacaaggtgagagtggccctggaggtggaggacggcagaaagagaagcctggaggagctgagagccctggagagcgaggccagagagagaagattccccaacagcgagctgctgcagcagctgaagaactgcctgagcgaggccgaggcctgcgtgagcagagccctgggcctggtgagcggccaggaggccggcccccacagagtggccggcctgcagatgaccctgaccgagctgagagccttcctggaccagatgaacaacctgccctgcgccatgcaccagatcggcgacgtgaagggcgtgctggagcaggtggaggcctaccaggccgaggccagagaggccctggccagcctgcccagcagccccggcctgctgcagagcctgctggagagaggcagacagctgggcgtggaggtgcccgaggcccagcagctgcagagacaggtggagcaggccagatggctggacgaggtgaagagaaccctggcccccagcgccagaagaggcaccctggccgtgatgagaggcctgctggtggccggcgccagcgtggcccccagccccgccgtggacaaggcccaggccgagctgcaggagctgctgaccatcgccgagagatgggaggagaaggcccacctgtgcctggaggccagacagaagcacccccccgccaccctggaggccatcatcagagaggccgagaacatccccgtgcacctgcccaacatccaggccctgaaggaggccctggccaaggccagagcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggagctgggcctgtacaagagcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggccagcagcagcaccgccagcagcaccaccagcatctgcgtgtgcggccaggtgctggccggcgccggcgccctgcagtgcgacctgtgccaggactggttccacggcagatgcgtgagcgtgcccagactgctgagcagccccagacccaaccccaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcagctggcagggcagagccagacaggccctggccagcgaggacgtgaccgccctgctgggcagactggccgagctgagacagagactgcaggccgagcccagacccgaggagccccccaactaccccgccgcccccgccagcgaccccctgagagagggcagcggcaaggacatgcccaaggtgcagggcctgctggagaacggcgacagcgtgaccagccccgagaaggtggcccccgaggagggcagcgacctggagctgctgagcagcctgctgccccagctgaccggccccgtgctggagctgcccgaggccaccagagcccccctggaggagctgatgatggagggcgacctgctggaggtgaccctggacgagaaccacagcatccccgagagcctggacttctgcatcctgacccccagatactgcagcgacctgagcagctggggccccgcccccggcgtgttccccccctggtag

SEQ ID NO: 87497 - DNA, 4620 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggaggcccagaccagagtgaagctgaactacctggaccagatcgccaagttctgggagatccagggcagcagcctgaagatccccaacgtggagagaaagatcctggacctgtacagcctgagcaagatcgtgatcgaggagggcggctacgaggccatctgcaaggacagaagatgggccagagtggcccagagactgcactacccccccggcaagaacatcggcagcctgctgagaagccactacgagagaatcatctacccctacgagatgttccagagcggcgccaaccacgtgcagtgcaacacccaccccttcgacaacgaggtgaaggacaaggagtacaagccccacagcatccccctgagacagagcgtgcagcccagcaagttcagcagctacagcagaagagccaagagactgcagcccgaccccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaaggagtacgccaccagcggctggaacctgaacgtgatgcccgtgctggaccagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagatgctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgccttccccgagaccctggacctgaacctggccgtggccgtgcacaaggagatgttcatcatggtgcaggaggagagaagactgagaaaggccctgctggagaagggcgtgaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccaccatgctgcacaagctgaagatcagagccgagagcttcgacacctgggccaacaaggtgagagtggccctggaggtggaggacggcagaaagagaagcttcgaggagctgagagccctggagagcgaggccagagagagaagattccccaacagcgagctgctgcagagactgaagaactgcctgagcgaggtggaggcctgcatcgcccaggtgctgggcctggtgagcggccaggtggccagaatggacaccccccagctgaccctgaccgagctgagagtgctgctggagcagatgggcagcctgccctgcgccatgcaccagatcggcgacgtgaaggacgtgctggagcaggtggaggcctaccaggccgaggccagagaggccctggccaccctgcccagcagccccggcctgctgagaagcctgctggagagaggccagcagctgggcgtggaggtgcccgaggcccaccagctgcagcagcaggtggagcaggcccagtggctggacgaggtgaagcaggccctggcccccagcgcccacagaggcagcctggtgatcatgcagggcctgctggtgatgggcgccaagatcgccagcagccccagcgtggacaaggccagagccgagctgcaggagctgctgaccatcgccgagagatgggaggagaaggcccacttctgcctggaggccagacagaagcacccccccgccaccctggaggccatcatcagagagaccgagaacatccccgtgcacctgcccaacatccaggccctgaaggaggccctgaccaaggcccaggcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggccctgggcctgtaccagtgcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggcccccagcctgatggccagcagccccaccagcatctgcgtgtgcggccaggtgcccgccggcgtgggcgtgctgcagtgcgacctgtgccaggactggttccacggccagtgcgtgagcgtgccccacctgctgaccagccccaagcccagcctgaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcggctggcaggacagagccagaaaggccctggccagcgaggacgtgaccgccctgctgagacagctggccgagctgagacagcagctgcaggccaagcccagacccgaggaggccagcgtgtacaccagcgccaccgcctgcgaccccatcagagagggcagcggcaacaacatcagcaaggtgcagggcctgctggagaacggcgacagcgtgaccagccccgagaacatggcccccggcaagggcagcgacctggagctgctgagcagcctgctgccccagctgaccggccccgtgctggagctgcccgaggccatcagagcccccctggaggagctgatgatggagggcgacctgctggaggtgaccctggacgagaaccacagcatctggcagctgctgcaggccggccagccccccgacctggacagaatcagaaccctgctggagctggagaagttcgagcaccagggcagcagaaccagaagcagagccctggagagaagaagaagaagacagaaggtggaccagggcagaaacgtggagaacctggtgcagcaggagctgcagagcaagagagccagaagcagcggcatcatgagccaggtgggcagagaggaggagcactaccaggagaaggccgacagagagaacatgttcctgacccccagcaccgaccacagccccttcctgaagggcaaccagaacagcctgcagcacaaggacagcggcagcagcgccgcctgccccagcctgatgcccctgctgcagctgagctacagcgacgagcagcagctgtag

SEQ ID NO: 87498 - DNA, 4449 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggaggcccagaccagagtgaagctgaactacctggaccagatcgccaagttctgggagatccagggcagcagcctgaagatccccaacgtggagagaaagatcctggacctgtacagcctgagcaagcagtgcaacacccaccccttcgacaacgaggtgaaggacaaggagtacaagccccacagcatccccctgagacagagcgtgcagcccagcaagttcagcagctacagcagaagagccaagagactgcagcccgaccccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaaggagtacgccaccagcggctggaacctgaacgtgatgcccgtgctggaccagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagatgctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgccttccccgagaccctggacctgaacctggccgtggccgtgcacaaggagatgttcatcatggtgcaggaggagagaagactgagaaaggccctgctggagaagggcgtgaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccaccatgctgcacaagctgaagatcagagccgagagcttcgacacctgggccaacaaggtgagagtggccctggaggtggaggacggcagaaagagaagcttcgaggagctgagagccctggagagcgaggccagagagagaagattccccaacagcgagctgctgcagagactgaagaactgcctgagcgaggtggaggcctgcatcgcccaggtgctgggcctggtgagcggccaggtggccagaatggacaccccccagctgaccctgaccgagctgagagtgctgctggagcagatgggcagcctgccctgcgccatgcaccagatcggcgacgtgaaggacgtgctggagcaggtggaggcctaccaggccgaggccagagaggccctggccaccctgcccagcagccccggcctgctgagaagcctgctggagagaggccagcagctgggcgtggaggtgcccgaggcccaccagctgcagcagcaggtggagcaggcccagtggctggacgaggtgaagcaggccctggcccccagcgcccacagaggcagcctggtgatcatgcagggcctgctggtgatgggcgccaagatcgccagcagccccagcgtggacaaggccagagccgagctgcaggagctgctgaccatcgccgagagatgggaggagaaggcccacttctgcctggaggccagacagaagcacccccccgccaccctggaggccatcatcagagagaccgagaacatccccgtgcacctgcccaacatccaggccctgaaggaggccctgaccaaggcccaggcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggccctgggcctgtaccagtgcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggcccccagcctgatggccagcagccccaccagcatctgcgtgtgcggccaggtgcccgccggcgtgggcgtgctgcagtgcgacctgtgccaggactggttccacggccagtgcgtgagcgtgccccacctgctgaccagccccaagcccagcctgaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcggctggcaggacagagccagaaaggccctggccagcgaggacgtgaccgccctgctgagacagctggccgagctgagacagcagctgcaggccaagcccagacccgaggaggccagcgtgtacaccagcgccaccgcctgcgaccccatcagagagggcagcggcaacaacatcagcaaggtgcagggcctgctggagaacggcgacagcgtgaccagccccgagaacatggcccccggcaagggcagcgacctggagctgctgagcagcctgctgccccagctgaccggccccgtgctggagctgcccgaggccatcagagcccccctggaggagctgatgatggagggcgacctgctggaggtgaccctggacgagaaccacagcatctggcagctgctgcaggccggccagccccccgacctggacagaatcagaaccctgctggagctggagaagttcgagcaccagggcagcagaaccagaagcagagccctggagagaagaagaagaagacagaaggtggaccagggcagaaacgtggagaacctggtgcagcaggagctgcagagcaagagagccagaagcagcggcatcatgagccaggtgggcagagaggaggagcactaccaggagaaggccgacagagagaacatgttcctgacccccagcaccgaccacagccccttcctgaagggcaaccagaacagcctgcagcacaaggacagcggcagcagcgccgcctgccccagcctgatgcccctgctgcagctgagctacagcgacgagcagcagctgtag

SEQ ID NO: 87499 - DNA, 882 bp, Artificial Sequence
  Description of Artificial Sequence: Synthetic coding sequence
ctgcccaacatccaggccctgaaggaggccctgaccaaggcccaggcctggatcgccgacgtggacgagatccagaacggcgaccactacccctgcctggacgacctggagggcctggtggccgtgggcagagacctgcccgtgggcctggaggagctgagacagctggagctgcaggtgctgtgcccctgcgccgacgccggcagcgacagcaccaagagaagcagatggatggagaaggccctgggcctgtaccagtgcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggcccccagcctgatggccagcagccccaccagcatctgcgtgtgcggccaggtgcccgccggcgtgggcgtgctgcagtgcgacctgtgccaggactggttccacggccagtgcgtgagcgtgccccacctgctgaccagccccaagcccagcctgaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcggctggcaggacagagccagaaaggccctggccagcgaggacgtgaccgccctgctgagacagctggccgagctgagacagcagctgcaggccaagcccagacccgaggaggccagcgtgtacaccagcgccaccgcctgcgactag

SEQ ID NO: 87500 - DNA, 4431 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggagatcgtgatcgaggagggcggctacgaggccatctgcaaggacagaagatgggccagagtggcccagagactgcactacccccccggcaagaacatcggcagcctgctgagaagccactacgagagaatcatctacccctacgagatgttccagagcggcgccaaccacgtgcagtgcaacacccaccccttcgacaacgaggtgaaggacaaggagtacaagccccacagcatccccctgagacagagcgtgcagcccagcaagttcagcagctacagcagaagagccaagagactgcagcccgaccccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaaggagtacgccaccagcggctggaacctgaacgtgatgcccgtgctggaccagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagatgctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgccttccccgagaccctggacctgaacctggccgtggccgtgcacaaggagatgttcatcatggtgcaggaggagagaagactgagaaaggccctgctggagaagggcgtgaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccaccatgctgcacaagctgaagatcagagccgagagcttcgacacctgggccaacaaggtgagagtggccctggaggtggaggacggcagaaagagaagcttcgaggagctgagagccctggagagcgaggccagagagagaagattccccaacagcgagctgctgcagagactgaagaactgcctgagcgaggtggaggcctgcatcgcccaggtgctgggcctggtgagcggccaggtggccagaatggacaccccccagctgaccctgaccgagctgagagtgctgctggagcagatgggcagcctgccctgcgccatgcaccagatcggcgacgtgaaggacgtgctggagcaggtggaggcctaccaggccgaggccagagaggccctggccaccctgcccagcagccccggcctgctgagaagcctgctggagagaggccagcagctgggcgtggaggtgcccgaggcccaccagctgcagcagcaggtggagcaggcccagtggctggacgaggtgaagcaggccctggcccccagcgcccacagaggcagcctggtgatcatgcagggcctgctggtgatgggcgccaagatcgccagcagccccagcgtggacaaggccagagccgagctgcaggagctgctgaccatcgccgagagatgggaggagaaggcccacttctgcctggaggccagacagaagcacccccccgccaccctggaggccatcatcagagagaccgagaacatccccgtgcacctgcccaacatccaggccctgaaggaggccctgaccaaggcccaggcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggccctgggcctgtaccagtgcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggcccccagcctgatggccagcagccccaccagcatctgcgtgtgcggccaggtgcccgccggcgtgggcgtgctgcagtgcgacctgtgccaggactggttccacggccagtgcgtgagcgtgccccacctgctgaccagccccaagcccagcctgaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcggctggcaggacagagccagaaaggccctggccagcgaggacgtgaccgccctgctgagacagctggccgagctgagacagcagctgcaggccaagcccagacccgaggaggccagcgtgtacaccagcgccaccgcctgcgaccccatcagagagggcagcggcaacaacatcagcaaggtgcagggcctgctggagaacggcgacagcgtgaccagccccgagaacatggcccccggcaagggcagcgacctggagctgctgagcagcctgctgccccagctgaccggccccgtgctggagctgcccgaggccatcagagcccccctggaggagctgatgatggagggcgacctgctggaggtgaccctggacgagaaccacagcatctggcagctgctgcaggccggccagccccccgacctggacagaatcagaaccctgctggagctggagaagttcgagcaccagggcagcagaaccagaagcagagccctggagagaagaagaagaagacagaaggtggaccagggcagaaacgtggagaacctggtgcagcaggagctgcagagcaagagagccagaagcagcggcatcatgagccaggtgggcagagaggaggagcactaccaggagaaggccgacagagagaacatgttcctgacccccagcaccgaccacagccccttcctgaagggcaaccagaacagcctgcagcacaaggacagcggctag

SEQ ID NO: 87501 - DNA, 1278 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggaggcccagaccagagtgaagctgaactacctggaccagatcgccaagttctgggagatccagggcagcagcctgaagatccccaacgtggagagaaagatcctggacctgtacagcctgagcaagatcgtgatcgaggagggcggctacgaggccatctgcaaggacagaagatgggccagagtggcccagagactgcactacccccccggcaagaacatcggcagcctgctgagaagccactacgagagaatcatctacccctacgagatgttccagagcggcgccaaccacgtgcccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaaggagtacgccaccagcggctggaacctgaacgtgatgccctag

SEQ ID NO: 87502 - DNA, 2667 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggaggcccagaccagagtgaagctgaactacctggaccagatcgccaagttctgggagatccagggcagcagcctgaagatccccaacgtggagagaaagatcctggacctgtacagcctgagcaagatcgtgatcgaggagggcggctacgaggccatctgcaaggacagaagatgggccagagtggcccagagactgcactacccccccggcaagaacatcggcagcctgctgagaagccactacgagagaatcatctacccctacgagatgttccagagcggcgccaaccacgtgcagtgcaacacccaccccttcgacaacgaggtgaaggacaaggagtacaagccccacagcatccccctgagacagagcgtgcagcccagcaagttcagcagctacagcagaagagccaagagactgcagcccgaccccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaaggagtacgccaccagcggctggaacctgaacgtgatgcccgtgctggaccagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagatgctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgccttccccgagaccctggacctgaacctggccgtggccgtgcacaaggagatgttcatcatggtgcaggaggagagaagactgagaaaggccctgctggagaagggcgtgaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccaccatgctgcacaagctgaagatcagagccgagagcttcgacacctgggccaacaaggtgagagtggccctggaggtggaggacggcagaaagagaagcttcgaggagctgagagccctggagagcgaggccagagagagaagattccccaacagcgagctgctgcagagactgaagaactgcctgagcgaggtggaggcctgcatcgcccaggtgctgggcctggtgagcggccaggtggccagaatggacaccccccagctgaccctgaccgagctgagagtgctgctggagcagatgggcagcctgccctgcgccatgcaccagatcggcgacgtgaaggtgctgagctggaagtggagaagatacgtgttcccctaccacctgtgcgtgtacagcatgcagggcaacatcctgcccgactag

SEQ ID NO: 87503 - DNA, 4713 bp, Artificial Sequence
  Description of Artificial Sequence: Synthetic coding sequence
atggagcccggctgcgacgagttcctgcccccccccgagtgccccgtgttcgagcccagctgggccgagttccaggaccccctgggctacatcgccaagatcagacccatcgccgagaagagcggcatctgcaagatcagaccccccgccgactggcagccccccttcgccgtggaggtggacaacttcagattcacccccagagtgcagagactgaacgagctggaggcccagaccagagtgaagctgaactacctggaccagatcgccaagttctgggagatccagggcagcagcctgaagatccccaacgtggagagaaagatcctggacctgtacagcctgagcaagatcgtgatcgaggagggcggctacgaggccatctgcaaggacagaagatgggccagagtggcccagagactgcactacccccccggcaagaacatcggcagcctgctgagaagccactacgagagaatcatctacccctacgagatgttccagagcggcgccaaccacgtgcagtgcaacacccaccccttcgacaacgaggtgaaggacaaggagtacaagccccacagcatccccctgagacagagcgtgcagcccagcaagttcagcagctacagcagaagagccaagagactgcagcccgaccccgagcccaccgaggaggacatcgagaagcaccccgagctgaagaagctgcagatctacggccccggccccaagatgatgggcctgggcctgatggccaaggacaaggacaagaccgtgcacaagaaggtgacctgcccccccaccgtgaccgtgaaggacgagcagagcggcggcggcaacgtgagcagcaccctgctgaagcagcacctgagcctggagccctgcaccaagaccaccatgcagctgagaaagaaccacagcagcgcccagttcatcgacagctacatctgccaggtgtgcagcagaggcgacgaggacgacaagctgctgttctgcgacggctgcgacgacaactaccacatcttctgcctgctgccccccctgcccgagatccccagaggcatctggagatgccccaagtgcatcctggccgagtgcaagcagccccccgaggccttcggcttcgagcaggccacccaggagtacagcctgcagagcttcggcgagatggccgacagcttcaagagcgactacttcaacatgcccgtgcacatggtgcccaccgagctggtggagaaggagttctggagactggtgagcagcatcgaggaggacgtgaccgtggagtacggcgccgacatccacagcaaggagttcggcagcggcttccccgtgagcaacagcaagcagaacctgagccccgaggagaagagacagagcctgaccgtgctgaccagactgatcagcagcttctgggcccaggccgtgctgcccccctggccccccaaggtgctgggcctgcaggagtacgccaccagcggctggaacctgaacgtgatgcccgtgctggaccagagcgtgctgtgccacatcaacgccgacatcagcggcatgaaggtgccctggctgtacgtgggcatggtgttcagcgccttctgctggcacatcgaggaccactggagctacagcatcaactacctgcactggggcgagcccaagacctggtacggcgtgcccagcctggccgccgagcacctggaggaggtgatgaagatgctgacccccgagctgttcgacagccagcccgacctgctgcaccagctggtgaccctgatgaaccccaacaccctgatgagccacggcgtgcccgtggtgagaaccaaccagtgcgccggcgagttcgtgatcaccttccccagagcctaccacagcggcttcaaccagggctacaacttcgccgaggccgtgaacttctgcaccgccgactggctgcccgccggcagacagtgcatcgagcactacagaagactgagaagatactgcgtgttcagccacgaggagctgatctgcaagatggccgccttccccgagaccctggacctgaacctggccgtggccgtgcacaaggagatgttcatcatggtgcaggaggagagaagactgagaaaggccctgctggagaagggcgtgaccgaggccgagagagaggccttcgagctgctgcccgacgacgagagacagtgcatcaagtgcaagaccacctgcttcctgagcgccctggcctgctacgactgccccgacggcctggtgtgcctgagccacatcaacgacctgtgcaagtgcagcagcagcagacagtacctgagatacagatacaccctggacgagctgcccaccatgctgcacaagctgaagatcagagccgagagcttcgacacctgggccaacaaggtgagagtggccctggaggtggaggacggcagaaagagaagcttcgaggagctgagagccctggagagcgaggccagagagagaagattccccaacagcgagctgctgcagagactgaagaactgcctgagcgaggtggaggcctgcatcgcccaggtgctgggcctggtgagcggccaggtggccagaatggacaccccccagctgaccctgaccgagctgagagtgctgctggagcagatgggcagcctgccctgcgccatgcaccagatcggcgacgtgaaggacgtgctggagcaggtggaggcctaccaggccgaggccagagaggccctggccaccctgcccagcagccccggcctgctgagaagcctgctggagagaggccagcagctgggcgtggaggtgcccgaggcccaccagctgcagcagcaggtggagcaggcccagtggctggacgaggtgaagcaggccctggcccccagcgcccacagaggcagcctggtgatcatgcagggcctgctggtgatgggcgccaagatcgccagcagccccagcgtggacaaggccagagccgagctgcaggagctgctgaccatcgccgagagatgggaggagaaggcccacttctgcctggaggccagacagaagcacccccccgccaccctggaggccatcatcagagagaccgagaacatccccgtgcacctgcccaacatccaggccctgaaggaggccctgaccaaggcccaggcctggatcgccgacgtggacgagatccagaacggcgaccactacccctgcctggacgacctggagggcctggtggccgtgggcagagacctgcccgtgggcctggaggagctgagacagctggagctgcaggtgctgaccgcccacagctggagagagaaggccagcaagaccttcctgaagaagaacagctgctacaccctgctggaggtgctgtgcccctgcgccgacgccggcagcgacagcaccaagagaagcagatggatggagaaggccctgggcctgtaccagtgcgacaccgagctgctgggcctgagcgcccaggacctgagagaccccggcagcgtgatcgtggccttcaaggagggcgagcagaaggagaaggagggcatcctgcagctgagaagaaccaacagcgccaagcccagccccctggcccccagcctgatggccagcagccccaccagcatctgcgtgtgcggccaggtgcccgccggcgtgggcgtgctgcagtgcgacctgtgccaggactggttccacggccagtgcgtgagcgtgccccacctgctgaccagccccaagcccagcctgaccagcagccccctgctggcctggtgggagtgggacaccaagttcctgtgccccctgtgcatgagaagcagaagacccagactggagaccatcctggccctgctggtggccctgcagagactgcccgtgagactgcccgagggcgaggccctgcagtgcctgaccgagagagccatcggctggcaggacagagccagaaaggccctggccagcgaggacgtgaccgccctgctgagacagctggccgagctgagacagcagctgcaggccaagcccagacccgaggaggccagcgtgtacaccagcgccaccgcctgcgaccccatcagagagggcagcggcaacaacatcagcaaggtgcagggcctgctggagaacggcgacagcgtgaccagccccgagaacatggcccccggcaagggcagcgacctggagctgctgagcagcctgctgccccagctgaccggccccgtgctggagctgcccgaggccatcagagcccccctggaggagctgatgatggagggcgacctgctggaggtgaccctggacgagaaccacagcatctggcagctgctgcaggccggccagccccccgacctggacagaatcagaaccctgctggagctggagaagttcgagcaccagggcagcagaaccagaagcagagccctggagagaagaagaagaagacagaaggtggaccagggcagaaacgtggagaacctggtgcagcaggagctgcagagcaagagagccagaagcagcggcatcatgagccaggtgggcagagaggaggagcactaccaggagaaggccgacagagagaacatgttcctgacccccagcaccgaccacagccccttcctgaagggcaaccagaacagcctgcagcacaaggacagcggcagcagcgccgcctgccccagcctgatgcccctgctgcagctgagctacagcgacgagcagcagctgtag

SEQ ID NO: 87504 - DNA, 3297 bp, Artificial Sequence
  Description of Artificial Sequence: Synthetic coding sequence
atggacctgggcaccctgtacgagagctgcaaccagccccaggacgccatcaagtgctacctgaacgccaccagaagcaagagctgcagcaacaccagcgccctggccgccagaatcaagtacctgcaggcccagctgtgcaacctgccccagggcagcctgcagaacaagaccaagctgctgcccagcatcgaggaggcctggagcctgcccatccccgccgagctgaccagcagacagggcgccatgaacaccgcccagcaggcctgcaagccccaccaccccaacaccgagcccgtgctgggcctgagccagacccccatcagccagcagagcctgcccctgcacatgatccccagcagccaggtggacgacctgagcagccccgccaagagaaagagaaccagcagccccaccaagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87505 - DNA, 4206 bp, Artificial Sequence
  Description of Artificial Sequence: Synthetic coding sequence
atgaagagctgcggcgtgagcctggccaccgccgccgccgccgccgccgccttcggcgacgaggagaagaagatggccgccggcaaggccagcggcgagagcgaggaggccagccccagcctgaccgccgaggagagagaggccctgggcggcctggacagcagactgttcggcttcgtgagattccacgaggacggcgccagaaccaaggccctgctgggcaaggccgtgagatgctacgagagcctgatcctgaaggccgagggcaaggtggagagcgacttcttctgccagctgggccacttcaacctgctgctggaggactaccccaaggccctgagcgcctaccagagatactacagcctgcagagcgactactggaagaacgccgccttcctgtacggcctgggcctggtgtacttccactacaacgccttccagtgggccatcaaggccttccaggaggtgctgtacgtggaccccagcttctgcagagccaaggagatccacctgagactgggcctgatgttcaaggtgaacaccgactacgagagcagcctgaagcacttccagctggccctggtggactgcaacccctgcaccctgagcaacgccgagatccagttccacatcgcccacctgtacgagacccagagaaagtaccacagcgccaaggaggcctacgagcagctgctgcagaccgagaacctgagcgcccaggtgaaggccaccgtgctgcagcagctgggctggatgcaccacaccgtggacctgctgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccaccagaagcaagagctgcagcaacaccagcgccctggccgccagaatcaagtacctgcaggcccagctgtgcaacctgccccagggcagcctgcagaacaagaccaagctgctgcccagcatcgaggaggcctggagcctgcccatccccgccgagctgaccagcagacagggcgccatgaacaccgcccagcagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87506 - DNA, 4227 bp, Artificial Sequence
  Description of Artificial Sequence: Synthetic coding sequence
atgaagagctgcggcgtgagcctggccaccgccgccgccgccgccgccgccttcggcgacgaggagaagaagatggccgccggcaaggccagcggcgagagcgaggaggccagccccagcctgaccgccgaggagagagaggccctgggcggcctggacagcagactgttcggcttcgtgagattccacgaggacggcgccagaaccaaggccctgctgggcaaggccgtgagatgctacgagagcctgatcctgaaggccgagggcaaggtggagagcgacttcttctgccagctgggccacttcaacctgctgctggaggactaccccaaggccctgagcgcctaccagagatactacagcctgcagagcgactactggaagaacgccgccttcctgtacggcctgggcctggtgtacttccactacaacgccttccagtgggccatcaaggccttccaggaggtgctgtacgtggaccccagcttctgcagagccaaggagatccacctgagactgggcctgatgttcaaggtgaacaccgactacgagagcagcctgaagcacttccagctggccctggtggactgcaacccctgcaccctgagcaacgccgagatccagttccacatcgcccacctgtacgagacccagagaaagtaccacagcgccaaggaggcctacgagcagctgctgcagaccgagaacctgagcgcccaggtgaaggccaccgtgctgcagcagctgggctggatgcaccacaccgtggacctgctgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccaccagaagcaagagctgcagcaacaccagcgccctggccgccagaatcaagtacctgcaggcctgcaagccccaccaccccaacaccgagcccgtgctgggcctgagccagacccccatcagccagcagagcctgcccctgcacatgatccccagcagccaggtggacgacctgagcagccccgccaagagaaagagaaccagcagccccaccaagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87507 - DNA, 3000 bp, Artificial Sequence
  Description of Artificial Sequence: Synthetic coding sequence
tgaggcaccctgtacgagagctgcaaccagccccaggacgccatcaagtgctacctgaacgccaccagaagcaagagctgcagcaacaccagcgccctggccgccagaatcaagtacctgcagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87508 - DNA, 486 bp, Artificial Sequence
  Description of Artificial Sequence: Synthetic coding sequence
tgagccagaaacatcaaggtgagcgaccccaagctgttcgagatgatcaagatcttcagcctgagccccaacttcagagccgagaagtgcctgagagaccacctggtgcagcccctgagaagcaacggcgagcccgagcccctgagattcaccggcgagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87509 - DNA, 3135 bp, Artificial Sequence
  Description of Artificial Sequence: Synthetic coding sequence
tgaaacaagaccaagctgctgcccagcatcgaggaggcctggagcctgcccatccccgccgagctgaccagcagacagggcgccatgaacaccgcccagcaggcctgcaagccccaccaccccaacaccgagcccgtgctgggcctgagccagacccccatcagccagcagagcctgcccctgcacatgatccccagcagccaggtggacgacctgagcagccccgccaagagaaagagaaccagcagccccaccaagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87510 - DNA, 675 bp, Artificial Sequence
  Description of Artificial Sequence: Synthetic coding sequence
tgactgcaggcctacatctgcgccgtgcagctggaccacggccacgccgccgcctggatggacctgggcaccctgtacgagagctgcaaccagccccaggacgccatcaagtgctacctgaacgccaccagaagcaagagctgcagcaacaccagcgccctggccgccagaatcaagtacctgcaggcccagctgtgcaacctgccccagggcagcctgcagaacaagaccaagctgctgcccagcatcgaggaggcctggagcctgcccatccccgccgagctgaccagcagacagggcgccatgaacaccgcccagcagaacaccagcgacaactggagcggcggccacgccgtgagccacccccccgtgcagcagcaggcccacagctggtgcctgaccccccagaagctgcagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggctag

SEQ ID NO: 87511 - DNA, 516 bp, Artificial Sequence
  Description of Artificial Sequence: Synthetic coding sequence
agcctgcagaacaagaccaagctgctgcccagcatcgaggaggcctggagcctgcccatccccgccgagctgaccagcagacagggcgccatgaacaccgcccagcagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttctgcagaccctgcagcctgtag

SEQ ID NO: 87512 - DNA, 4071 bp, Artificial Sequence
  Description of Artificial Sequence: Synthetic coding sequence
atgaagagctgcggcgtgagcctggccaccgccgccgccgccgccgccgccttcggcgacgaggagaagaagatggccgccggcaaggccagcggcgagagcgaggaggccagccccagcctgaccgccgaggagagagaggccctgggcggcctggacagcagactgttcggcttcgtgagattccacgaggacggcgccagaaccaaggccctgctgggcaaggccgtgagatgctacgagagcctgatcctgaaggccgagggcaaggtggagagcgacttcttctgccagctgggccacttcaacctgctgctggaggactaccccaaggccctgagcgcctaccagagatactacagcctgcagagcgactactggaagaacgccgccttcctgtacggcctgggcctggtgtacttccactacaacgccttccagtgggccatcaaggccttccaggaggtgctgtacgtggaccccagcttctgcagagccaaggagatccacctgagactgggcctgatgttcaaggtgaacaccgactacgagagcagcctgaagcacttccagctggccctggtggactgcaacccctgcaccctgagcaacgccgagatccagttccacatcgcccacctgtacgagacccagagaaagtaccacagcgccaaggaggcctacgagcagctgctgcagaccgagaacctgagcgcccaggtgaaggccaccgtgctgcagcagctgggctggatgcaccacaccgtggacctgctgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccaccagaagcaagagctgcagcaacaccagcgccctggccgccagaatcaagtacctgcagaacaccagcgacaactggagcggcggccacgccgtgagccacccccccgtgcagcagcaggcccacagctggtgcctgaccccccagaagctgcagcacctggagcagctgagagccaacagaaacaacctgaaccccgcccagaagctgatgctggagcagctggagagccagttcgtgctgatgcagcagcaccagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87513 - DNA, 675 bp, Artificial Sequence
  Description of Artificial Sequence: Synthetic coding sequence
atgaagagctgcggcgtgagcctggccaccgccgccgccgccgccgccgccttcggcgacgaggagaagaagatggccgccggcaaggccagcggcgagagcgaggaggccagccccagcctgaccgccgaggagagagaggccctgggcggcctggacagcagactgttcggcttcgtgagattccacgaggacggcgccagaaccaaggccctgctgggcaaggccgtgagatgctacgagagcctgatcctgaaggccgagggcaaggtggagagcgacttcttctgccagctgggccacttcaacctgctgctggaggactaccccaaggccctgagcgcctaccagagatactacagcctgcagagcgactactggaagaacgccgccttcctgtacggcctgggcctggtgtacttccactacaacgccttccagtgggccatcaaggccttccaggaggtgctgtacgtggaccccagcttctgcagagccaaggagatccacctgagactgggcctgatgttcaaggtgaacaccgactacgagagcagcctgaagcacttccagctggccctggtggactgcaacccctgcaccctgagcaacgccgagatccagttccacatcgcccacctgtacgagacccaggtgggctgcatcaccctgtag

SEQ ID NO: 87514 - DNA, 3969 bp, Artificial Sequence
  Description of Artificial Sequence: Synthetic coding sequence
atgaagagctgcggcgtgagcctggccaccgccgccgccgccgccgccgccttcggcgacgaggagaagaagatggccgccggcaaggccagcggcgagagcgaggaggccagccccagcctgaccgccgaggagagagaggccctgggcggcctggacagcagactgttcggcttcgtgagattccacgaggacggcgccagaaccaaggccctgctgggcaaggccgtgagatgctacgagagcctgatcctgaaggccgagggcaaggtggagagcgacttcttctgccagctgggccacttcaacctgctgctggaggactaccccaaggccctgagcgcctaccagagatactacagcctgcagagcgactactggaagaacgccgccttcctgtacggcctgggcctggtgtacttccactacaacgccttccagtgggccatcaaggccttccaggaggtgctgtacgtggaccccagcttctgcagagccaaggagatccacctgagactgggcctgatgttcaaggtgaacaccgactacgagagcagcctgaagcacttccagctggccctggtggactgcaacccctgcaccctgagcaacgccgagatccagttccacatcgcccacctgtacgagacccagagaaagtaccacagcgccaaggaggcctacgagcagctgctgcagaccgagaacctgagcgcccaggtgaaggccaccgtgctgcagcagctgggctggatgcaccacaccgtggacctgctgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccaccagaagcaagagctgcagcaacaccagcgccctggccgccagaatcaagtacctgcagaacaccagcgacaactggagcggcggccacgccgtgagccacccccccgtgcagcagcaggcccacagctggtgcctgaccccccagaagctgcagatgagacccaccggcgtggcccaggtgagaagcaccggcatccccaacggccccaccgccgacagcagcctgcccaccaacagcgtgagcggccagcagccccagctggccctgaccagagtgcccagcgtgagccagcccggcgtgagacccgcctgccccggccagcccctggccaacggccccttcagcgccggccacgtgccctgcagcaccagcagaaccctgggcagcaccgacaccatcctgatcggcaacaaccacatcaccggcagcggcagcaacggcaacgtgccctacctgcagagaaacgccctgaccctgccccacaacagaaccaacctgaccagcagcgccgaggagccctggaagaaccagctgagcaacagcacccagggcctgcacaagggccagagcagccacagcgccggccccaacggcgagagacccctgagcagcaccggccccagccagcacctgcaggccgccggcagcggcatccagaaccagaacggccaccccaccctgcccagcaacagcgtgacccagggcgccgccctgaaccacctgagcagccacaccgccaccagcggcggccagcagggcatcaccctgaccaaggagagcaagcccagcggcaacatcctgaccgtgcccgagaccagcagacacaccggcgagacccccaacagcaccgccagcgtggagggcctgcccaaccacgtgcaccagatgaccgccgacgccgtgtgcagccccagccacggcgacagcaagagccccggcctgctgagcagcgacaacccccagctgagcgccctgctgatgggcaaggccaacaacaacgtgggcaccggcacctgcgacaaggtgaacaacatccaccccgccgtgcacaccaagaccgacaacagcgtggccagcagccccagcagcgccatcagcaccgccacccccagccccaagagcaccgagcagaccaccaccaacagcgtgaccagcctgaacagcccccacagcggcctgcacaccatcaacggcgagggcatggaggagagccagagccccatgaagaccgacctgctgctggtgaaccacaagcccagcccccagatcatccccagcatgagcgtgagcatctaccccagcagcgccgaggtgctgaaggcctgcagaaacctgggcaagaacggcctgagcaacagcagcatcctgctggacaagtgccccccccccagaccccccagcagcccctacccccccctgcccaaggacaagctgaacccccccacccccagcatctacctggagaacaagagagacgccttcttcccccccctgcaccagttctgcaccaaccccaacaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggcactgcgagagcaacagaagccacaccaccatcgccaagtacgcccagtaccaggccagcagcttccaggagagcctgagagaggagaacgagaagagaagccaccacaaggaccacagcgacagcgagagcaccagcagcgacaacagcggcagaagaagaaagggccccttcaagaccatcaagttcggcaccaacatcgacctgagcgacgacaagaagtggaagctgcagctgcacgagctgaccaagctgcccgccttcgtgagagtggtgagcgccggcaacctgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgagggctactggggcgtgctgaacgacttctgcgagaagaacaacctgaacttcctgatgggcagctggtggcccaacctggaggacctgtacgaggccaacgtgcccgtgtacagattcatccagagacccggcgacctggtgtggatcaacgccggcaccgtgcactgggtgcaggccatcggctggtgcaacaacatcgcctggaacgtgggccccctgaccgcctgccagtacaagctggccgtggagagatacgagtggaacaagctgcagagcgtgaagagcatcgtgcccatggtgcacctgagctggaacatggccagaaacatcaaggtgagcgaccccaagctgttcgagatgatcaagtactgcctgctgagaaccctgaagcagtgccagaccctgagagaggccctgatcgccgccggcaaggagatcatctggcacggcagaaccaaggaggagcccgcccactactgcagcatctgcgaggtggaggtgttcgacctgctgttcgtgaccaacgagagcaacagcagaaagacctacatcgtgcactgccaggactgcgccagaaagaccagcggcaacctggagaacttcgtggtgctggagcagtacaagatggaggacctgatgcaggtgtacgaccagttcaccctggccccccccctgcccagcgccagcagctag

SEQ ID NO: 87515 - DNA, 5049 bp, Artificial Sequence
  Description of Artificial Sequence: Synthetic coding sequence
atgcacagagccgtggacccccccggcgccagagccgccagagaggccttcgccctgggcggcctgagctgcgccggcgcctggagcagctgccccccccaccccccccccagaagcgcctggctgcccggcggcagatgcagcgccagcatcggccagccccccctgcccgcccccctgccccccagccacggcagcagcagcggccaccccagcaagccctactacgcccccggcgcccccacccccagacccctgcacggcaagctggagagcctgcacggctgcgtgcaggccctgctgagagagcccgcccagcccggcctgtgggagcagctgggccagctgtacgagagcgagcacgacagcgaggaggccaccagatgctaccacagcgccctgagatacggcggcagcttcgccgagctgggccccagaatcggcagactgcagcaggcccagctgtggaacttccacaccggcagctgccagcacagagccaaggtgctgccccccctggagcaggtgtggaacctgctgcacctggagcacaagagaaactacggcgccaagagaggcggcccccccgtgaagagagccgccgagccccccgtggtgcagcccgtgccccccgccgccctgagcggccccagcggcgaggagggcctgagccccggcggcaagagaagaagaggctgcaacagcgagcagaccggcctgccccccggcctgcccctgccccccccccccctgcccccccccccccccccccccccccccccccccccccccctgcccggcctggccaccagcccccccttccagctgaccaagcccggcctgtggagcaccctgcacggcgacgcctggggccccgagagaaagggcagcgccccccccgagagacaggagcagagacacagcctgccccacccctacccctaccccgcccccgcctacaccgcccacccccccggccacagactggtgcccgccgccccccccggccccggccccagaccccccggcgccgagagccacggctgcctgcccgccaccagaccccccggcagcgacctgagagagagcagagtgcagagaagcagaatggacagcagcgtgagccccgccgccaccaccgcctgcgtgccctacgcccccagcagaccccccggcctgcccggcaccaccaccagcagcagcagcagcagcagcagcaacaccggcctgagaggcgtggagcccaaccccggcatccccggcgccgaccactaccagacccccgccctggaggtgagccaccacggcagactgggccccagcgcccacagcagcagaaagcccttcctgggcgcccccgccgccaccccccacctgagcctgccccccggccccagcagcccccccccccccccctgccccagactgctgagacccccccccccccccgcctggctgaagggccccgcctgcagagccgccagagaggacggcgagatcctggaggagctgttcttcggcaccgagggcccccccagacccgcccccccccccctgccccacagagagggcttcctgggcccccccgccagcagattcagcgtgggcacccaggacagccacaccccccccaccccccccacccccaccaccagcagcagcaacagcaacagcggcagccacagcagcagccccgccggccccgtgagcttccccccccccccctacctggccagaagcatcgaccccctgcccagaccccccagccccgcccagaacccccaggacccccccctggtgcccctgaccctggccctgccccccgccccccccagcagctgccaccagaacaccagcggcagcttcagaagacccgagagccccagacccagagtgagcttccccaagacccccgaggtgggccccggccccccccccggccccctgagcaaggccccccagcccgtgccccccggcgtgggcgagctgcccgccagaggccccagactgttcgacttcccccccacccccctggaggaccagttcgaggagcccgccgagttcaagatcctgcccgacggcctggccaacatcatgaagatgctggacgagagcatcagaaaggaggaggagcagcagcagcacgaggccggcgtggccccccagccccccctgaaggagcccttcgccagcctgcagagccccttccccaccgacaccgcccccaccaccaccgcccccgccgtggccgtgaccaccaccaccaccaccaccaccaccaccaccgccacccaggaggaggagaagaagcccccccccgccctgcccccccccccccccctggccaagttccccccccccagccagccccagcccccccccccccccccccccagccccgccagcctgctgaagagcctggccagcgtgctggagggccagaagtactgctacagaggcaccggcgccgccgtgagcaccagacccggccccctgcccaccacccagtacagccccggcccccccagcggcgccaccgccctgccccccaccagcgccgcccccagcgcccagggcagcccccagcccagcgccagcagcagcagccagttcagcaccagcggcggcccctgggccagagagagaagagccggcgaggagcccgtgcccggccccatgacccccacccagccccccccccccctgagcctgccccccgccagaagcgagagcgaggtgctggaggagatcagcagagcctgcgagaccctggtggagagagtgggcagaagcgccaccgaccccgccgaccccgtggacaccgccgagcccgccgacagcggcaccgagagactgctgccccccgcccaggccaaggaggaggccggcggcgtggccgccgtgagcggcagctgcaagagaagacagaaggagcaccagaaggagcacagaagacacagaagagcctgcaaggacagcgtgggcagaagacccagagagggcagagccaaggccaaggccaaggtgcccaaggagaagagcagaagagtgctgggcaacctggacctgcagagcgaggagatccagggcagagagaagagcagacccgacctgggcggcgccagcaaggccaagccccccaccgcccccgccccccccagcgcccccgcccccagcgcccagcccaccccccccagcgccagcgtgcccggcaagaaggccagagaggaggcccccggcccccccggcgtgagcagagccgacatgctgaagctgagaagcctgagcgagggcccccccaaggagctgaagatcagactgatcaaggtggagagcggcgacaaggagaccttcatcgccagcgaggtggaggagagaagactgagaatggccgacctgaccatcagccactgcgccgccgacgtggtgagagccagcagaaacgccaaggtgaagggcaagttcagagagagctacctgagccccgcccagagcgtgaagcccaagatcaacaccgaggagaagctgcccagagagaagctgaacccccccacccccagcatctacctggagagcaagagagacgccttcagccccgtgctgctgcagttctgcaccgaccccagaaaccccatcaccgtgatcagaggcctggccggcagcctgagactgaacctgggcctgttcagcaccaagaccctggtggaggccagcggcgagcacaccgtggaggtgagaacccaggtgcagcagcccagcgacgagaactgggacctgaccggcaccagacagatctggccctgcgagagcagcagaagccacaccaccatcgccaagtacgcccagtaccaggccagcagcttccaggagagcctgcaggaggagaaggagagcgaggacgaggagagcgaggagcccgacagcaccaccggcaccccccccagcagcgcccccgaccccaagaaccaccacatcatcaagttcggcaccaacatcgacctgagcgacgccaagagatggaagccccagctgcaggagctgctgaagctgcccgccttcatgagagtgaccagcaccggcaacatgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgccgtgcacgagcactactgggagaccatcagcgccttctgcgacagacacggcgtggactacctgaccggcagctggtggcccatcctggacgacctgtacgccagcaacatccccgtgtacagattcgtgcagagacccggcgacctggtgtggatcaacgccggcaccgtgcactgggtgcaggccaccggctggtgcaacaacatcgcctggaacgtgggccccctgaccgcctaccagtaccagctggccctggagagatacgagtggaacgaggtgaagaacgtgaagagcatcgtgcccatgatccacgtgagctggaacgtggccagaaccgtgaagatcagcgaccccgacctgttcaagatgatcaagttctgcctgctgcagagcatgaagcactgccaggtgcagagagagagcctggtgagagccggcaagaagatcgcctaccagggcagagtgaaggacgagcccgcctactactgcaacgagtgcgacgtggaggtgttcaacatcctgttcgtgaccagcgagaacggcagcagaaacacctacctggtgcactgcgagggctgcgccagaagaagaagcgccggcctgcagggcgtggtggtgctggagcagtacagaaccgaggagctggcccaggcctacgacgccttcaccctggtgagagccagaagagccagaggccagagaagaagagccctgggccaggccgccggcaccggcttcggcagccccgccgcccccttccccgagcccccccccgccttcagcccccaggcccccgccagcaccagcagatag

SEQ ID NO: 87516 - DNA, 4932 bp, Artificial Sequence
  Description of Artificial Sequence: Synthetic coding sequence
atgcacagagccgtggacccccccggcgccagagccgccagagaggccttcgccctgggcggcctgagctgcgccggcgcctggagcagctgccccccccaccccccccccagaagcgcctggctgcccggcggcagatgcagcgccagcatcggccagccccccctgcccgcccccctgccccccagccacggcagcagcagcggccaccccagcaagccctactacgcccccggcgcccccacccccagacccctgcacggcaagctggagagcctgcacggctgcgtgcaggccctgctgagagagcccgcccagcccggcctgtgggagcagctgggccagctgtacgagagcgagcacgacagcgaggaggccaccagatgctaccacagcgccctgagatacggcggcagcttcgccgagctgggccccagaatcggcagactgcagcaggcccagctgtggaacttccacaccggcagctgccagcacagagccaaggtgctgccccccctggagcaggtgtggaacctgctgcacctggagcacaagagaaactacggcgccaagagaggcggcccccccgtgaagagagccgccgagccccccgtggtgcagcccgtgccccccgccgccctgagcggccccagcggcgaggagggcctgagccccggcggcaagagaagaagaggctgcaacagcgagcagaccggcctgccccccggcctgcccctgccccccccccccctgcccccccccccccccccccccccccccccccccccccccctgcccggcctggccaccagcccccccttccagctgaccaagcccggcctgtggagcaccctgcacggcgacgcctggggccccgagagaaagggcagcgccccccccgagagacaggagcagagacacagcctgccccacccctacccctaccccgcccccgcctacaccgcccacccccccggccacagactggtgcccgccgccccccccggccccggccccagaccccccggcgccgagagccacggctgcctgcccgccaccagaccccccggcagcgacctgagagagagcagagtgcagagaagcagaatggacagcagcgtgagccccgccgccaccaccgcctgcgtgccctacgcccccagcagaccccccggcctgcccggcaccaccaccagcagcagcagcagcagcagcagcaacaccggcctgagaggcgtggagcccaaccccggcatccccggcgccgaccactaccagacccccgccctggaggtgagccaccacggcagactgggccccagcgcccacagcagcagaaagcccttcctgggcgcccccgccgccaccccccacctgagcctgccccccggccccagcagcccccccccccccccctgccccagactgctgagacccccccccccccccgcctggctgaagggccccgcctgcagagccgccagagaggacggcgagatcctggaggagctgttcttcggcaccgagggcccccccagacccgcccccccccccctgccccacagagagggcttcctgggcccccccgccagcagattcagcgtgggcacccaggacagccacaccccccccaccccccccacccccaccaccagcagcagcaacagcaacagcggcagccacagcagcagccccgccggccccgtgagcttccccccccccccctacctggccagaagcatcgaccccctgcccagaccccccagccccgcccagaacccccaggacccccccctggtgcccctgaccctggccctgccccccgccccccccagcagctgccaccagaacaccagcggcagcttcagaagacccgagagccccagacccagagtgagcttccccaagacccccgaggtgggccccggccccccccccggccccctgagcaaggccccccagcccgtgccccccggcgtgggcgagctgcccgccagaggccccagactgttcgacttcccccccacccccctggaggaccagttcgaggagcccgccgagttcaagatcctgcccgacggcctggccaacatcatgaagatgctggacgagagcatcagaaaggaggaggagcagcagcagcacgaggccggcgtggccccccagccccccctgaaggagcccttcgccagcctgcagagccccttccccaccgacaccgcccccaccaccaccgcccccgccgtggccgtgaccaccaccaccaccaccaccaccaccaccaccgccacccaggaggaggagaagaagcccccccccgccctgcccccccccccccccctggccaagttccccccccccagccagccccagcccccccccccccccccccccagccccgccagcctgctgaagagcctggccagcgtgctggagggccagaagtactgctacagaggcaccggcgccgccgtgagcaccagacccggccccctgcccaccacccagtacagccccggcccccccagcggcgccaccgccctgccccccaccagcgccgcccccagcgcccagggcagcccccagcccagcgccagcagcagcagccagttcagcaccagcggcggcccctgggccagagagagaagagccggcgaggagcccgtgcccggccccatgacccccacccagccccccccccccctgagcctgccccccgccagaagcgagagcgaggtgctggaggagatcagcagagcctgcgagaccctggtggagagagtgggcagaagcgccaccgaccccgccgaccccgtggacaccgccgagcccgccgacagcggcaccgagagactgctgccccccgcccaggccaaggaggaggccggcggcgtggccgccgtgagcggcagctgcaagagaagacagaaggagcaccagaaggagcacagaagacacagaagagcctgcaaggacagcgtgggcagaagacccagagagggcagagccaaggccaaggccaaggtgcccaaggagaagagcagaagagtgctgggcaacctggacctgcagagcgaggagatccagggcagagagaagagcagacccgacctgggcggcgccagcaaggccaagccccccaccgcccccgccccccccagcgcccccgcccccagcgcccagcccaccccccccagcgccagcgtgcccggcaagaaggccagagaggaggcccccggcccccccggcgtgagcagagccgacatgctgaagctgagaagcctgagcgagggcccccccaaggagctgaagatcagactgatcaaggtggagagcggcgacaaggagaccttcatcgccagcgaggtggaggagagaagactgagaatggccgacctgaccatcagccactgcgccgccgacgtggtgagagccagcagaaacgccaaggtgaagggcaagttcagagagagctacctgagccccgcccagagcgtgaagcccaagatcaacaccgaggagaagctgcccagagagaagctgaacccccccacccccagcatctacctggagagcaagagagacgccttcagccccgtgctgctgcagttctgcaccgaccccagaaaccccatcaccgtgatcagaggcctggccggcagcctgagactgaacctgggcctgttcagcaccaagaccctggtggaggccagcggcgagcacaccgtggaggtgagaacccaggtgcagcagcccagcgacgagaactgggacctgaccggcaccagacagatctggccctgcgagagcagcagaagccacaccaccatcgccaagtacgcccagtaccaggccagcagcttccaggagagcctgcaggaggagaaggagagcgaggacgaggagagcgaggagcccgacagcaccaccggcaccccccccagcagcgcccccgaccccaagaaccaccacatcatcaagttcggcaccaacatcgacctgagcgacgccaagagatggaagccccagctgcaggagctgctgaagctgcccgccttcatgagagtgaccagcaccggcaacatgctgagccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgccgtgcacgagcactactgggagaccatcagcgccttctgcgacagacacggcgtggactacctgaccggcagctggtggcccatcctggacgacctgtacgccagcaacatccccgtgtacagattcgtgcagagacccggcgacctggtgtggatcaacgccggcaccgtgcactgggtgcaggccaccggctggtgcaacaacatcgcctggaacgtgggccccctgaccgcctaccagtaccagctggccctggagagatacgagtggaacgaggtgaagaacgtgaagagcatcgtgcccatgatccacgtgagctggaacgtggccagaaccgtgaagatcagcgaccccgacctgttcaagatgatcaagttctgcctgctgcagagcatgaagcactgccaggtgcagagagagagcctggtgagagccggcaagaagatcgcctaccagggcagagtgaaggacgagcccgcctactactgcaacgagtgcgacgtggaggtgttcaacatcctgttcgtgaccagcgagaacggcagcagaaacacctacctggtgcactgcgagggctgcgccagaagaagaagcgccggcctgcagggcgtggtggtgctggagcagtacagaaccgaggagctggcccaggcctacgacgccttcaccctggcccccgccagcaccagcagatag

SEQ ID NO: 87517 - DNA, 1245 bp, Artificial Sequence
  Description of Artificial Sequence: Synthetic coding sequence
atgcacagcagaggcagagagatcgtggtgctgctgaacccctggagcatcaacgaggccgtgagcagctactgcacctacttcatcaagcaggacagcaagagcttcggcatcatggtgagctggaagggcatctacttcatcctgaccctgttctggggcagcttcttcggcagcatcttcatgctgagccccttcctgcccctgatgttcgtgaaccccagctggtacagatggatcaacaacagactggtggccacctggctgaccctgcccgtggccctgctggagaccatgttcggcgtgaaggtgatcatcaccggcgacgccttcgtgcccggcgagagaagcgtgatcatcatgaaccacagaaccagaatggactggatgttcctgtggaactgcctgatgagatacagctacctgagactggagaagatctgcctgaaggccagcctgaagggcgtgcccggcttcggctgggccatgcaggccgccgcctacatcttcatccacagaaagtggaaggacgacaagagccacttcgaggacatgatcgactacttctgcgacatccacgagcccctgcagctgctgatcttccccgagggcaccgacctgaccgagaacagcaagagcagaagcaacgccttcgccgagaagaacggcctgcagaagtacgagtacgtgctgcaccccagaaccaccggcttcaccttcgtggtggacagactgagagagggcaagaacctggacgccgtgcacgacatcaccgtggcctacccccacaacatcccccagagcgagaagcacctgctgcagggcgacttccccagagagatccacttccacgtgcacagataccccatcgacaccctgcccaccagcaaggaggacctgcagctgtggtgccacaagagatgggaggagaaggaggagagactgagaagcttctaccagggcgagaagaacttctacttcaccggccagagcgtgatccccccctgcaagagcgagctgagagtgctggtggtgaagctgctgagcatcctgtactggaccctgttcagccccgccatgtgcctgctgatctacctgtacagcctggtgaagtggtacttcatcatcaccatcgtgatcttcgtgctgcaggagagaatcttcggcggcctggagatcatcgagctggcctgctacagactgctgcacaagcagccccacctgaacagcaagaagaacgagtag

SEQ ID NO: 87518 - DNA, 927 bp, Artificial Sequence
  Description of Artificial Sequence: Synthetic coding sequence
atgcacagcagaggcagagagatcgtggtgctgctgaacccctggagcatcaacgaggccgtgagcagctactgcacctacttcatcaagcaggacagcaagagcttcggcatcatggtgagctggaagggcatctacttcatcctgaccctgttctggggcagcttcttcggcagcatcttcatgctgagccccttcctgcccctgatgttcgtgaaccccagctggtacagatggatcaacaacagactggtggccacctggctgaccctgcccgtggccctgctggagaccatgttcggcgtgaaggtgatcatcaccggcgacgccttcgtgcccggcgagagaagcgtgatcatcatgaaccacagaaccagaatggactggatgttcctgtggaactgcctgatgagatacagctacctgagactggagaagatctgcctgaaggccagcctgaagggcgtgcccggcttcggctgggccatgcaggccgccgcctacatcttcatccacagaaagtggaaggacgacaagagccacttcgaggacatgatcgactacttctgcgacatccacgagcccctgcagctgctgatcttccccgagggcaccgacctgaccgagaacagcaagagcagaagcaacgccttcgccgagaagaacggcctgcagaagtacgagtacgtgctgcaccccagaaccaccggcttcaccttcgtggtggacagactgagagagggcagaagacagagcgagggcagcaagggccccctgcagggcgagctgcagatcaccgcccagggcaaccagagaggccacaagcagatggagaagcacagcatgctgatggactggaagaaccagtacagagagatcggccacaccgcccagagcaacctgcagatccagtgctacagccactag

SEQ ID NO: 87519 - DNA, 927 bp, Artificial Sequence; identical to SEQ ID NO: 87518
  Description of Artificial Sequence: Synthetic coding sequence

SEQ ID NO: 87520 - DNA, 1131 bp, Artificial Sequence
  Description of Artificial Sequence: Synthetic coding sequence
atggtgagctggaagggcatctacttcatcctgaccctgttctggggcagcttcttcggcagcatcttcatgctgagccccttcctgcccctgatgttcgtgaaccccagctggtacagatggatcaacaacagactggtggccacctggctgaccctgcccgtggccctgctggagaccatgttcggcgtgaaggtgatcatcaccggcgacgccttcgtgcccggcgagagaagcgtgatcatcatgaaccacagaaccagaatggactggatgttcctgtggaactgcctgatgagatacagctacctgagactggagaagatctgcctgaaggccagcctgaagggcgtgcccggcttcggctgggccatgcaggccgccgcctacatcttcatccacagaaagtggaaggacgacaagagccacttcgaggacatgatcgactacttctgcgacatccacgagcccctgcagctgctgatcttccccgagggcaccgacctgaccgagaacagcaagagcagaagcaacgccttcgccgagaagaacggcctgcagaagtacgagtacgtgctgcaccccagaaccaccggcttcaccttcgtggtggacagactgagagagggcaagaacctggacgccgtgcacgacatcaccgtggcctacccccacaacatcccccagagcgagaagcacctgctgcagggcgacttccccagagagatccacttccacgtgcacagataccccatcgacaccctgcccaccagcaaggaggacctgcagctgtggtgccacaagagatgggaggagaaggaggagagactgagaagcttctaccagggcgagaagaacttctacttcaccggccagagcgtgatccccccctgcaagagcgagctgagagtgctggtggtgaagctgctgagcatcctgtactggaccctgttcagccccgccatgtgcctgctgatctacctgtacagcctggtgaagtggtacttcatcatcaccatcgtgatcttcgtgctgcaggagagaatcttcggcggcctggagatcatcgagctggcctgctacagactgctgcacaagcagccccacctgaacagcaagaagaacgagtag

SEQ ID NO: 87521 - DNA, 993 bp, Artificial Sequence
  Description of Artificial Sequence: Synthetic coding sequence
atggtgagctggaagggcatctacttcatcctgaccctgttctggggcagcttcttcggcagcatcttcatgctgagccccttcctgcccctgatgttcgtgaaccccagctggtacagatggatcaacaacagactggtggccacctggctgaccctgcccgtggccctgctggagaccatgttcggcgtgaaggtgatcatcaccggcgacgccttcgtgcccggcgagagaagcgtgatcatcatgaaccacagaaccagaatggactggatgttcctgtggaactgcctgatgagatacagctacctgagactggagaagatctgcctgaaggccagcctgaagggcgtgcccggcttcggctgggccatgcaggccgccgcctacatcttcatccacagaaagtggaaggacgacaagagccacttcgaggacatgatcgactacttctgcgacatccacgagcccctgcagctgctgatcttccccgagggcaccgacctgaccgagaacagcaagagcagaagcaacgccttcgccgagaagaacggcctgcagaagtacgagtacgtgctgcaccccagaaccaccggcttcaccttcgtggtggacagactgagagagggcaagaacctggacgccgtgcacgacatcaccgtggcctacccccacaacatcccccagagcgagaagcacctgctgcagggcgacttccccagagagatccacttccacgtgcacagataccccatcgacaccctgcccaccagcaaggaggacctgcagctgtggtgccacaagagatgggaggagaaggaggagagactgagaagcttctaccagggcgagaagaacttctacttcaccggccagagcgtgatccccccctgcaagagcgagctgagagtgctggtggtgaagctgtacaccgtgctggaccccgtgcagccctgcaacgtgcccacccacatcttcgtgcagagctgctag

SEQ ID NO: 87522 - DNA, 462 bp, Artificial Sequence
  Description of Artificial Sequence: Synthetic coding sequence
atgcacagcagaggcagagagatcgtggtgctgctgaacccctggagcatcaacgaggccgtgagcagctactgcacctacttcatcaagcaggacagcaagagcttcggcatcatggtgagctggaagggcatctacttcatcctgaccctgttctggggcagcttcttcggcagcatcttcatgctgagccccttcctgcccctgatgttcgtgaaccccagctggtacagatggatcaacaacagactggtggccacctggctgaccctgcccgtggccctgctggagaccatgttcggcgtgaaggtgatcatcaccggcgacgccttcgtgcccggcgagagaagcgtgatcatcatgaaccacagaaccagaatggactggatgttcctgtggaactgcctgatgagatacagctacctgagactggagaagatctgcctgaaggccagcctgtag

SEQ ID NO: 87523 - DNA, 1131 bp, Artificial Sequence; identical to SEQ ID NO: 87520
  Description of Artificial Sequence: Synthetic coding sequence

SEQ ID NO: 87524 - DNA, 1095 bp, Artificial Sequence
  Description of Artificial Sequence: Synthetic coding sequence
atggccgccatcagcaccagcatccccgtgatcagccagccccagttcaccgccatgaacgagccccagtgcttctacaacgagagcatcgccttcttctacaacagaagcggcaagcacctggccaccgagtggaacaccgtgagcaagctggtgatgggcctgggcatcaccgtgtgcatcttcatcatgctggccaacctgctggtgatggtggccatctacgtgaacagaagattccacttccccatctactacctgatggccaacctggccgccgccgacttcttcgccggcctggcctacttctacctgatgttcaacaccggccccaacaccagaagactgaccgtgagcacctggctgctgagacagggcctgatcgacaccagcctgaccgccagcgtggccaacctgctggccatcgccatcgagagacacatcaccgtgttcagaatgcagctgcacaccagaatgagcaacagaagagtggtggtggtgatcgtggtgatctggaccatggccatcgtgatgggcgccatccccagcgtgggctggaactgcatctgcgacatcgagaactgcagcaacatggcccccctgtacagcgacagctacctggtgttctgggccatcttcaacctggtgaccttcgtggtgatggtggtgctgtacgcccacatcttcggctacgtgagacagagaaccatgagaatgagcagacacagcagcggccccagaagaaacagagacaccatgatgagcctgctgaagaccgtggtgatcgtgctgggcgccttcatcatctgctggacccccggcctggtgctgctgctgctggacgtgtgctgcccccagtgcgacgtgctggcctacgagaagttcttcctgctgctggccgagttcaacagcgccatgaaccccatcatctacagctacagagacaaggagatgagcgccaccttcagacagatcctgtgctgccagagaagcgagaaccccaccggccccaccgagggcagcgacagaagcgccagcagcctgaaccacaccatcctggccggcgtgcacagcaacgaccacagcgtggtgtag

SEQ ID NO: 87525 - DNA, 1095 bp, Artificial Sequence; identical to SEQ ID NO: 87524
  Description of Artificial Sequence: Synthetic coding sequence

SEQ ID NO: 87526 - DNA, 1095 bp, Artificial Sequence; identical to SEQ ID NO: 87524
  Description of Artificial Sequence: Synthetic coding sequence

SEQ ID NO: 87527 - DNA, 549 bp, Artificial Sequence
  Description of Artificial Sequence: Synthetic coding sequence
atggccgccatcagcaccagcatccccgtgatcagccagccccagttcaccgccatgaacgagccccagtgcttctacaacgagagcatcgccttcttctacaacagaagcggcaagcacctggccaccgagtggaacaccgtgagcaagctggtgatgggcctgggcatcaccgtgtgcatcttcatcatgctggccaacctgctggtgatggtggccatctacgtgaacagaagattccacttccccatctactacctgatggccaacctggccgccgccgacttcttcgccggcctggcctacttctacctgatgttcaacaccggccccaacaccagaagactgaccgtgagcacctggctgctgagacagggcctgatcgacaccagcctgaccgccagcgtggccaacctgctggccatcgccatcgagagacacatcaccgtgttcagaatgcagctgcacaccagaatgagcaacagaagagtggtggtggtgatcgtggtgatctggaccatggccatcgtgatgggcgccatcccctag

SEQ ID NO: 87528 - DNA, 1041 bp, Artificial Sequence
  Description of Artificial Sequence: Synthetic coding sequence
atgaacgagccccagtgcttctacaacgagagcatcgccttcttctacaacagaagcggcaagcacctggccaccgagtggaacaccgtgagcaagctggtgatgggcctgggcatcaccgtgtgcatcttcatcatgctggccaacctgctggtgatggtggccatctacgtgaacagaagattccacttccccatctactacctgatggccaacctggccgccgccgacttcttcgccggcctggcctacttctacctgatgttcaacaccggccccaacaccagaagactgaccgtgagcacctggctgctgagacagggcctgatcgacaccagcctgaccgccagcgtggccaacctgctggccatcgccatcgagagacacatcaccgtgttcagaatgcagctgcacaccagaatgagcaacagaagagtggtggtggtgatcgtggtgatctggaccatggccatcgtgatgggcgccatccccagcgtgggctggaactgcatctgcgacatcgagaactgcagcaacatggcccccctgtacagcgacagctacctggtgttctgggccatcttcaacctggtgaccttcgtggtgatggtggtgctgtacgcccacatcttcggctacgtgagacagagaaccatgagaatgagcagacacagcagcggccccagaagaaacagagacaccatgatgagcctgctgaagaccgtggtgatcgtgctgggcgccttcatcatctgctggacccccggcctggtgctgctgctgctggacgtgtgctgcccccagtgcgacgtgctggcctacgagaagttcttcctgctgctggccgagttcaacagcgccatgaaccccatcatctacagctacagagacaaggagatgagcgccaccttcagacagatcctgtgctgccagagaagcgagaaccccaccggccccaccgagggcagcgacagaagcgccagcagcctgaaccacaccatcctggccggcgtgcacagcaacgaccacagcgtggtgtag

SEQ ID NO: 87529 - DNA, 1098 bp, Artificial Sequence
  Description of Artificial Sequence: Synthetic coding sequence
atggaggagggcgcccagagaagcggcgccctgggcgccccccaccagttcaccgccatgaacgagccccagtgcttctacaacgagagcatcgccttcttctacaacagaagcggcaagcacctggccaccgagtggaacaccgtgagcaagctggtgatgggcctgggcatcaccgtgtgcatcttcatcatgctggccaacctgctggtgatggtggccatctacgtgaacagaagattccacttccccatctactacctgatggccaacctggccgccgccgacttcttcgccggcctggcctacttctacctgatgttcaacaccggccccaacaccagaagactgaccgtgagcacctggctgctgagacagggcctgatcgacaccagcctgaccgccagcgtggccaacctgctggccatcgccatcgagagacacatcaccgtgttcagaatgcagctgcacaccagaatgagcaacagaagagtggtggtggtgatcgtggtgatctggaccatggccatcgtgatgggcgccatccccagcgtgggctggaactgcatctgcgacatcgagaactgcagcaacatggcccccctgtacagcgacagctacctggtgttctgggccatcttcaacctggtgaccttcgtggtgatggtggtgctgtacgcccacatcttcggctacgtgagacagagaaccatgagaatgagcagacacagcagcggccccagaagaaacagagacaccatgatgagcctgctgaagaccgtggtgatcgtgctgggcgccttcatcatctgctggacccccggcctggtgctgctgctgctggacgtgtgctgcccccagtgcgacgtgctggcctacgagaagttcttcctgctgctggccgagttcaacagcgccatgaaccccatcatctacagctacagagacaaggagatgagcgccaccttcagacagatcctgtgctgccagagaagcgagaaccccaccggccccaccgagggcagcgacagaagcgccagcagcctgaaccacaccatcctggccggcgtgcacagcaacgaccacagcgtggtgtag

SEQ ID NO: 87530 - DNA, 1098 bp, Artificial Sequence
  Description of Artificial Sequence: Synthetic coding sequence
atgctgctgctgctgatccccgcccacagcagcgtgctggagaacgagttcaccgccatgaacgagccccagtgcttctacaacgagagcatcgccttcttctacaacagaagcggcaagcacctggccaccgagtggaacaccgtgagcaagctggtgatgggcctgggcatcaccgtgtgcatcttcatcatgctggccaacctgctggtgatggtggccatctacgtgaacagaagattccacttccccatctactacctgatggccaacctggccgccgccgacttcttcgccggcctggcctacttctacctgatgttcaacaccggccccaacaccagaagactgaccgtgagcacctggctgctgagacagggcctgatcgacaccagcctgaccgccagcgtggccaacctgctggccatcgccatcgagagacacatcaccgtgttcagaatgcagctgcacaccagaatgagcaacagaagagtggtggtggtgatcgtggtgatctggaccatggccatcgtgatgggcgccatccccagcgtgggctggaactgcatctgcgacatcgagaactgcagcaacatggcccccctgtacagcgacagctacctggtgttctgggccatcttcaacctggtgaccttcgtggtgatggtggtgctgtacgcccacatcttcggctacgtgagacagagaaccatgagaatgagcagacacagcagcggccccagaagaaacagagacaccatgatgagcctgctgaagaccgtggtgatcgtgctgggcgccttcatcatctgctggacccccggcctggtgctgctgctgctggacgtgtgctgcccccagtgcgacgtgctggcctacgagaagttcttcctgctgctggccgagttcaacagcgccatgaaccccatcatctacagctacagagacaaggagatgagcgccaccttcagacagatcctgtgctgccagagaagcgagaaccccaccggccccaccgagggcagcgacagaagcgccagcagcctgaaccacaccatcctggccggcgtgcacagcaacgaccacagcgtggtgtag

SEQ ID NO: 87531 - DNA, 1056 bp, Artificial Sequence
  Description of Artificial Sequence: Synthetic coding sequence
atggtgatcatgggccagtgctactacaacgagaccatcggcttcttctacaacaacagcggcaaggagctgagcagccactggagacccaaggacgtggtggtggtggccctgggcctgaccgtgagcgtgctggtgctgctgaccaacctgctggtgatcgccgccatcgccagcaacagaagattccaccagcccatctactacctgctgggcaacctggccgccgccgacctgttcgccggcgtggcctacctgttcctgatgttccacaccggccccagaaccgccagactgagcctggagggctggttcctgagacagggcctgctggacaccagcctgaccgccagcgtggccaccctgctggccatcgccgtggagagacacagaagcgtgatggccgtgcagctgcacagcagactgcccagaggcagagtggtgatgctgatcgtgggcgtgtgggtggccgccctgggcctgggcctgctgcccgcccacagctggcactgcctgtgcgccctggacagatgcagcagaatggcccccctgctgagcagaagctacctggccgtgtgggccctgagcagcctgctggtgttcctgctgatggtggccgtgtacaccagaatcttcttctacgtgagaagaagagtgcagagaatggccgagcacgtgagctgccaccccagatacagagagaccaccctgagcctggtgaagaccgtggtgatcatcctgggcgccttcgtggtgtgctggacccccggccaggtggtgctgctgctggacggcctgggctgcgagagctgcaacgtgctggccgtggagaagtacttcctgctgctggccgaggccaacagcctggtgaacgccgccgtgtacagctgcagagacgccgagatgagaagaaccttcagaagactgctgtgctgcgcctgcctgagacagagcaccagagagagcgtgcactacaccagcagcgcccagggcggcgccagcaccagaatcatgctgcccgagaacggccaccccctgatggacagcaccctgtag

SEQ ID NO: 87532 - DNA, 1056 bp, Artificial Sequence; identical to SEQ ID NO: 87531
  Description of Artificial Sequence: Synthetic coding sequence

SEQ ID NO: 87533 - DNA, 1062 bp, Artificial Sequence
  Description of Artificial Sequence: Synthetic coding sequence
atgaacgagtgccactacgacaagcacatggacttcttctacaacagaagcaacaccgacaccgtggacgactggaccggcaccaagctggtgatcgtgctgtgcgtgggcaccttcttctgcctgttcatcttcttcagcaacagcctggtgatcgccgccgtgatcaagaacagaaagttccacttccccttctactacctgctggccaacctggccgccgccgacttcttcgccggcatcgcctacgtgttcctgatgttcaacaccggccccgtgagcaagaccctgaccgtgaacagatggttcctgagacagggcctgctggacagcagcctgaccgccagcctgaccaacctgctggtgatcgccgtggagagacacatgagcatcatgagaatgagagtgcacagcaacctgaccaagaagagagtgaccctgctgatcctgctggtgtgggccatcgccatcttcatgggcgccgtgcccaccctgggctggaactgcctgtgcaacatcagcgcctgcagcagcctggcccccatctacagcagaagctacctggtgttctggaccgtgagcaacctgatggccttcctgatcatggtggtggtgtacctgagaatctacgtgtacgtgaagagaaagaccaacgtgctgagcccccacaccagcggcagcatcagcagaagaagaacccccatgaagctgatgaagaccgtgatgaccgtgctgggcgccttcgtggtgtgctggacccccggcctggtggtgctgctgctggacggcctgaactgcagacagtgcggcgtgcagcacgtgaagagatggttcctgctgctggccctgctgaacagcgtggtgaaccccatcatctacagctacaaggacgaggacatgtacggcaccatgaagaagatgatctgctgcttcagccaggagaaccccgagagaagacccagcagaatccccagcaccgtgctgagcagaagcgacaccggcagccagtacatcgaggacagcatcagccagggcgccgtgtgcaacaagagcaccagctag

SEQ ID NO: 87534 - DNA, 1062 bp, Artificial Sequence; identical to SEQ ID NO: 87533
  Description of Artificial Sequence: Synthetic coding sequence

SEQ ID NO: 87535 - DNA, 1113 bp, Artificial Sequence
  Description of Artificial Sequence: Synthetic coding sequence
atgggcgacagaagattcatcgacttccagttccaggacagcaacagcagcctgagacccagactgggcaacgccaccgccaacaacacctgcatcgtggacgacagcttcaagtacaacctgaacggcgccgtgtacagcgtggtgttcatcctgggcctgatcaccaacagcgtgagcctgttcgtgttctgcttcagaatgaagatgagaagcgagaccgccatcttcatcaccaacctggccgtgagcgacctgctgttcgtgtgcaccctgcccttcaagatcttctacaacttcaacagacactggcccttcggcgacaccctgtgcaagatcagcggcaccgccttcctgaccaacatctacggcagcatgctgttcctgacctgcatcagcgtggacagattcctggccatcgtgtaccccttcagaagcagaaccatcagaaccagaagaaacagcgccatcgtgtgcgccggcgtgtggatcctggtgctgagcggcggcatcagcgccagcctgttcagcaccaccaacgtgaacaacgccaccaccacctgcttcgagggcttcagcaagagagtgtggaagacctacctgagcaagatcaccatcttcatcgaggtggtgggcttcatcatccccctgatcctgaacgtgagctgcagcagcgtggtgctgagaaccctgagaaagcccgccaccctgagccagatcggcaccaacaagaagaaggtgctgaagatgatcaccgtgcacatggccgtgttcgtggtgtgcttcgtgccctacaacagcgtgctgttcctgtacgccctggtgagaagccaggccatcaccaactgcttcctggagagattcgccaagatcatgtaccccatcaccctgtgcctggccaccctgaactgctgcttcgaccccttcatctactacttcaccctggagagcttccagaagagcttctacatcaacgcccacatcagaatggagagcctgttcaagaccgagacccccctgaccaccaagcccagcctgcccgccatccaggaggaggtgagcgaccagaccaccaacaacggcggcgagctgatgctggagagcaccttctag

SEQ ID NO: 87536 - DNA, 1113 bp, Artificial Sequence; identical to SEQ ID NO: 87535
  Description of Artificial Sequence: Synthetic coding sequence

SEQ ID NO: 87537 - DNA, 1119 bp, Artificial Sequence
  Description of Artificial Sequence: Synthetic coding sequence
atgctggccaacagcagcagcaccaacagcagcgtgctgccctgccccgactacagacccacccacagactgcacctggtggtgtacagcctggtgctggccgccggcctgcccctgaacgccctggccctgtgggtgttcctgagagccctgagagtgcacagcgtggtgagcgtgtacatgtgcaacctggccgccagcgacctgctgttcaccctgagcctgcccgtgagactgagctactacgccctgcaccactggcccttccccgacctgctgtgccagaccaccggcgccatcttccagatgaacatgtacggcagctgcatcttcctgatgctgatcaacgtggacagatacgccgccatcgtgcaccccctgagactgagacacctgagaagacccagagtggccagactgctgtgcctgggcgtgtgggccctgatcctggtgttcgccgtgcccgccgccagagtgcacagacccagcagatgcagatacagagacctggaggtgagactgtgcttcgagagcttcagcgacgagctgtggaagggcagactgctgcccctggtgctgctggccgaggccctgggcttcctgctgcccctggccgccgtggtgtacagcagcggcagagtgttctggaccctggccagacccgacgccacccagagccagagaagaagaaagaccgtgagactgctgctggccaacctggtgatcttcctgctgtgcttcgtgccctacaacagcaccctggccgtgtacggcctgctgagaagcaagctggtggccgccagcgtgcccgccagagacagagtgagaggcgtgctgatggtgatggtgctgctggccggcgccaactgcgtgctggaccccctggtgtactacttcagcgccgagggcttcagaaacaccctgagaggcctgggcaccccccacagagccagaaccagcgccaccaacggcaccagagccgccctggcccagagcgagagaagcgccgtgaccaccgacgccaccagacccgacgccgccagccagggcctgctgagacccagcgacagccacagcctgagcagcttcacccagtgcccccaggacagcgccctgtag

SEQ ID NO: 87538 - DNA, 1119 bp, Artificial Sequence; identical to SEQ ID NO: 87537
  Description of Artificial Sequence: Synthetic coding sequence

SEQ ID NO: 87539 - DNA, 1290 bp, Artificial Sequence
  Description of Artificial Sequence: Synthetic coding sequence
atgctggccaacagcagcagcaccaacagcagcgtgctgccctgccccgactacagacccacccacagactgcacctggtggtgtacagcctggtgctggccgccggcctgcccctgaacgccctggccctgtgggtgttcctgagagccctgagagtgcacagcgtggtgagcgtgtacatgtgcaacctggccgccagcgacctgctgttcaccctgagcctgcccgtgagactgagctactacgccctgcaccactggcccttccccgacctgctgtgccagaccaccggcgccatcttccagatgaacatgtacggcagctgcatcttcctgatgctgatcaacgtggacagatacgccgccatcgtgcaccccctgagactgagacacctgagaagacccagagtggccagactgctgtgcctgggcgtgtgggccctgatcctggtgttcgccgtgcccgccgccagagtgcacagacccagcagatgcagatacagagacctggaggtgagactgtgcttcgagagcttcagcgacgagctgtggaagggcagactgctgcccctggtgctgctggccgaggccctgggcttcctgctgcccctggccgccgtggtgtacagcagcggcagagtgttctggaccctggccagacccgacgccacccagagccagagaagaagaaagaccgtgagactgctgctggccaacctggtgatcttcctgctgtgcttcgtgccctacaacagcaccctggccgtgtacggcctgctgagaagcaagctggtggccgccagcgtgcccgccagagacagagtgagaggcgtgctgatggtgatggtgctgctggccggcgccaactgcgtgctggaccccctggtgtactacttcagcgccgagggcttcagaaacaccctgagaggcctgggcaccccccacagagccagaaccagcgccaccaacggcaccagagccgccctggcccagagcgagagaagcgccgtgaccaccgacgccaccagacccgacgccgccagccagggcctgctgagacccagcgacagccacagcctgagcagcttcacccacgccatcgccctgagcgtgcccgacagccagagactgagcttctgggaggcctacagagtgtacacccaggagggcggcctgggcacctggaccttcggctggcagttccagctgagcaacgccgaggagtacaaggtgtggaagcccggccccagagagggcagcgccgccggcaacggcttcttcaagctgtag

SEQ ID NO: 87540 - DNA, 1605 bp, Artificial Sequence
  Description of Artificial Sequence: Synthetic coding sequence
atgagactgagaggctgcggccccagagccgcccccgccagcagcgccggcgccagcgacgccagactgctggccccccccggcagaaaccccttcgtgcacgagctgagactgagcgccctgcagaaggcccaggtggccctgatgaccctgaccctgttccccgtgagactgctggtggccgccgccatgatgctgctggcctggcccctggccctggtggccagcctgggcagcgccgagaaggagcccgagcagccccccgccctgtggagaaaggtggtggacttcctgctgaaggccatcatgagaaccatgtggttcgccggcggcttccacagagtggccgtgaagggcagacaggccctgcccaccgaggccgccatcctgaccctggccccccacagcagctacttcgacgccatccccgtgaccatgaccatgagcagcatcgtgatgaaggccgagagcagagacatccccatctggggcaccctgatccagtacatcagacccgtgttcgtgagcagaagcgaccaggacagcagaagaaagaccgtggaggagatcaagagaagagcccagagcaacggcaagtggccccagatcatgatcttccccgagggcacctgcaccaacagaacctgcctgatcaccttcaagcccggcgccttcatccccggcgcccccgtgcagcccgtggtgctgagataccccaacaagctggacaccatcacctggacctggcagggccccggcgccctggagatcctgtggctgaccctgtgccagttccacaaccaggtggagatcgagttcctgcccgtgtacagccccagcgaggaggagaagagaaaccccgccctgtacgccagcaacgtgagaagagtgatggccgaggccctgggcgtgagcgtgaccgactacaccttcgaggactgccagctggccctggccgagggccagctgagactgcccgccgacacctgcctgctggagttcgccagactggtgagaggcctgggcctgaagcccgagaagctggagaaggacctggacagatacagcgagagagccagaatgaagggcggcgagaagatcggcatcgccgagttcgccgccagcctggaggtgcccgtgagcgacctgctggaggacatgttcagcctgttcgacgagagcggcagcggcgaggtggacctgagagagtgcgtggtggccctgagcgtggtgtgcagacccgccagaaccctggacaccatccagctggccttcaagatgtacggcgcccaggaggacggcagcgtgggcgagggcgacctgagctgcatcctgaagaccgccctgggcgtggccgagctgaccgtgaccgacctgttcagagccatcgaccaggaggagaagggcaagatcaccttcgccgacttccacagattcgccgagatgtaccccgccttcgccgaggagtacctgtaccccgaccagacccacttcgagagctgcgccgagaccagccccgcccccatccccaacggcttctgcgccgacttcagccccgagaacagcgacgccggcagaaagcccgtgagaaagaagctggactag

SEQ ID NO: 87541 - DNA, 1605 bp, Artificial Sequence; identical to SEQ ID NO: 87540
  Description of Artificial Sequence: Synthetic coding sequence

SEQ ID NO: 87542 - DNA, 1464 bp, Artificial Sequence
  Description of Artificial Sequence: Synthetic coding sequence
atggccagcagcgccgagggcgacgagggcaccgtggtggccctggccggcgtgctgcagagcggcttccaggagctgagcctgaacaagctggccaccagcctgggcgccagcgagcaggccctgagactgatcatcagcatcttcctgggctaccccttcgccctgttctacagacactacctgttctacaaggagacctacctgatccacctgttccacaccttcaccggcctgagcatcgcctacttcaacttcggcaaccagctgtaccacagcctgctgtgcatcgtgctgcagttcctgatcctgagactgatgggcagaaccatcaccgccgtgctgaccaccttctgcttccagatggcctacctgctggccggctactactacaccgccaccggcaactacgacatcaagtggaccatgccccactgcgtgctgaccctgaagctgatcggcctggccgtggactacttcgacggcggcaaggaccagaacagcctgagcagcgagcagcagaagtacgccatcagaggcgtgcccagcctgctggaggtggccggcttcagctacttctacggcgccttcctggtgggcccccagttcagcatgaaccactacatgaagctggtgcagggcgagctgatcgacatccccggcaagatccccaacagcatcatccccgccctgaagagactgagcctgggcctgttctacctggtgggctacaccctgctgagcccccacatcaccgaggactacctgctgaccgaggactacgacaaccaccccttctggttcagatgcatgtacatgctgatctggggcaagttcgtgctgtacaagtacgtgacctgctggctggtgaccgagggcgtgtgcatcctgaccggcctgggcttcaacggcttcgaggagaagggcaaggccaagtgggacgcctgcgccaacatgaaggtgtggctgttcgagaccaaccccagattcaccggcaccatcgccagcttcaacatcaacaccaacgcctgggtggccagatacatcttcaagagactgaagttcctgggcaacaaggagctgagccagggcctgagcctgctgttcctggccctgtggcacggcctgcacagcggctacctggtgtgcttccagatggagttcctgatcgtgatcgtggagagacaggccgccagactgatccaggagagccccaccctgagcaagctggccgccatcaccgtgctgcagcccttctactacctggtgcagcagaccatccactggctgttcatgggctacagcatgaccgccttctgcctgttcacctgggacaagtggctgaaggtgtacaagagcatctacttcctgggccacatcttcttcctgagcctgctgttcatcctgccctacatccacaaggccatggtgcccagaaaggagaagctgaagaagatggagtag

SEQ ID NO: 87543 - DNA, 1575 bp, Artificial Sequence
  Description of Artificial Sequence: Synthetic coding sequence
atgagccagggcagccccggcgactgggcccccctggaccccacccccggcccccccgccagccccaaccccttcgtgcacgagctgcacctgagcagactgcagagagtgaagttctgcctgctgggcgccctgctggcccccatcagagtgctgctggccttcatcgtgctgttcctgctgtggcccttcgcctggctgcaggtggccggcctgagcgaggagcagctgcaggagcccatcaccggctggagaaagaccgtgtgccacaacggcgtgctgggcctgagcagactgctgttcttcctgctgggcttcctgagaatcagagtgagaggccagagagccagcagactgcaggcccccgtgctggtggccgccccccacagcaccttcttcgaccccatcgtgctgctgccctgcgacctgcccaaggtggtgagcagagccgagaacctgagcgtgcccgtgatcggcgccctgctgagattcaaccaggccatcctggtgagcagacacgaccccgccagcagaagaagagtggtggaggaggtgagaagaagagccaccagcggcggcaagtggccccaggtgctgttcttccccgagggcacctgcagcaacaagaaggccctgctgaagttcaagcccggcgccttcatcgccggcgtgcccgtgcagcccgtgctgatcagataccccaacagcctggacaccaccagctgggcctggagaggccccggcgtgctgaaggtgctgtggctgaccgccagccagccctgcagcatcgtggacgtggagttcctgcccgtgtaccaccccagccccgaggagagcagagaccccaccctgtacgccaacaacgtgcagagagtgatggcccaggccctgggcatccccgccaccgagtgcgagttcgtgggcagcctgcccgtgatcgtggtgggcagactgaaggtggccctggagccccagctgtgggagctgggcaaggtgctgagaaaggccggcctgagcgccggctacgtggacgccggcgccgagcccggcagaagcagaatgatcagccaggaggagttcgccagacagctgcagctgagcgacccccagaccgtggccggcgccttcggctacttccagcaggacaccaagggcctggtggacttcagagacgtggccctggccctggccgccctggacggcggcagaagcctggaggagctgaccagactggccttcgagctgttcgccgaggagcaggccgagggccccaacagactgctgtacaaggacggcttcagcaccatcctgcacctgctgctgggcagcccccaccccgccgccaccgccctgcacgccgagctgtgccaggccggcagcagccagggcctgagcctgtgccagttccagaacttcagcctgcacgaccccctgtacggcaagctgttcagcacctacctgagacccccccacaccagcagaggcaccagccagacccccaacgccagcagccccggcaaccccaccgccctggccaacggcaccgtgcaggcccccaagcagaagggcgactag

SEQ ID NO: 87544 - DNA, 693 bp, Artificial Sequence
  Description of Artificial Sequence: Synthetic coding sequence
atgtgcggcaacaacatgagcacccccctgcccgccatcgtgcccgccgccagaaaggccaccgccgccgtgatcttcctgcacggcctgggcgacaccggccacggctgggccgaggccttcgccggcatcagaagcagccacatcaagtacatctgcccccacgcccccgtgagacccgtgaccctgaacatgaacgtggccatgcccagctggttcgacatcatcggcctgagccccgacagccaggaggacgagagcggcatcaagcaggccgccgagaacatcaaggccctgatcgaccaggaggtgaagaacggcatccccagcaacagaatcatcctgggcggcttcagccagggcggcgccctgagcctgtacaccgccctgaccacccagcagaagctggccggcgtgaccgccctgagctgctggctgcccctgagagccagcttcccccagggccccatcggcggcgccaacagagacatcagcatcctgcagtgccacggcgactgcgaccccctggtgcccctgatgttcggcagcctgaccgtggagaagctgaagaccctggtgaaccccgccaacgtgaccttcaagacctacgagggcatgatgcacagcagctgccagcaggagatgatggacgtgaagcagttcatcgacaagctgctgccccccatcgactag

SEQ ID NO: 87545 - DNA, 645 bp, Artificial Sequence
  Description of Artificial Sequence: Synthetic coding sequence
atgtgcggcaacaacatgagcacccccctgcccgccatcgtgcccgccgccagaaaggccaccgccgccgtgatcttcctgcacggcctgggcgacaccggccacggctgggccgaggccttcgccggcatcagaagcagccacatcaagtacatctgcccccacgccttcgacatcatcggcctgagccccgacagccaggaggacgagagcggcatcaagcaggccgccgagaacatcaaggccctgatcgaccaggaggtgaagaacggcatccccagcaacagaatcatcctgggcggcttcagccagggcggcgccctgagcctgtacaccgccctgaccacccagcagaagctggccggcgtgaccgccctgagctgctggctgcccctgagagccagcttcccccagggccccatcggcggcgccaacagagacatcagcatcctgcagtgccacggcgactgcgaccccctggtgcccctgatgttcggcagcctgaccgtggagaagctgaagaccctggtgaaccccgccaacgtgaccttcaagacctacgagggcatgatgcacagcagctgccagcaggagatgatggacgtgaagcagttcatcgacaagctgctgccccccatcgactag

SEQ ID NO: 87546 - DNA, 1092 bp, Artificial Sequence
  Description of Artificial Sequence: Synthetic coding sequence
atggagctgcacgagagacccgacgagagaagaaaggccagaaccagcacccagggcagactgggcgactggagaagagtgcacgccgacggcttcacccacagagtgtggagcagcagcagctggctggagcccgccatgaccagcagaaccagagtgacctggcccagcccccccagacccctgcccgtgcccgccgccgccgccgtggccttcggcgccaagggcaccgaccccgccgaggccagaagcagcagaggcatcgaggaggccggccccagagcccacggcagagccggcagagagcccgagagaagaagaagcagacagcagagaagaggcggcctgcaggccagaagaagcaccctgctgaagacctgcgccagagccagagccaccgcccccggcgccatgaagatggtggccccctggaccagattctacagcaacagctgctgcctgtgctgccacgtgagaaccggcaccatcctgctgggcgtgtggtacctgatcatcaacgccgtggtgctgctgatcctgctgagcgccctggccgaccccgaccagtacaacttcagcagcagcgagctgggcggcgacttcgagttcatggacgacgccaacatgtgcatcgccatcgccatcagcctgctgatgatcctgatctgcgccatggccacctacggcgcctacaagcagagagccgcctggatcatccccttcttctgctaccagatcttcgacttcgccctgaacatgctggtggccatcaccgtgctgatctaccccaacagcatccaggagtacatcagacagctgccccccaacttcccctacagagacgacgtgatgagcgtgaaccccacctgcctggtgctgatcatcctgctgttcatcagcatcatcctgaccttcaagggctacctgatcagctgcgtgtggaactgctacagatacatcaacggcagaaacagcagcgacgtgctggtgtacgtgaccagcaacgacaccaccgtgctgctgcccccctacgacgacgccaccgtgaacggcgccgccaaggagcccccccccccctacgtgagcgcctag

SEQ ID NO: 87547 - DNA, 954 bp, Artificial Sequence
  Description of Artificial Sequence: Synthetic coding sequence
atgaccagcagaaccagagtgacctggcccagcccccccagacccctgcccgtgcccgccgccgccgccgtggccttcggcgccaagggcaccgaccccgccgaggccagaagcagcagaggcatcgaggaggccggccccagagcccacggcagagccggcagagagcccgagagaagaagaagcagacagcagagaagaggcggcctgcaggccagaagaagcaccctgctgaagacctgcgccagagccagagccaccgcccccggcgccatgaagatggtggccccctggaccagattctacagcaacagctgctgcctgtgctgccacgtgagaaccggcaccatcctgctgggcgtgtggtacctgatcatcaacgccgtggtgctgctgatcctgctgagcgccctggccgaccccgaccagtacaacttcagcagcagcgagctgggcggcgacttcgagttcatggacgacgccaacatgtgcatcgccatcgccatcagcctgctgatgatcctgatctgcgccatggccacctacggcgcctacaagcagagagccgcctggatcatccccttcttctgctaccagatcttcgacttcgccctgaacatgctggtggccatcaccgtgctgatctaccccaacagcatccaggagtacatcagacagctgccccccaacttcccctacagagacgacgtgatgagcgtgaaccccacctgcctggtgctgatcatcctgctgttcatcagcatcatcctgaccttcaagggctacctgatcagctgcgtgtggaactgctacagatacatcaacggcagaaacagcagcgacgtgctggtgtacgtgaccagcaacgacaccaccgtgctgctgcccccctacgacgacgccaccgtgaacggcgccgccaaggagcccccccccccctacgtgagcgcctag

SEQ ID NO: 87548 - DNA, 681 bp, Artificial Sequence
  Description of Artificial Sequence: Synthetic coding sequence
atgaagatggtggccccctggaccagattctacagcaacagctgctgcctgtgctgccacgtgagaaccggcaccatcctgctgggcgtgtggtacctgatcatcaacgccgtggtgctgctgatcctgctgagcgccctggccgaccccgaccagtacaacttcagcagcagcgagctgggcggcgacttcgagttcatggacgacgccaacatgtgcatcgccatcgccatcagcctgctgatgatcctgatctgcgccatggccacctacggcgcctacaagcagagagccgcctggatcatccccttcttctgctaccagatcttcgacttcgccctgaacatgctggtggccatcaccgtgctgatctaccccaacagcatccaggagtacatcagacagctgccccccaacttcccctacagagacgacgtgatgagcgtgaaccccacctgcctggtgctgatcatcctgctgttcatcagcatcatcctgaccttcaagggctacctgatcagctgcgtgtggaactgctacagatacatcaacggcagaaacagcagcgacgtgctggtgtacgtgaccagcaacgacaccaccgtgctgctgcccccctacgacgacgccaccgtgaacggcgccgccaaggagcccccccccccctacgtgagcgcctag

SEQ ID NO: 87549 - DNA, 789 bp, Artificial Sequence
  Description of Artificial Sequence: Synthetic coding sequence
atggaccccagactgagcaccgtgagacagacctgctgctgcttcaacgtgagaatcgccaccaccgccctggccatctaccacgtgatcatgagcgtgctgctgttcatcgagcacagcgtggaggtggcccacggcaaggccagctgcaagctgagccagatgggctacctgagaatcgccgacctgatcagcagcttcctgctgatcaccatgctgttcatcatcagcctgagcctgctgatcggcgtggtgaagaacagagagaagtacctgctgcccttcctgagcctgcagatcatggactacctgctgtgcctgctgaccctgctgggcagctacatcgagctgcccgcctacctgaagctggccagcagaagcagagccagcagcagcaagttccccctgatgaccctgcagctgctggacttctgcctgagcatcctgaccctgtgcagcagctacatggaggtgcccacctacctgaacttcaagagcatgaaccacatgaactacctgcccagccaggaggacatgccccacaaccagttcatcaagatgatgatcatcttcagcatcgccttcatcaccgtgctgatcttcaaggtgtacatgttcaagtgcgtgtggagatgctacagactgatcaagtgcatgaacagcgtggaggagaagagaaacagcaagatgctgcagaaggtggtgctgcccagctacgaggaggccctgagcctgcccagcaagacccccgagggcggccccgccccccccccctacagcgaggtgtag

SEQ ID NO: 87550 - DNA, 873 bp, Artificial Sequence
  Description of Artificial Sequence: Synthetic coding sequence
atggaccccagactgagcaccgtgagacagacctgctgctgcttcaacgtgagaatcgccaccaccgccctggccatctaccacgtgatcatgagcgtgctgctgttcatcgagcacagcgtggaggtggcccacggcaaggccagctgcaagctgagccagatgggctacctgagaatcgccgacctgatcagcagcttcctgctgatcaccatgctgttcatcatcagcctgagcctgctgatcggcgtggtgaagaacagagagaagtacctgctgcccttcctgagcctgcagatcatggactacctgctgtgcctgctgaccctgctgggcagctacatcgagctgcccgcctacctgaagctggccagcagaagcagagccagcagcagcaagttccccctgatgaccctgcagctgctggacttctgcctgagcatcctgaccctgtgcagcagctacatggaggtgcccacctacctgaacttcaagagcatgaaccacatgaactacctgcccagccaggaggacatgccccacaaccagttcatcaagatgatgatcatcttcagcatcgccttcatcaccgtgctgatcttcaaggtgtacatgttcaagtgcgtgtggagatgctacagactgatcaagtgcatgaacagcgtggaggagaagagaaacagcaagatgctgcagaaggtggtgctgcccagctacgaggaggccctgagccccgccggccccgtgagctgcagccagctgggccagagattcagactgagccacagcagcggcctgagcatcatccagcccaacaacgcctggttcatcagcatcagcagcgacacctgcctggacgactggcccttctag

SEQ ID NO: 87551 - DNA, 11406 bp, Artificial Sequence
  Description of Artificial Sequence: Synthetic coding sequence
atgagcaccgacagcaacagcctggccagagagttcctgaccgacgtgaacagactgtgcaacgccgtggtgcagagagtggaggccagagaggaggaggaggaggagacccacatggccaccctgggccagtacctggtgcacggcagaggcttcctgctgctgaccaagctgaacagcatcatcgaccaggccctgacctgcagagaggagctgctgaccctgctgctgagcctgctgcccctggtgtggaagatccccgtgcaggaggagaaggccaccgacttcaacctgcccctgagcgccgacatcatcctgaccaaggagaagaacagcagcagccagagaagcacccaggagaagctgcacctggagggcagcgccctgagcagccaggtgagcgccaaggtgaacgtgttcagaaagagcagaagacagagaaagatcacccacagatacagcgtgagagacgccagaaagacccagctgagcaccagcgacagcgaggccaacagcgacgagaagggcatcgccatgaacaagcacagaagaccccacctgctgcaccacttcctgaccagcttccccaagcaggaccaccccaaggccaagctggacagactggccaccaaggagcagaccccccccgacgccatggccctggagaacagcagagagatcatccccagacagggcagcaacaccgacatcctgagcgagcccgccgccctgagcgtgatcagcaacatgaacaacagccccttcgacctgtgccacgtgctgctgagcctgctggagaaggtgtgcaagttcgacgtgaccctgaaccacaacagccccctggccgccagcgtggtgcccaccctgaccgagttcctggccggcttcggcgactgctgcagcctgagcgacaacctggagagcagagtggtgagcgccggctggaccgaggagcccgtggccctgatccagagaatgctgttcagaaccgtgctgcacctgctgagcgtggacgtgagcaccgccgagatgatgcccgagaacctgagaaagaacctgaccgagctgctgagagccgccctgaagatcagaatctgcctggagaagcagcccgaccccttcgcccccagacagaagaagaccctgcaggaggtgcaggaggacttcgtgttcagcaagtacagacacagagccctgctgctgcccgagctgctggagggcgtgctgcagatcctgatctgctgcctgcagagcgccgccagcaaccccttctacttcagccaggccatggacctggtgcaggagttcatccagcaccacggcttcaacctgttcgagaccgccgtgctgcagatggagtggctggtgctgagagacggcgtgccccccgaggccagcgagcacctgaaggccctgatcaacagcgtgatgaagatcatgagcaccgtgaagaaggtgaagagcgagcagctgcaccacagcatgtgcaccagaaagagacacagaagatgcgagtacagccacttcatgcaccaccacagagacctgagcggcctgctggtgagcgccttcaagaaccaggtgagcaagaaccccttcgaggagaccgccgacggcgacgtgtactaccccgagagatgctgctgcatcgccgtgtgcgcccaccagtgcctgagactgctgcagcaggccagcctgagcagcacctgcgtgcagatcctgagcggcgtgcacaacatcggcatctgctgctgcatggaccccaagagcgtgatcatccccctgctgcacgccttcaagctgcccgccctgaagaacttccagcagcacatcctgaacatcctgaacaagctgatcctggaccagctgggcggcgccgagatcagccccaagatcaagaaggccgcctgcaacatctgcaccgtggacagcgaccagctggcccagctggaggagaccctgcagggcaacctgtgcgacgccgagctgagcagcagcctgagcagccccagctacagattccagggcatcctgcccagcagcggcagcgaggacctgctgtggaagtgggacgccctgaaggcctaccagaacttcgtgttcgaggaggacagactgcacagcatccagatcgccaaccacatctgcaacctgatccagaagggcaacatcgtggtgcagtggaagctgtacaactacatcttcaaccccgtgctgcagagaggcgtggagctggcccaccactgccagcacctgagcgtgaccagcgcccagagccacgtgtgcagccaccacaaccagtgcctgccccaggacgtgctgcagatctacgtgaagaccctgcccatcctgctgaagagcagagtgatcagagacctgttcctgagctgcaacggcgtgagccagatcatcgagctgaactgcctgaacggcatcagaagccacagcctgaaggccttcgagaccctgatcatcagcctgggcgagcagcagaaggacgccagcgtgcccgacatcgacggcatcgacatcgagcagaaggagctgagcagcgtgcacgtgggcaccagcttccaccaccagcaggcctacagcgacagcccccagagcctgagcaagttctacgccggcctgaaggaggcctaccccaagagaagaaagaccgtgaaccaggacgtgcacatcaacaccatcaacctgttcctgtgcgtggccttcctgtgcgtgagcaaggaggccgagagcgacagagagagcgccaacgacagcgaggacaccagcggctacgacagcaccgccagcgagcccctgagccacatgctgccctgcatcagcctggagagcctggtgctgcccagccccgagcacatgcaccaggccgccgacatctggagcatgtgcagatggatctacatgctgagcagcgtgttccagaagcagttctacagactgggcggcttcagagtgtgccacaagctgatcttcatgatcatccagaagctgttcagaagccacaaggaggagcagggcaagaaggagggcgacaccagcgtgaacgagaaccaggacctgaacagaatcagccagcccaagagaaccatgaaggaggacctgctgagcctggccatcaagagcgaccccatccccagcgagctgggcagcctgaagaagagcgccgacagcctgggcaagctggagctgcagcacatcagcagcatcaacgtggaggaggtgagcgccaccgaggccgcccccgaggaggccaagctgttcaccagccaggagagcgagaccagcctgcagagcatcagactgctggaggccctgctggccatctgcctgcacggcgccagaaccagccagcagaagatggagctggagctgcccaaccagaacctgagcgtggagagcatcctgttcgagatgagagaccacctgagccagagcaaggtgatcgagacccagctggccaagcccctgttcgacgccctgctgagagtggccctgggcaactacagcgccgacttcgagcacaacgacgccatgaccgagaagagccaccagagcgccgaggagctgagcagccagcccggcgacttcagcgaggaggccgaggacagccagtgctgcagcttcaagctgctggtggaggaggagggctacgaggccgacagcgagagcaaccccgaggacggcgagacccaggacgacggcgtggacctgaagagcgagaccgagggcttcagcgccagcagcagccccaacgacctgctggagaacctgacccagggcgagatcatctaccccgagatctgcatgctggagctgaacctgctgagcgccagcaaggccaagctggacgtgctggcccacgtgttcgagagcttcctgaagatcatcagacagaaggagaagaacgtgttcctgctgatgcagcagggcaccgtgaagaacctgctgggcggcttcctgagcatcctgacccaggacgacagcgacttccaggcctgccagagagtgctggtggacctgctggtgagcctgatgagcagcagaacctgcagcgaggagctgaccctgctgctgagaatcttcctggagaagagcccctgcaccaagatcctgctgctgggcatcctgaagatcatcgagagcgacaccaccatgagccccagccagtacctgaccttccccctgctgcacgcccccaacctgagcaacggcgtgagcagccagaagtaccccggcatcctgaacagcaaggccatgggcctgctgagaagagccagagtgagcagaagcaagaaggaggccgacagagagagcttcccccacagactgctgagcagctggcacatcgcccccgtgcacctgcccctgctgggccagaactgctggccccacctgagcgagggcttcagcgtgagcctgtggttcaacgtggagtgcatccacgaggccgagagcaccaccgagaagggcaagaagatcaagaagagaaacaagagcctgatcctgcccgacagcagcttcgacggcaccgagagcgacagacccgagggcgccgagtacatcaaccccggcgagagactgatcgaggagggctgcatccacatcatcagcctgggcagcaaggccctgatgatccaggtgtgggccgacccccacaacgccaccctgatcttcagagtgtgcatggacagcaacgacgacatgaaggccgtgctgctggcccaggtggagagccaggagaacatcttcctgcccagcaagtggcagcacctggtgctgacctacctgcagcagccccagggcaagagaagaatccacggcaagatcagcatctgggtgagcggccagagaaagcccgacgtgaccctggacttcatgctgcccagaaagaccagcctgagcagcgacagcaacaagaccttctgcatgatcggccactgcctgagcagccaggaggagttcctgcagctggccggcaagtgggacctgggcaacctgctgctgttcaacggcgccaaggtgggcagccaggaggccttctacctgtacgcctgcggccccaaccacaccagcgtgatgccctgcaagtacggcaagcccgtgaacgactacagcaagtacatcaacaaggagatcctgagatgcgagcagatcagagagctgttcatgaccaagaaggacgtggacatcggcctgctgatcgagagcctgagcgtggtgtacaccacctactgccccgcccagtacaccatctacgagcccgtgatcagactgaagggccagatgaagacccagctgagccagagacccttcagcagcaaggaggtgcagagcatcctgctggagccccaccacctgaagaacctgcagcccaccgagtacaagaccatccagggcatcctgcacgagatcggcggcaccggcatcttcgtgttcctgttcgccagagtggtggagctgagcagctgcgaggagacccaggccctggccctgagagtgatcctgagcctgatcaagtacaaccagcagagagtgcacgagctggagaactgcaacggcctgagcatgatccaccaggtgctgatcaagcagaagtgcatcgtgggcttctacatcctgaagaccctgctggagggctgctgcggcgaggacatcatctacatgaacgagaacggcgagttcaagctggacgtggacagcaacgccatcatccaggacgtgaagctgctggaggagctgctgctggactggaagatctggagcaaggccgagcagggcgtgtgggagaccctgctggccgccctggaggtgctgatcagagccgaccaccaccagcagatgttcaacatcaagcagctgctgaaggcccaggtggtgcaccacttcctgctgacctgccaggtgctgcaggagtacaaggagggccagctgacccccatgcccagagaggtgtgcagaagcttcgtgaagatcatcgccgaggtgctgggcagcccccccgacctggagctgctgaccatcatcttcaacttcctgctggccgtgcacccccccaccaacacctacgtgtgccacaaccccaccaacttctacttcagcctgcacatcgacggcaagatcttccaggagaaggtgagaagcatcatgtacctgagacacagcagcagcggcggcagaagcctgatgagccccggcttcatggtgatcagccccagcggcttcaccgccagcccctacgagggcgagaacagcagcaacatcatcccccagcagatggccgcccacatgctgagaagcagaagcctgcccgccttccccaccagcagcctgctgacccagagccagaagctgaccggcagcctgggctgcagcatcgacagactgcagaacatcgccgacacctacgtggccacccagagcaagaagcagaacagcctgggcagcagcgacaccctgaagaagggcaaggaggacgccttcatcagcagctgcgagagcgccaagaccgtgtgcgagatggaggccgtgctgagcgcccaggtgagcgtgagcgacgtgcccaagggcgtgctgggcttccccgtggtgaaggccgaccacaagcagctgggcgccgagcccagaagcgaggacgacagccccggcgacgagagctgccccagaagacccgactacctgaagggcctggccagcttccagagaagccacagcaccatcgccagcctgggcctggccttccccagccagaacggcagcgccgccgtgggcagatggcccagcctggtggacagaaacaccgacgactgggagaacttcgcctacagcctgggctacgagcccaactacaacagaaccgccagcgcccacagcgtgaccgaggactgcctggtgcccatctgctgcggcctgtacgagctgctgagcggcgtgctgctgatcctgcccgacgtgctgctggaggacgtgatggacaagctgatccaggccgacaccctgctggtgctggtgaaccaccccagccccgccatccagcagggcgtgatcaagctgctggacgcctacttcgccagagccagcaaggagcagaaggacaagttcctgaagaacagaggcttcagcctgctggccaaccagctgtacctgcacagaggcacccaggagctgctggagtgcttcatcgagatgttcttcggcagacacatcggcctggacgaggagttcgacctggaggacgtgagaaacatgggcctgttccagaagtggagcgtgatccccatcctgggcctgatcgagaccagcctgtacgacaacatcctgctgcacaacgccctgctgctgctgctgcagatcctgaacagctgcagcaaggtggccgacatgctgctggacaacggcctgctgtacgtgctgtgcaacaccgtggccgccctgaacggcctggagaagaacatccccatgagcgagtacaagctgctggcctgcgacatccagcagctgttcatcgccgtgaccatccacgcctgcagcagcagcggcagccagtacttcagagtgatcgaggacctgatcgtgatgctgggctacctgcagaacagcaagaacaagagaacccagaacatggccgtggccctgcagctgagagtgctgcaggccgccatggagttcatcagaaccaccgccaaccacgacagcgagaacctgaccgacagcctgcagagccccagcgccccccaccacgccgtggtgcagaagagaaagagcatcgccggccccagaaagttccccctggcccagaccgagagcctgctgatgaagatgagaagcgtggccaacgacgagctgcacgtgatgatgcagagaagaatgagccaggagaaccccagccaggccaccgagaccgagctggcccagagactgcagagactgaccgtgctggccgtgaacagaatcatctaccaggagttcaacagcgacatcatcgacatcctgagaacccccgagaacgtgacccagagcaagaccagcgtgttccagaccgagatcagcgaggagaacatccaccacgagcagagcagcgtgttcaaccccttccagaaggagatcttcacctacctggtggagggcttcaaggtgagcatcggcagcagcaaggccagcggcagcaagcagcagtggaccaagatcctgtggagctgcaaggagaccttcagaatgcagctgggcagactgctggtgcacatcctgagccccgcccacgccgcccaggagagaaagcagatcttcgagatcgtgcacgagcccaaccaccaggagatcctgagagactgcctgagccccagcctgcagcacggcgccaagctggtgctgtacctgagcgagctgatccacaaccaccagggcgagctgaccgaggaggagctgggcaccgccgagctgctgatgaacgccctgaagctgtgcggccacaagtgcatcccccccagcgccagcaccaaggccgacctgatcaagatgatcaaggaggagcagaagaagtacgagaccgaggagggcgtgaacaaggccgcctggcagaagaccgtgaacaacaaccagcagagcctgttccagagactggacagcaagagcaaggacatcagcaagatcgccgccgacatcacccaggccgtgagcctgagccagggcaacgagagaaagaaggtgatccagcacatcagaggcatgtacaaggtggacctgagcgccagcagacactggcaggagctgatccagcagctgacccacgacagagccgtgtggtacgaccccatctactaccccaccagctggcagctggaccccaccgagggccccaacagagagagaagaagactgcagagatgctacctgaccatccccaacaagtacctgctgagagacagacagaagagcgaggacgtggtgaagccccccctgagctacctgttcgaggacaagacccacagcagcttcagcagcaccgtgaaggacaaggccgccagcgagagcatcagagtgaacagaagatgcatcagcgtggcccccagcagagagaccgccggcgagctgctgctgggcaagtgcggcatgtacttcgtggaggacaacgccagcgacaccgtggagagcagcagcctgcagggcgagctggagcccgccagcttcagctggacctacgaggagatcaaggaggtgcacaagagatggtggcagctgagagacaacgccgtggagatcttcctgaccaacggcagaaccctgctgctggccttcgacaacaccaaggtgagagacgacgtgtaccacaacatcctgaccaacaacctgcccaacctgctggagtacggcaacatcaccgccctgaccaacctgtggtacaccggccagatcaccaacttcgagtacctgacccacctgaacaagcacgccggcagaagcttcaacgacctgatgcagtaccccgtgttccccttcatcctggccgactacgtgagcgagaccctggacctgaacgacctgctgatctacagaaacctgagcaagcccatcgccgtgcagtacaaggagaaggaggacagatacgtggacacctacaagtacctggaggaggagtacagaaagggcgccagagaggacgaccccatgccccccgtgcagccctaccactacggcagccactacagcaacagcggcaccgtgctgcacttcctggtgagaatgccccccttcaccaagatgttcctggcctaccaggaccagagcttcgacatccccgacagaaccttccacagcaccaacaccacctggagactgagcagcttcgagagcatgaccgacgtgaaggagctgatccccgagttcttctacctgcccgagttcctggtgaacagagagggcttcgacttcggcgtgagacagaacggcgagagagtgaaccacgtgaacctgcccccctgggccagaaacgaccccagactgttcatcctgatccacagacaggccctggagagcgactacgtgagccagaacatctgccagtggatcgacctggtgttcggctacaagcagaagggcaaggccagcgtgcaggccatcaacgtgttccaccccgccacctacttcggcatggacgtgagcgccgtggaggaccccgtgcagagaagagccctggagaccatgatcaagacctacggccagacccccagacagctgttccacatggcccacgtgagcagacccggcgccaagctgaacatcgagggcgagctgcccgccgccgtgggcctgctggtgcagttcgccttcagagagaccagagagcaggtgaaggagatcacctaccccagccccctgagctggatcaagggcctgaagtggggcgagtacgtgggcagccccagcgcccccgtgcccgtggtgtgcttcagccagccccacggcgagagattcggcagcctgcaggccctgcccaccagagccatctgcggcctgagcagaaacttctgcctgctgatgacctacagcaaggagcagggcgtgagaagcatgaacagcaccgacatccagtggagcgccatcctgagctggggctacgccgacaacatcctgagactgaagagcaagcagagcgagccccccgtgaacttcatccagagcagccagcagtaccaggtgaccagctgcgcctgggtgcccgacagctgccagctgttcaccggcagcaagtgcggcgtgatcaccgcctacaccaacagattcaccagcagcacccccagcgagatcgagatggagacccagatccacctgtacggccacaccgaggagatcaccagcctgttcgtgtgcaagccctacagcatcctgatcagcgtgagcagagacggcacctgcatcatctgggacctgaacagactgtgctacgtgcagagcctggccggccacaagagccccgtgaccgccgtgagcgccagcgagaccagcggcgacatcgccaccgtgtgcgacagcgccggcggcggcagcgacctgagactgtggaccgtgaacggcgacctggtgggccacgtgcactgcagagagatcatctgcagcgtggccttcagcaaccagcccgagggcgtgagcatcaacgtgatcgccggcggcctggagaacggcatcgtgagactgtggagcacctgggacctgaagcccgtgagagagatcaccttccccaagagcaacaagcccatcatcagcctgaccttcagctgcgacggccaccacctgtacaccgccaacagcgacggcaccgtgatcgcctggtgcagaaaggaccagcagagactgaagcagcccatgttctacagcttcctgagcagctacgccgccggctag

SEQ ID NO: 87552 - DNA, 11406 bp, Artificial Sequence; identical to SEQ ID NO: 87551
  Description of Artificial Sequence: Synthetic coding sequence

SEQ ID NO: 87553 - DNA, 4149 bp, Artificial Sequence
  Description of Artificial Sequence: Synthetic coding sequence
atgagcaccgacagcaacagcctggccagagagttcctgaccgacgtgaacagactgtgcaacgccgtggtgcagagagtggaggccagagaggaggaggaggaggagacccacatggccaccctgggccagtacctggtgcacggcagaggcttcctgctgctgaccaagctgaacagcatcatcgaccaggccctgacctgcagagaggagctgctgaccctgctgctgagcctgctgcccctggtgtggaagatccccgtgcaggaggagaaggccaccgacttcaacctgcccctgagcgccgacatcatcctgaccaaggagaagaacagcagcagccagagaagcacccaggagaagctgcacctggagggcagcgccctgagcagccaggtgagcgccaaggtgaacgtgttcagaaagagcagaagacagagaaagatcacccacagatacagcgtgagagacgccagaaagacccagctgagcaccagcgacagcgaggccaacagcgacgagaagggcatcgccatgaacaagcacagaagaccccacctgctgcaccacttcctgaccagcttccccaagcaggaccaccccaaggccaagctggacagactggccaccaaggagcagaccccccccgacgccatggccctggagaacagcagagagatcatccccagacagggcagcaacaccgacatcctgagcgagcccgccgccctgagcgtgatcagcaacatgaacaacagccccttcgacctgtgccacgtgctgctgagcctgctggagaaggtgtgcaagttcgacgtgaccctgaaccacaacagccccctggccgccagcgtggtgcccaccctgaccgagttcctggccggcttcggcgactgctgcagcctgagcgacaacctggagagcagagtggtgagcgccggctggaccgaggagcccgtggccctgatccagagaatgctgttcagaaccgtgctgcacctgctgagcgtggacgtgagcaccgccgagatgatgcccgagaacctgagaaagaacctgaccgagctgctgagagccgccctgaagatcagaatctgcctggagaagcagcccgaccccttcgcccccagacagaagaagaccctgcaggaggtgcaggaggacttcgtgttcagcaagtacagacacagagccctgctgctgcccgagctgctggagggcgtgctgcagatcctgatctgctgcctgcagagcgccgccagcaaccccttctacttcagccaggccatggacctggtgcaggagttcatccagcaccacggcttcaacctgttcgagaccgccgtgctgcagatggagtggctggtgctgagagacggcgtgccccccgaggccagcgagcacctgaaggccctgatcaacagcgtgatgaagatcatgagcaccgtgaagaaggtgaagagcgagcagctgcaccacagcatgtgcaccagaaagagacacagaagatgcgagtacagccacttcatgcaccaccacagagacctgagcggcctgctggtgagcgccttcaagaaccaggtgagcaagaaccccttcgaggagaccgccgacggcgacgtgtactaccccgagagatgctgctgcatcgccgtgtgcgcccaccagtgcctgagactgctgcagcaggccagcctgagcagcacctgcgtgcagatcctgagcggcgtgcacaacatcggcatctgctgctgcatggaccccaagagcgtgatcatccccctgctgcacgccttcaagctgcccgccctgaagaacttccagcagcacatcctgaacatcctgaacaagctgatcctggaccagctgggcggcgccgagatcagccccaagatcaagaaggccgcctgcaacatctgcaccgtggacagcgaccagctggcccagctggaggagaccctgcagggcaacctgtgcgacgccgagctgagcagcagcctgagcagccccagctacagattccagggcatcctgcccagcagcggcagcgaggacctgctgtggaagtgggacgccctgaaggcctaccagaacttcgtgttcgaggaggacagactgcacagcatccagatcgccaaccacatctgcaacctgatccagaagggcaacatcgtggtgcagtggaagctgtacaactacatcttcaaccccgtgctgcagagaggcgtggagctggcccaccactgccagcacctgagcgtgaccagcgcccagagccacgtgtgcagccaccacaaccagtgcctgccccaggacgtgctgcagatctacgtgaagaccctgcccatcctgctgaagagcagagtgatcagagacctgttcctgagctgcaacggcgtgagccagatcatcgagctgaactgcctgaacggcatcagaagccacagcctgaaggccttcgagaccctgatcatcagcctgggcgagcagcagaaggacgccagcgtgcccgacatcgacggcatcgacatcgagcagaaggagctgagcagcgtgcacgtgggcaccagcttccaccaccagcaggcctacagcgacagcccccagagcctgagcaagttctacgccggcctgaaggaggcctaccccaagagaagaaagaccgtgaaccaggacgtgcacatcaacaccatcaacctgttcctgtgcgtggccttcctgtgcgtgagcaaggaggccgagagcgacagagagagcgccaacgacagcgaggacaccagcggctacgacagcaccgccagcgagcccctgagccacatgctgccctgcatcagcctggagagcctggtgctgcccagccccgagcacatgcaccaggccgccgacatctggagcatgtgcagatggatctacatgctgagcagcgtgttccagaagcagttctacagactgggcggcttcagagtgtgccacaagctgatcttcatgatcatccagaagctgttcagaagccacaaggaggagcagggcaagaaggagggcgacaccagcgtgaacgagaaccaggacctgaacagaatcagccagcccaagagaaccatgaaggaggacctgctgagcctggccatcaagagcgaccccatccccagcgagctgggcagcctgaagaagagcgccgacagcctgggcaagctggagctgcagcacatcagcagcatcaacgtggaggaggtgagcgccaccgaggccgcccccgaggaggccaagctgttcaccagccaggagagcgagaccagcctgcagagcatcagactgctggaggccctgctggccatctgcctgcacggcgccagaaccagccagcagaagatggagctggagctgcccaaccagaacctgagcgtggagagcatcctgttcgagatgagagaccacctgagccagagcaaggtgatcgagacccagctggccaagcccctgttcgacgccctgctgagagtggccctgggcaactacagcgccgacttcgagcacaacgacgccatgaccgagaagagccaccagagcgccgaggagctgagcagccagcccggcgacttcagcgaggaggccgaggacagccagtgctgcagcttcaagctgctggtggaggaggagggctacgaggccgacagcgagagcaaccccgaggacggcgagacccaggacgacggcgtggacctgaagagcgagaccgagggcttcagcgccagcagcagccccaacgacctgctggagaacctgacccagggcgagatcatctaccccgagatctgcatgctggagctgaacctgctgagcgccagcaaggccaagctggacgtgctggcccacgtgttcgagagcttcctgaagatcatcagacagaaggagaagaacgtgttcctgctgatgcagcagggcaccgtgaagaacctgctgggcggcttcctgagcatcctgacccaggacgacagcgacttccaggcctgccagagagtgctggtggacctgctggtgagcctgatgagcagcagaacctgcagcgaggagctgaccctgctgctgagaatcttcctggagaagagcccctgcaccagagccaccgaccagaaggtgcagagcacctag

SEQ ID NO: 87554 - DNA, 1254 bp, Artificial Sequence
  Description of Artificial Sequence: Synthetic coding sequence
atggccgcccccggcagcgccagaagacccctgctgctgctgctgctgctgctgctgctgggcctgatgcactgcgccagcgccgccatgttcatggtgaagaacggcaacggcaccgcctgcatcatggccaacttcagcgccgccttcagcgtgaactacgacaccaagagcggccccaagaacatgaccttcgacctgcccagcgacgccaccgtggtgctgaacagaagcagctgcggcaaggagaacaccagcgaccccagcctggtgatcgccttcggcagaggccacaccctgaccctgaacttcaccagaaacgccaccagatacagcgtgcagctgatgagcttcgtgtacaacctgagcgacacccacctgttccccaacgccagcagcaaggagatcaagaccgtggagagcatcaccgacatcagagccgacatcgacaagaagtacagatgcgtgagcggcacccaggtgcacatgaacaacgtgaccgtgaccctgcacgacgccaccatccaggcctacctgagcaacagcagcttcagcagaggcgagaccagatgcgagcaggacagacccagccccaccaccgccccccccgccccccccagccccagccccagccccgtgcccaagagccccagcgtggacaagtacaacgtgagcggcaccaacggcacctgcctgctggccagcatgggcctgcagctgaacctgacctacgagagaaaggacaacaccaccgtgaccagactgctgaacatcaaccccaacaagaccagcgccagcggcagctgcggcgcccacctggtgaccctggagctgcacagcgagggcaccaccgtgctgctgttccagttcggcatgaacgccagcagcagcagattcttcctgcagggcatccagctgaacaccatcctgcccgacgccagagaccccgccttcaaggccgccaacggcagcctgagagccctgcaggccaccgtgggcaacagctacaagtgcaacgccgaggagcacgtgagagtgaccaaggccttcagcgtgaacatcttcaaggtgtgggtgcaggccttcaaggtggagggcggccagttcggcagcgtggaggagtgcctgctggacgagaacagcatgctgatccccatcgccgtgggcggcgccctggccggcctggtgctgatcgtgctgatcgcctacctggtgggcagaaagagaagccacgccggctaccagaccatctag

SEQ ID NO: 87555 - DNA, 1095 bp, Artificial Sequence
  Description of Artificial Sequence: Synthetic coding sequence
atggccgcccccggcagcgccagaagacccctgctgctgctgctgctgctgctgctgctgggcctgatgcactgcgccagcgccgccatgttcatggtgaagaacggcaacggcaccgcctgcatcatggccaacttcagcgccgccttcagcgtgaactacgacaccaagagcggccccaagaacatgaccttcgacctgcccagcgacgccaccgtggtgctgaacagaagcagctgcggcaaggagaacaccagcgaccccagcctggtgatcgccttcggcagaggccacaccctgaccctgaacttcaccagaaacgccaccagatacagcgtgcagctgatgagcttcgtgtacaacctgagcgacacccacctgttccccaacgccagcagcaaggagaccagatgcgagcaggacagacccagccccaccaccgccccccccgccccccccagccccagccccagccccgtgcccaagagccccagcgtggacaagtacaacgtgagcggcaccaacggcacctgcctgctggccagcatgggcctgcagctgaacctgacctacgagagaaaggacaacaccaccgtgaccagactgctgaacatcaaccccaacaagaccagcgccagcggcagctgcggcgcccacctggtgaccctggagctgcacagcgagggcaccaccgtgctgctgttccagttcggcatgaacgccagcagcagcagattcttcctgcagggcatccagctgaacaccatcctgcccgacgccagagaccccgccttcaaggccgccaacggcagcctgagagccctgcaggccaccgtgggcaacagctacaagtgcaacgccgaggagcacgtgagagtgaccaaggccttcagcgtgaacatcttcaaggtgtgggtgcaggccttcaaggtggagggcggccagttcggcagcgtggaggagtgcctgctggacgagaacagcatgctgatccccatcgccgtgggcggcgccctggccggcctggtgctgatcgtgctgatcgcctacctggtgggcagaaagagaagccacgccggctaccagaccatctag

SEQ ID NO: 87556 - DNA, 1233 bp, Artificial Sequence
  Description of Artificial Sequence: Synthetic coding sequence
atggtgtgcttcagactgttccccgtgcccggcagcggcctggtgctggtgtgcctggtgctgggcgccgtgagaagctacgccctggagctgaacctgaccgacagcgagaacgccacctgcctgtacgccaagtggcagatgaacttcaccgtgagatacgagaccaccaacaagacctacaagaccgtgaccatcagcgaccacggcaccgtgacctacaacggcagcatctgcggcgacgaccagaacggccccaagatcgccgtgcagttcggccccggcttcagctggatcgccaacttcaccaaggccgccagcacctacagcatcgacagcgtgagcttcagctacaacaccggcgacaacaccaccttccccgacgccgaggacaagggcatcctgaccgtggacgagctgctggccatcagaatccccctgaacgacctgttcagatgcaacagcctgagcaccctggagaagaacgacgtggtgcagcactactgggacgtgctggtgcaggccttcgtgcagaacggcaccgtgagcaccaacgagttcctgtgcgacaaggacaagaccagcaccgtggcccccaccatccacaccaccgtgcccagccccaccaccacccccacccccaaggagaagcccgaggccggcacctacagcgtgaacaacggcaacgacacctgcctgctggccaccatgggcctgcagctgaacatcacccaggacaaggtggccagcgtgatcaacatcaaccccaacaccacccacagcaccggcagctgcagaagccacaccgccctgctgagactgaacagcagcaccatcaagtacctggacttcgtgttcgccgtgaagaacgagaacagattctacctgaaggaggtgaacatcagcatgtacctggtgaacggcagcgtgttcagcatcgccaacaacaacctgagctactgggacgcccccctgggcagcagctacatgtgcaacaaggagcagaccgtgagcgtgagcggcgccttccagatcaacaccttcgacctgagagtgcagcccttcaacgtgacccagggcaagtacagcaccgcccaggactgcagcgccgacgacgacaacttcctggtgcccatcgccgtgggcgccgccctggccggcgtgctgatcctggtgctgctggcctacttcatcggcctgaagcaccaccacgccggctacgagcagttctag

SEQ ID NO: 87557 - DNA, 1233 bp, Artificial Sequence
  Description of Artificial Sequence: Synthetic coding sequence
atggtgtgcttcagactgttccccgtgcccggcagcggcctggtgctggtgtgcctggtgctgggcgccgtgagaagctacgccctggagctgaacctgaccgacagcgagaacgccacctgcctgtacgccaagtggcagatgaacttcaccgtgagatacgagaccaccaacaagacctacaagaccgtgaccatcagcgaccacggcaccgtgacctacaacggcagcatctgcggcgacgaccagaacggccccaagatcgccgtgcagttcggccccggcttcagctggatcgccaacttcaccaaggccgccagcacctacagcatcgacagcgtgagcttcagctacaacaccggcgacaacaccaccttccccgacgccgaggacaagggcatcctgaccgtggacgagctgctggccatcagaatccccctgaacgacctgttcagatgcaacagcctgagcaccctggagaagaacgacgtggtgcagcactactgggacgtgctggtgcaggccttcgtgcagaacggcaccgtgagcaccaacgagttcctgtgcgacaaggacaagaccagcaccgtggcccccaccatccacaccaccgtgcccagccccaccaccacccccacccccaaggagaagcccgaggccggcacctacagcgtgaacaacggcaacgacacctgcctgctggccaccatgggcctgcagctgaacatcacccaggacaaggtggccagcgtgatcaacatcaaccccaacaccacccacagcaccggcagctgcagaagccacaccgccctgctgagactgaacagcagcaccatcaagtacctggacttcgtgttcgccgtgaagaacgagaacagattctacctgaaggaggtgaacatcagcatgtacctggtgaacggcagcgtgttcagcatcgccaacaacaacctgagctactgggacgcccccctgggcagcagctacatgtgcaacaaggagcagaccgtgagcgtgagcggcgccttccagatcaacaccttcgacctgagagtgcagcccttcaacgtgacccagggcaagtacagcaccgcccaggagtgcagcctggacgacgacaccatcctgatccccatcatcgtgggcgccggcctgagcggcctgatcatcgtgatcgtgatcgcctacgtgatcggcagaagaaagagctacgccggctaccagaccctgtag

SEQ ID NO: 87558 - DNA, 1236 bp, Artificial Sequence
  Description of Artificial Sequence: Synthetic coding sequence
atggtgtgcttcagactgttccccgtgcccggcagcggcctggtgctggtgtgcctggtgctgggcgccgtgagaagctacgccctggagctgaacctgaccgacagcgagaacgccacctgcctgtacgccaagtggcagatgaacttcaccgtgagatacgagaccaccaacaagacctacaagaccgtgaccatcagcgaccacggcaccgtgacctacaacggcagcatctgcggcgacgaccagaacggccccaagatcgccgtgcagttcggccccggcttcagctggatcgccaacttcaccaaggccgccagcacctacagcatcgacagcgtgagcttcagctacaacaccggcgacaacaccaccttccccgacgccgaggacaagggcatcctgaccgtggacgagctgctggccatcagaatccccctgaacgacctgttcagatgcaacagcctgagcaccctggagaagaacgacgtggtgcagcactactgggacgtgctggtgcaggccttcgtgcagaacggcaccgtgagcaccaacgagttcctgtgcgacaaggacaagaccagcaccgtggcccccaccatccacaccaccgtgcccagccccaccaccacccccacccccaaggagaagcccgaggccggcacctacagcgtgaacaacggcaacgacacctgcctgctggccaccatgggcctgcagctgaacatcacccaggacaaggtggccagcgtgatcaacatcaaccccaacaccacccacagcaccggcagctgcagaagccacaccgccctgctgagactgaacagcagcaccatcaagtacctggacttcgtgttcgccgtgaagaacgagaacagattctacctgaaggaggtgaacatcagcatgtacctggtgaacggcagcgtgttcagcatcgccaacaacaacctgagctactgggacgcccccctgggcagcagctacatgtgcaacaaggagcagaccgtgagcgtgagcggcgccttccagatcaacaccttcgacctgagagtgcagcccttcaacgtgacccagggcaagtacagcaccgccgaggagtgcagcgccgacagcgacctgaacttcctgatccccgtggccgtgggcgtggccctgggcttcctgatcatcgtggtgttcatcagctacatgatcggcagaagaaagagcagaaccggctaccagagcgtgtag

SEQ ID NO: 87559 - DNA, 903 bp, Artificial Sequence
  Description of Artificial Sequence: Synthetic coding sequence
atggtgtgcttcagactgttccccgtgcccggcagcggcctggtgctggtgtgcctggtgctgggcatcctgaccgtggacgagctgctggccatcagaatccccctgaacgacctgttcagatgcaacagcctgagcaccctggagaagaacgacgtggtgcagcactactgggacgtgctggtgcaggccttcgtgcagaacggcaccgtgagcaccaacgagttcctgtgcgacaaggacaagaccagcaccgtggcccccaccatccacaccaccgtgcccagccccaccaccacccccacccccaaggagaagcccgaggccggcacctacagcgtgaacaacggcaacgacacctgcctgctggccaccatgggcctgcagctgaacatcacccaggacaaggtggccagcgtgatcaacatcaaccccaacaccacccacagcaccggcagctgcagaagccacaccgccctgctgagactgaacagcagcaccatcaagtacctggacttcgtgttcgccgtgaagaacgagaacagattctacctgaaggaggtgaacatcagcatgtacctggtgaacggcagcgtgttcagcatcgccaacaacaacctgagctactgggacgcccccctgggcagcagctacatgtgcaacaaggagcagaccgtgagcgtgagcggcgccttccagatcaacaccttcgacctgagagtgcagcccttcaacgtgacccagggcaagtacagcaccgccgaggagtgcagcgccgacagcgacctgaacttcctgatccccgtggccgtgggcgtggccctgggcttcctgatcatcgtggtgttcatcagctacatgatcggcagaagaaagagcagaaccggctaccagagcgtgtag

SEQ ID NO: 87560 - DNA, 1092 bp, Artificial Sequence
  Description of Artificial Sequence: Synthetic coding sequence
atgaacttcaccgtgagatacgagaccaccaacaagacctacaagaccgtgaccatcagcgaccacggcaccgtgacctacaacggcagcatctgcggcgacgaccagaacggccccaagatcgccgtgcagttcggccccggcttcagctggatcgccaacttcaccaaggccgccagcacctacagcatcgacagcgtgagcttcagctacaacaccggcgacaacaccaccttccccgacgccgaggacaagggcatcctgaccgtggacgagctgctggccatcagaatccccctgaacgacctgttcagatgcaacagcctgagcaccctggagaagaacgacgtggtgcagcactactgggacgtgctggtgcaggccttcgtgcagaacggcaccgtgagcaccaacgagttcctgtgcgacaaggacaagaccagcaccgtggcccccaccatccacaccaccgtgcccagccccaccaccacccccacccccaaggagaagcccgaggccggcacctacagcgtgaacaacggcaacgacacctgcctgctggccaccatgggcctgcagctgaacatcacccaggacaaggtggccagcgtgatcaacatcaaccccaacaccacccacagcaccggcagctgcagaagccacaccgccctgctgagactgaacagcagcaccatcaagtacctggacttcgtgttcgccgtgaagaacgagaacagattctacctgaaggaggtgaacatcagcatgtacctggtgaacggcagcgtgttcagcatcgccaacaacaacctgagctactgggacgcccccctgggcagcagctacatgtgcaacaaggagcagaccgtgagcgtgagcggcgccttccagatcaacaccttcgacctgagagtgcagcccttcaacgtgacccagggcaagtacagcaccgcccaggagtgcagcctggacgacgacaccatcctgatccccatcatcgtgggcgccggcctgagcggcctgatcatcgtgatcgtgatcgcctacgtgatcggcagaagaaagagctacgccggctaccagaccctgtag

SEQ ID NO: 87561 - DNA, 447 bp, Artificial Sequence
  Description of Artificial Sequence: Synthetic coding sequence
atgaaggccctgatcgtgctgggcctggtgctgctgagcgtgaccgtgcagggcaaggtgttcgagagatgcgagctggccagaaccctgaagagactgggcatggacggctacagaggcatcagcctggccaactggatgtgcctggccaagtgggagagcggctacaacaccagagccaccaactacaacgccggcgacagaagcaccgactacggcatcttccagatcaacagcagatactggtgcaacgacggcaagacccccggcgccgtgaacgcctgccacctgagctgcagcgccctgctgcaggacaacatcgccgacgccgtggcctgcgccaagagagtggtgagagacccccagggcatcagagcctgggtggcctggagaaacagatgccagaacagagacgtgagacagtacgtgcagggctgcggcgtgtag

SEQ ID NO: 87562 - DNA, 585 bp, Artificial Sequence
  Description of Artificial Sequence: Synthetic coding sequence
atgcaggacgcccccctgagctgcctgagccccaccaagtggagcagcgtgagcagcgccgacagcaccgagaagagcgccagcgccgccggcaccagaaacctgcccttccagttctgcctgagacaggccctgagaatgaaggccgccggcatcctgaccctgatcggctgcctggtgaccggcgccgagagcaagatctacaccagatgcaagctggccaagatcttcagcagagccggcctggacaactactggggcttcagcctgggcaactggatctgcatggcctactacgagagcggctacaacaccaccgcccagaccgtgctggacgacggcagcatcgactacggcatcttccagatcaacagcttcgcctggtgcagaagaggcaagctgaaggagaacaaccactgccacgtggcctgcagcgccctggtgaccgacgacctgaccgacgccatcatctgcgccaagaagatcgtgaaggagacccagggcatgaactactggcagggctggaagaagcactgcgagggcagagacctgagcgactggaagaaggactgcgaggtgagctag

SEQ ID NO: 87563 - DNA, 441 bp, Artificial Sequence
  Description of Artificial Sequence: Synthetic coding sequence
atgaaggccagcgtggtgctgagcctgctgggctacctggtggtgcccagcggcgcctacatcctgggcagatgcaccgtggccaagaagctgcacgacggcggcctggactacttcgagggctacagcctggagaactgggtgtgcctggcctacttcgagagcaagttcaaccccatggccatctacgagaacaccagagagggctacaccggcttcggcctgttccagatgagaggcagcgactggtgcggcgaccacggcagaaacagatgccacatgagctgcagcgccctgctgaaccccaacctggagaagaccatcaagtgcgccaagaccatcgtgaagggcaaggagggcatgggcgcctggcccacctggagcagatactgccagtacagcgacaccctggccagatggctggacggctgcaagctgtag

SEQ ID NO: 87564 - DNA, 441 bp, Artificial Sequence; identical to SEQ ID NO: 87563
  Description of Artificial Sequence: Synthetic coding sequence

SEQ ID NO: 87565 - DNA, 447 bp, Artificial Sequence
  Description of Artificial Sequence: Synthetic coding sequence
atgaccaaggccctgctgatctacctggtgagcagcttcctggccctgaaccaggccagcctgatcagcagatgcgacctggcccaggtgctgcagctggaggacctggacggcttcgagggctacagcctgagcgactggctgtgcctggccttcgtggagagcaagttcaacatcagcaagatcaacgagaacgccgacggcagcttcgactacggcctgttccagatcaacagccactactggtgcaacgactacaagagctacagcgagaacctgtgccacgtggactgccaggacctgctgaaccccaacctgctggccggcatccactgcgccaagagaatcgtgagcggcgccagaggcatgaacaactgggtggagtggagactgcactgcagcggcagacccctgttctactggctgaccggctgcagactgagatag

SEQ ID NO: 87566 - DNA, 447 bp, Artificial Sequence; identical to SEQ ID NO: 87565
  Description of Artificial Sequence: Synthetic coding sequence

SEQ ID NO: 87567 - DNA, 447 bp, Artificial Sequence; identical to SEQ ID NO: 87565
  Description of Artificial Sequence: Synthetic coding sequence

SEQ ID NO: 87568 - DNA, 2952 bp, Artificial Sequence
  Description of Artificial Sequence: Synthetic coding sequence
atggagatgaagctgcccggccaggagggcttcgaggccagcagcgcccccagaaacatccccagcggcgagctggacagcaaccccgaccccggcaccggccccagccccgacggccccagcgacaccgagagcaaggagctgggcgtgcccaaggaccccctgctgttcatccagctgaacgagctgctgggctggccccaggccctggagtggagagagaccggcagcagcagcgccagcctgctgctggacatgggcgagatgcccagcatcaccctgagcacccacctgcaccacagatgggtgctgttcgaggagaagctggaggtggccgccggcagatggagcgccccccacgtgcccaccctggccctgcccagcctgcagaagctgagaagcctgctggccgagggcctggtgctgctggactgccccgcccagagcctgctggagctggtggagcaggtgaccagagtggagagcctgagccccgagctgagaggccagctgcaggccctgctgctgcagagaccccagcactacaaccagaccaccggcaccagaccctgctggggcagcacccaccccagaaaggccagcgacaacgaggaggcccccctgagagagcagtgccagaaccccctgagacagaagctgccccccggcgccgaggccggcaccgtgctggccggcgagctgggcttcctggcccagcccctgggcgccttcgtgagactgagaaaccccgtggtgctgggcagcctgaccgaggtgagcctgcccagcagattcttctgcctgctgctgggcccctgcatgctgggcaagggctaccacgagatgggcagagccgccgccgtgctgctgagcgacccccagttccagtggagcgtgagaagagccagcaacctgcacgacctgctggccgccctggacgccttcctggaggaggtgaccgtgctgccccccggcagatgggaccccaccgccagaatccccccccccaagtgcctgcccagccagcacaagagactgcccagccagcagagagagatcagaggccccgccgtgcccagactgaccagcgccgaggacagacacagacacggcccccacgcccacagccccgagctgcagagaaccggcagactgttcggcggcctgatccaggacgtgagaagaaaggtgccctggtaccccagcgacttcctggacgccctgcacctgcagtgcttcagcgccgtgctgtacatctacctggccaccgtgaccaacgccatcaccttcggcggcctgctgggcgacgccaccgacggcgcccagggcgtgctggagagcttcctgggcaccgccgtggccggcgccgccttctgcctgatggccggccagcccctgaccatcctgagcagcaccggccccgtgctggtgttcgagagactgctgttcagcttcagcagagactacagcctggactacctgcccttcagactgtgggtgggcatctgggtggccaccttctgcctggtgctggtggccaccgaggccagcgtgctggtgagatacttcaccagattcaccgaggagggcttctgcgccctgatcagcctgatcttcatctacgacgccgtgggcaagatgctgaacctgacccacacctaccccatccagaagcccggcagcagcgcctacggctgcctgtgccagtaccccggccccggcggcaacgagagccagtggatcagaaccagacccaaggacagagacgacatcgtgagcatggacctgggcctgatcaacgccagcctgctgcccccccccgagtgcaccagacagggcggccaccccagaggccccggctgccacaccgtgcccgacatcgccttcttcagcctgctgctgttcctgaccagcttcttcttcgccatggccctgaagtgcgtgaagaccagcagattcttccccagcgtggtgagaaagggcctgagcgacttcagcagcgtgctggccatcctgctgggctgcggcctggacgccttcctgggcctggccacccccaagctgatggtgcccagagagttcaagcccaccctgcccggcagaggctggctggtgagccccttcggcgccaacccctggtggtggagcgtggccgccgccctgcccgccctgctgctgagcatcctgatcttcatggaccagcagatcaccgccgtgatcctgaacagaatggagtacagactgcagaagggcgccggcttccacctggacctgttctgcgtggccgtgctgatgctgctgaccagcgccctgggcctgccctggtacgtgagcgccaccgtgatcagcctggcccacatggacagcctgagaagagagagcagagcctgcgcccccggcgagagacccaacttcctgggcatcagagagcagagactgaccggcctggtggtgttcatcctgaccggcgccagcatcttcctggcccccgtgctgaagttcatccccatgcccgtgctgtacggcatcttcctgtacatgggcgtggccgccctgagcagcatccagttcaccaacagagtgaagctgctgctgatgcccgccaagcaccagcccgacctgctgctgctgagacacgtgcccctgaccagagtgcacctgttcaccgccatccagctggcctgcctgggcctgctgtggatcatcaagagcacccccgccgccatcatcttccccctgatgctgctgggcctggtgggcgtgagaaaggccctggagagagtgttcagcccccaggagctgctgtggctggacgagctgatgcccgaggaggagagaagcatccccgagaagggcctggagcccgagcacagcttcagcggcagcgacagcgaggacagcgagctgatgtaccagcccaaggcccccgagatcaacatcagcgtgaactag

SEQ ID NO: 87569 - DNA, 123 bp, Artificial Sequence
  Description of Artificial Sequence: Synthetic coding sequence
atgagattcgcctggaccgtgctgctgctgggccccctgcagctgtgcgccctggtgcactgcgccccccccgccgccggccagcagcagccccccagagagccccccgccgcccccggctag

SEQ ID NO: 87570 - DNA, 1134 bp, Artificial Sequence
  Description of Artificial Sequence: Synthetic coding sequence
atgagattcgcctggaccgtgctgctgctgggccccctgcagctgtgcgccctggtgcactgcgccccccccgccgccggccagcagcagccccccagagagccccccgccgcccccggcgccgccagcgcccagcagcccagaacccccatcctgctgatcagagacaacagaaccgccgccgccagaaccagaaccgccggcagcagcggcgtgaccgccggcagacccagacccaccgccagacactggttccaggccggctacagcaccagcagagccagagaggccggcgccagcagagccgagaaccagaccgcccccggcgaggtgcccgccctgagcaacctgagaccccccagcagagtggacggcatggtgggcgacgacccctacaacccctacaagtacagcgacgacaacccctactacaactactacgacacctacgagagacccagacccggcggcagatacagacccggctacggcaccggctacttccagtacggcctgcccgacctggtggccgacccctactacatccaggccagcacctacgtgcagaagatgagcatgtacaacctgagatgcgccgccgaggagaactgcctggccagcaccgcctacagagccgacgtgagagactacgaccacagagtgctgctgagattcccccagagagtgaagaaccagggcaccagcgacttcctgcccagcagacccagatacagctgggagtggcacagctgccaccagcactaccacagcatggacgagttcagccactacgacctgctggacgccaacacccagagaagagtggccgagggccacaaggccagcttctgcctggaggacaccagctgcgactacggctaccacagaagattcgcctgcaccgcccacacccagggcctgagccccggctgctacgacacctacggcgccgacatcgactgccagtggatcgacatcaccgacgtgaagcccggcaactacatcctgaaggtgagcgtgaaccccagctacctggtgcccgagagcgactacaccaacaacgtggtgagatgcgacatcagatacaccggccaccacgcctacgccagcggctgcaccatcagcccctactag

SEQ ID NO: 87571 - DNA, 2325 bp, Artificial Sequence
  Description of Artificial Sequence: Synthetic coding sequence
atggagagacccctgtgcagccacctgtgcagctgcctggccatgctggccctgctgagccccctgagcctggcccagtacgacagctggccccactaccccgagtacttccagcagcccgcccccgagtaccaccagccccaggcccccgccaacgtggccaagatccagctgagactggccggccagaagagaaagcacagcgagggcagagtggaggtgtactacgacggccagtggggcaccgtgtgcgacgacgacttcagcatccacgccgcccacgtggtgtgcagagagctgggctacgtggaggccaagagctggaccgccagcagcagctacggcaagggcgagggccccatctggctggacaacctgcactgcaccggcaacgaggccaccctggccgcctgcaccagcaacggctggggcgtgaccgactgcaagcacaccgaggacgtgggcgtggtgtgcagcgacaagagaatccccggcttcaagttcgacaacagcctgatcaaccagatcgagaacctgaacatccaggtggaggacatcagaatcagagccatcctgagcacctacagaaagagaacccccgtgatggagggctacgtggaggtgaaggagggcaagacctggaagcagatctgcgacaagcactggaccgccaagaacagcagagtggtgtgcggcatgttcggcttccccggcgagagaacctacaacaccaaggtgtacaagatgttcgccagcagaagaaagcagagatactggcccttcagcatggactgcaccggcaccgaggcccacatcagcagctgcaagctgggcccccaggtgagcctggaccccatgaagaacgtgacctgcgagaacggcctgcccgccgtggtgagctgcgtgcccggccaggtgttcagccccgacggccccagcagattcagaaaggcctacaagcccgagcagcccctggtgagactgagaggcggcgcctacatcggcgagggcagagtggaggtgctgaagaacggcgagtggggcaccgtgtgcgacgacaagtgggacctggtgagcgccagcgtggtgtgcagagagctgggcttcggcagcgccaaggaggccgtgaccggcagcagactgggccagggcatcggccccatccacctgaacgagatccagtgcaccggcaacgagaagagcatcatcgactgcaagttcaacgccgagagccagggctgcaaccacgaggaggacgccggcgtgagatgcaacacccccgccatgggcctgcagaagaagctgagactgaacggcggcagaaacccctacgagggcagagtggaggtgctggtggagagaaacggcagcctggtgtggggcatggtgtgcggccagaactggggcatcgtggaggccatggtggtgtgcagacagctgggcctgggcttcgccagcaacgccttccaggagacctggtactggcacggcgacgtgaacagcaacaaggtggtgatgagcggcgtgaagtgcagcggcaccgagctgagcctggcccactgcagacacgacggcgaggacgtggcctgcccccagggcggcgtgcagtacggcgccggcgtggcctgcagcgagaccgcccccgacctggtgctgaacgccgagatggtgcagcagaccacctacctggaggacagacccatgttcatgctgcagtgcgccatggaggagaactgcctgagcgccagcgccgcccagaccgaccccaccaccggctacagaagactgctgagattcagcagccagatccacaacaacggccagagcgacttcagacccaagaacggcagacacgcctggatctggcacgactgccacagacactaccacagcatggaggtgttcacccactacgacctgctgaacctgaacggcaccaaggtggccgagggccacaaggccagcttctgcctggaggacaccgagtgcgagggcgacatccagaagaactacgagtgcgccaacttcggcgaccagggcatcaccatgggctgctgggacatgtacagacacgacatcgactgccagtgggtggacatcaccgacgtgccccccggcgactacctgttccaggtggtgatcaaccccaacttcgaggtggccgagagcgactacagcaacaacatcatgaagtgcagaagcagatacgacggccacagaatctggatgtacaactgccacatcggcggcagcttcagcgaggagaccgagaagaagttcgagcacttcagcggcctgctgaacaaccagctgagcccccagtag

SEQ ID NO: 87572 - DNA, 456 bp, Artificial Sequence
  Description of Artificial Sequence: Synthetic coding sequence
atggagagacccctgtgcagccacctgtgcagctgcctggccatgctggccctgctgagccccctgagcctggcccagtacgacagctggccccactaccccgagtacttccagcagcccgcccccgagtaccaccagccccaggcccccgccaacgtggccaagatccagctgagactggccggccagaagagaaagcacagcgagggcagagtggaggtgtactacgacggccagtggggcaccgtgtgcgacgacgacttcagcatccacgccgcccacgtggtgtgcagagagctgggctacgtggaggccaagagctggaccgccagcagcagctacggcaagggcgagggccccatctggctggacaacctgcactgcaccggcaacgaggccaccctggccgcctgcaccagcaacggctggggcgtgaccgactgcaagcacacctag

SEQ ID NO: 87573 - DNA, 291 bp, Artificial Sequence
  Description of Artificial Sequence: Synthetic coding sequence
atggagagacccctgtgcagccacctgtgcagctgcctggccatgctggccctgctgagccccctgagcctggcccagtacgacagctggccccactaccccgagtacttccagcagcccgcccccgagtaccaccagccccaggcccccgccaacgtggccaagatccagctgagactggccggccagaagagaaagcacagcgagggcagagtggaggtgtactacgacggccagtggggcaccgtgtgcgacgacgacttcagcatccacgccgcccacgtggtgtag

SEQ ID NO: 87574 - DNA, 420 bp, Artificial Sequence
  Description of Artificial Sequence: Synthetic coding sequence
atggagagacccctgtgcagccacctgtgcagctgcctggccatgctggccctgctgagccccctgagcctggcccagtacgacagctggccccactaccccgagtacttccagcagcccgcccccgagtaccaccagccccaggcccccgccaacgtggccaagatccagctgagactggccggccagaagagaaagcacagcgagggcagagtggaggtgtactacgacggccagtggggcaccgtgtgcgacgacgacttcagcatccacgccgcccacgtggtgtgcagagagctgggctacgtggaggccaagagctggaccgccagcagcagctacggcaagggcgagggccccatctggctggacaacctgcactgcaccggcaacgaggccaccctggccgcctgcacctag

SEQ ID NO: 87575 - DNA, 2262 bp, Artificial Sequence
  Description of Artificial Sequence: Synthetic coding sequence
atgagacccgtgagcgtgtggcagtggagcccctggggcctgctgctgtgcctgctgtgcagcagctgcctgggcagccccagccccagcaccggccccgagaagaaggccggcagccagggcctgagattcagactggccggcttccccagaaagccctacgagggcagagtggagatccagagagccggcgagtggggcaccatctgcgacgacgacttcaccctgcaggccgcccacatcctgtgcagagagctgggcttcaccgaggccaccggctggacccacagcgccaagtacggccccggcaccggcagaatctggctggacaacctgagctgcagcggcaccgagcagagcgtgaccgagtgcgccagcagaggctggggcaacagcgactgcacccacgacgaggacgccggcgtgatctgcaaggaccagagactgcccggcttcagcgacagcaacgtgatcgaggtggagcaccacctgcaggtggaggaggtgagaatcagacccgccgtgggctggggcagaagacccctgcccgtgaccgagggcctggtggaggtgagactgcccgacggctggagccaggtgtgcgacaagggctggagcgcccacaacagccacgtggtgtgcggcatgctgggcttccccagcgagaagagagtgaacgccgccttctacagactgctggcccagagacagcagcacagcttcggcctgcacggcgtggcctgcgtgggcaccgaggcccacctgagcctgtgcagcctggagttctacagagccaacgacaccgccagatgccccggcggcggccccgccgtggtgagctgcgtgcccggccccgtgtacgccgccagcagcggccagaagaagcagcagcagagcaagccccagggcgaggccagagtgagactgaagggcggcgcccaccccggcgagggcagagtggaggtgctgaaggccagcacctggggcaccgtgtgcgacagaaagtgggacctgcacgccgccagcgtggtgtgcagagagctgggcttcggcagcgccagagaggccctgagcggcgccagaatgggccagggcatgggcgccatccacctgagcgaggtgagatgcagcggccaggagctgagcctgtggaagtgcccccacaagaacatcaccgccgaggactgcagccacagccaggacgccggcgtgagatgcaacctgccctacaccggcgccgagaccagaatcagactgagcggcggcagaagccagcacgagggcagagtggaggtgcagatcggcggccccggccccctgagatggggcctgatctgcggcgacgactggggcaccctggaggccatggtggcctgcagacagctgggcctgggctacgccaaccacggcctgcaggagacctggtactgggacagcggcaacatcaccgaggtggtgatgagcggcgtgagatgcaccggcaccgagctgagcctggaccagtgcgcccaccacggcacccacatcacctgcaagagaaccggcaccagattcaccgccggcgtgatctgcagcgagaccgccagcgacctgctgctgcacagcgccctggtgcaggagaccgcctacatcgaggacagacccctgcacatgctgtactgcgccgccgaggagaactgcctggccagcagcgccagaagcgccaactggccctacggccacagaagactgctgagattcagcagccagatccacaacctgggcagagccgacttcagacccaaggccggcagacacagctgggtgtggcacgagtgccacggccactaccacagcatggacatcttcacccactacgacatcctgacccccaacggcaccaaggtggccgagggccacaaggccagcttctgcctggaggacaccgagtgccaggaggacgtgagcaagagatacgagtgcgccaacttcggcgagcagggcatcaccgtgggctgctgggacctgtacagacacgacatcgactgccagtggatcgacatcaccgacgtgaagcccggcaactacatcctgcaggtggtgatcaaccccaacttcgaggtggccgagagcgacttcaccaacaacgccatgaagtgcaactgcaagtacgacggccacagaatctgggtgcacaactgccacatcggcgacgccttcagcgaggaggccaacagaagattcgagagataccccggccagaccagcaaccagatcatctag

SEQ ID NO: 87576 - DNA, 1827 bp, Artificial Sequence
  Description of Artificial Sequence: Synthetic coding sequence
atgagacccgtgagcgtgtggcagtggagcccctggggcctgctgctgtgcctgctgtgcagcagctgcctgggcagccccagccccagcaccggccccgagaagaaggccggcagccagggcctgagattcagactggccggcttccccagaaagccctacgagggcagagtggagatccagagagccggcgagtggggcaccatctgcgacgacgacttcaccctgcaggccgcccacatcctgtgcagagagctgggcttcaccgaggccaccggctggacccacagcgccaagtacggccccggcaccggcagaatctggctggacaacctgagctgcagcggcaccgagcagagcgtgaccgagtgcgccagcagaggctggggcaacagcgactgcacccacgacgaggacgccggcgtgatctgcaaggaccagagactgcccggcttcagcgacagcaacgtgatcgaggccagagtgagactgaagggcggcgcccaccccggcgagggcagagtggaggtgctgaaggccagcacctggggcaccgtgtgcgacagaaagtgggacctgcacgccgccagcgtggtgtgcagagagctgggcttcggcagcgccagagaggccctgagcggcgccagaatgggccagggcatgggcgccatccacctgagcgaggtgagatgcagcggccaggagctgagcctgtggaagtgcccccacaagaacatcaccgccgaggactgcagccacagccaggacgccggcgtgagatgcaacctgccctacaccggcgccgagaccagaatcagactgagcggcggcagaagccagcacgagggcagagtggaggtgcagatcggcggccccggccccctgagatggggcctgatctgcggcgacgactggggcaccctggaggccatggtggcctgcagacagctgggcctgggctacgccaaccacggcctgcaggagacctggtactgggacagcggcaacatcaccgaggtggtgatgagcggcgtgagatgcaccggcaccgagctgagcctggaccagtgcgcccaccacggcacccacatcacctgcaagagaaccggcaccagattcaccgccggcgtgatctgcagcgagaccgccagcgacctgctgctgcacagcgccctggtgcaggagaccgcctacatcgaggacagacccctgcacatgctgtactgcgccgccgaggagaactgcctggccagcagcgccagaagcgccaactggccctacggccacagaagactgctgagattcagcagccagatccacaacctgggcagagccgacttcagacccaaggccggcagacacagctgggtgtggcacgagtgccacggccactaccacagcatggacatcttcacccactacgacatcctgacccccaacggcaccaaggtggccgagggccacaaggccagcttctgcctggaggacaccgagtgccaggaggacgtgagcaagagatacgagtgcgccaacttcggcgagcagggcatcaccgtgggctgctgggacctgtacagacacgacatcgactgccagtggatcgacatcaccgacgtgaagcccggcaactacatcctgcaggtggtgatcaaccccaacttcgaggtggccgagagcgacttcaccaacaacgccatgaagtgcaactgcaagtacgacggccacagaatctgggtgcacaactgccacatcggcgacgccttcagcgaggaggccaacagaagattcgagagataccccggccagaccagcaaccagatcatctag

SEQ ID NO: 87577 - DNA, 2094 bp, Artificial Sequence
  Description of Artificial Sequence: Synthetic coding sequence
atgagacccgtgagcgtgtggcagtggagcccctggggcctgctgctgtgcctgctgtgcagcagctgcctgggcagccccagccccagcaccggccccgagaagaaggccggcagccagggcctgagattcagactggccggcttccccagaaagccctacgagggcagagtggagatccagagagccggcgagtggggcaccatctgcgacgacgacttcaccctgcaggccgcccacatcctgtgcagagagctgggcttcaccgaggccaccggctggacccacagcgccaagtacggccccggcaccggcagaatctggctggacaacctgagctgcagcggcaccgagcagagcgtgaccgagtgcgccagcagaggctggggcaacagcgactgcacccacgacgaggacgccggcgtgatctgcaaggaccagagactgcccggcttcagcgacagcaacgtgatcgaggtggagcaccacctgcaggtggaggaggtgagaatcagacccgccgtgggctggggcagaagacccctgcccgtgaccgagggcctggtggaggtgagactgcccgacggctggagccaggtgtgcgacaagggctggagcgcccacaacagccacgtggtgtgcggcatgctgggcttccccagcgagaagagagtgaacgccgccttctacagactgctggcccagagacagcagcacagcttcggcctgcacggcgtggcctgcgtgggcaccgaggcccacctgagcctgtgcagcctggagttctacagagccaacgacaccgccagatgccccggcggcggccccgccgtggtgagctgcgtgcccggccccgtgtacgccgccagcagcggccagaagaagcagcagcagagcaagccccagggcgaggccagagtgagactgaagggcggcgcccaccccggcgagggcagagtggaggtgctgaaggccagcacctggggcaccgtgtgcgacagaaagtgggacctgcacgccgccagcgtggtgtgcagagagctgggcttcggcagcgccagagaggccctgagcggcgccagaatgggccagggcatgggcgccatccacctgagcgaggtgagatgcagcggccaggagctgagcctgtggaagtgcccccacaagaacatcaccgccgaggactgcagccacagccaggacgccggcgtgagatgcaacctgccctacaccggcgccgagaccagagagacctggtactgggacagcggcaacatcaccgaggtggtgatgagcggcgtgagatgcaccggcaccgagctgagcctggaccagtgcgcccaccacggcacccacatcacctgcaagagaaccggcaccagattcaccgccggcgtgatctgcagcgagaccgccagcgacctgctgctgcacagcgccctggtgcaggagaccgcctacatcgaggacagacccctgcacatgctgtactgcgccgccgaggagaactgcctggccagcagcgccagaagcgccaactggccctacggccacagaagactgctgagattcagcagccagatccacaacctgggcagagccgacttcagacccaaggccggcagacacagctgggtgtggcacgagtgccacggccactaccacagcatggacatcttcacccactacgacatcctgacccccaacggcaccaaggtggccgagggccacaaggccagcttctgcctggaggacaccgagtgccaggaggacgtgagcaagagatacgagtgcgccaacttcggcgagcagggcatcaccgtgggctgctgggacctgtacagacacgacatcgactgccagtggatcgacatcaccgacgtgaagcccggcaactacatcctgcaggtggtgatcaaccccaacttcgaggtggccgagagcgacttcaccaacaacgccatgaagtgcaactgcaagtacgacggccacagaatctgggtgcacaactgccacatcggcgacgccttcagcgaggaggccaacagaagattcgagagataccccggccagaccagcaaccagatcatctag

SEQ ID NO: 87578 - DNA, 912 bp, Artificial Sequence
  Description of Artificial Sequence: Synthetic coding sequence
atgagacccgtgagcgtgtggcagtggagcccctggggcctgctgctgtgcctgctgtgcagcagctgcctgggcagccccagccccagcaccggccccgagaagaaggccggcagccagggcctgagattcagactggccggcttccccagaaagccctacgagggcagagtggagatccagagagccggcgagtggggcaccatctgcgacgacgacttcaccctgcaggccgcccacatcctgtgcagagagctgggcttcaccgaggccaccggctggacccacagcgccaagtacggccccggcaccggcagaatctggctggacaacctgagctgcagcggcaccgagcagagcgtgaccgagtgcgccagcagaggctggggcaacagcgactgcacccacgacgaggacgccggcgtgatctgcaaggaccagagactgcccggcttcagcgacagcaacgtgatcgaggtggagcaccacctgcaggtggaggaggtgagaatcagacccgccgtgggctggggcagaagacccctgcccgtgaccgagggcctggtggaggtgagactgcccgacggctggagccaggtgtgcgacaagggctggagcgcccacaacagccacgtggtgtgcggcatgctgggcttccccagcgagaagagagtgaacgccgccttctacagactgctggcccagagacagcagcacagcttcggcctgcacggcgtggcctgcgtgggcaccgaggcccacctgagcctgtgcagcctggagttctacagagccaacgacaccgccagatgccccggcggcggccccgccgtggtgagctgcgtgcccggccccgtgtacgccgccagcagcggccagaagaagcagcagcagagcaagccccagggctag

SEQ ID NO: 87579 - DNA, 2271 bp, Artificial Sequence
  Description of Artificial Sequence: Synthetic coding sequence
atggcctggagcccccccgccaccctgttcctgttcctgctgctgctgggccagcccccccccagcagaccccagagcctgggcaccaccaagctgagactggtgggccccgagagcaagcccgaggagggcagactggaggtgctgcaccagggccagtggggcaccgtgtgcgacgacaacttcgccatccaggaggccaccgtggcctgcagacagctgggcttcgaggccgccctgacctgggcccacagcgccaagtacggccagggcgagggccccatctggctggacaacgtgagatgcgtgggcaccgagagcagcctggaccagtgcggcagcaacggctggggcgtgagcgactgcagccacagcgaggacgtgggcgtgatctgccaccccagaagacacagaggctacctgagcgagaccgtgagcaacgccctgggcccccagggcagaagactggaggaggtgagactgaagcccatcctggccagcgccaagcagcacagccccgtgaccgagggcgccgtggaggtgaagtacgagggccactggagacaggtgtgcgaccagggctggaccatgaacaacagcagagtggtgtgcggcatgctgggcttccccagcgaggtgcccgtggacagccactactacagaaaggtgtgggacctgaagatgagagaccccaagagcagactgaagagcctgaccaacaagaacagcttctggatccaccaggtgacctgcctgggcaccgagccccacatggccaactgccaggtgcaggtggcccccgccagaggcaagctgagacccgcctgccccggcggcatgcacgccgtggtgagctgcgtggccggcccccacttcagaccccccaagaccaagccccagagaaagggcagctgggccgaggagcccagagtgagactgagaagcggcgcccaggtgggcgagggcagagtggaggtgctgatgaacagacagtggggcaccgtgtgcgaccacagatggaacctgatcagcgccagcgtggtgtgcagacagctgggcttcggcagcgccagagaggccctgttcggcgccagactgggccagggcctgggccccatccacctgagcgaggtgagatgcagaggctacgagagaaccctgagcgactgccccgccctggagggcagccagaacggctgccagcacgagaacgacgccgccgtgagatgcaacgtgcccaacatgggcttccagaaccaggtgagactggccggcggcagaatccccgaggagggcctgctggaggtgcaggtggaggtgaacggcgtgcccagatggggcagcgtgtgcagcgagaactggggcctgaccgaggccatggtggcctgcagacagctgggcctgggcttcgccatccacgcctacaaggagacctggttctggagcggcacccccagagcccaggaggtggtgatgagcggcgtgagatgcagcggcaccgagctggccctgcagcagtgccagagacacggccccgtgcactgcagccacggcggcggcagattcctggccggcgtgagctgcatggacagcgcccccgacctggtgatgaacgcccagctggtgcaggagaccgcctacctggaggacagacccctgagccagctgtactgcgcccacgaggagaactgcctgagcaagagcgccgaccacatggactggccctacggctacagaagactgctgagattcagcacccagatctacaacctgggcagaaccgacttcagacccaagaccggcagagacagctgggtgtggcaccagtgccacagacactaccacagcatcgaggtgttcacccactacgacctgctgaccctgaacggcagcaaggtggccgagggccacaaggccagcttctgcctggaggacaccaactgccccaccggcctgcagagaagatacgcctgcgccaacttcggcgagcagggcgtgaccgtgggctgctgggacacctacagacacgacatcgactgccagtgggtggacatcaccgacgtgggccccggcaactacatcttccaggtgatcgtgaacccccactacgaggtggccgagagcgacttcagcaacaacatgctgcagtgcagatgcaagtacgacggccacagagtgtggctgcacaactgccacaccggcaacagctaccccgccaacgccgagctgagcctggagcaggagcagagactgagaaacaacctgatctag

SEQ ID NO: 87580 - DNA, 1794 bp, Artificial Sequence
  Description of Artificial Sequence: Synthetic coding sequence
atggccgccgtgcaggccgccgaggtgaaggtggacggcagcgagcccaagctgagcaagaacgagctgaagagaagactgaaggccgagaagaaggtggccgagaaggaggccaagcagaaggagctgagcgagaagcagctgagccaggccaccgccgccgccaccaaccacaccaccgacaacggcgtgggccccgaggaggagagcgtggaccccaaccagtactacaagatcagaagccaggccatccaccagctgaaggtgaacggcgaggacccctacccccacaagttccacgtggacatcagcctgaccgacttcatccagaagtacagccacctgcagcccggcgaccacctgaccgacatcaccctgaaggtggccggcagaatccacgccaagagagccagcggcggcaagctgatcttctacgacctgagaggcgagggcgtgaagctgcaggtgatggccaacagcagaaactacaagagcgaggaggagttcatccacatcaacaacaagctgagaagaggcgacatcatcggcgtgcagggcaaccccggcaagaccaagaagggcgagctgagcatcatcccctacgagatcaccctgctgagcccctgcctgcacatgctgccccacctgcacttcggcctgaaggacaaggagaccagatacagacagagatacctggacctgatcctgaacgacttcgtgagacagaagttcatcatcagaagcaagatcatcacctacatcagaagcttcctggacgagctgggcttcctggagatcgagacccccatgatgaacatcatccccggcggcgccgtggccaagcccttcatcacctaccacaacgagctggacatgaacctgtacatgagaatcgcccccgagctgtaccacaagatgctggtggtgggcggcatcgacagagtgtacgagatcggcagacagttcagaaacgagggcatcgacctgacccacaaccccgagttcaccacctgcgagttctacatggcctacgccgactaccacgacctgatggagatcaccgagaagatggtgagcggcatggtgaagcacatcaccggcagctacaaggtgacctaccaccccgacggccccgagggccaggcctacgacgtggacttcaccccccccttcagaagaatcaacatggtggaggagctggagaaggccctgggcatgaagctgcccgagaccaacctgttcgagaccgaggagaccagaaagatcctggacgacatctgcgtggccaaggccgtggagtgccccccccccagaaccaccgccagactgctggacaagctggtgggcgagttcctggaggtgacctgcatcaaccccaccttcatctgcgaccacccccagatcatgagccccctggccaagtggcacagaagcaaggagggcctgaccgagagattcgagctgttcgtgatgaagaaggagatctgcaacgcctacaccgagctgaacgaccccatgagacagagacagctgttcgaggagcaggccaaggccaaggccgccggcgacgacgaggccatgttcatcgacgagaacttctgcaccgccctggagtacggcctgccccccaccgccggctggggcatgggcatcgacagagtggccatgttcctgaccgacagcaacaacatcaaggaggtgctgctgttccccgccatgaagcccgaggacaagaaggagaacgtggccaccaccgacaccctggagagcaccaccgtgggcaccagcgtgtag

SEQ ID NO: 87581 - DNA, 1878 bp, Artificial Sequence
  Description of Artificial Sequence: Synthetic coding sequence
atgctgacccaggccgccgtgagactggtgagaggcagcctgagaaagaccagctgggccgagtggggccacagagagctgagactgggccagctggcccccttcaccgccccccacaaggacaagagcttcagcgaccagagaagcgagctgaagagaagactgaaggccgagaagaaggtggccgagaaggaggccaagcagaaggagctgagcgagaagcagctgagccaggccaccgccgccgccaccaaccacaccaccgacaacggcgtgggccccgaggaggagagcgtggaccccaaccagtactacaagatcagaagccaggccatccaccagctgaaggtgaacggcgaggacccctacccccacaagttccacgtggacatcagcctgaccgacttcatccagaagtacagccacctgcagcccggcgaccacctgaccgacatcaccctgaaggtggccggcagaatccacgccaagagagccagcggcggcaagctgatcttctacgacctgagaggcgagggcgtgaagctgcaggtgatggccaacagcagaaactacaagagcgaggaggagttcatccacatcaacaacaagctgagaagaggcgacatcatcggcgtgcagggcaaccccggcaagaccaagaagggcgagctgagcatcatcccctacgagatcaccctgctgagcccctgcctgcacatgctgccccacctgcacttcggcctgaaggacaaggagaccagatacagacagagatacctggacctgatcctgaacgacttcgtgagacagaagttcatcatcagaagcaagatcatcacctacatcagaagcttcctggacgagctgggcttcctggagatcgagacccccatgatgaacatcatccccggcggcgccgtggccaagcccttcatcacctaccacaacgagctggacatgaacctgtacatgagaatcgcccccgagctgtaccacaagatgctggtggtgggcggcatcgacagagtgtacgagatcggcagacagttcagaaacgagggcatcgacctgacccacaaccccgagttcaccacctgcgagttctacatggcctacgccgactaccacgacctgatggagatcaccgagaagatggtgagcggcatggtgaagcacatcaccggcagctacaaggtgacctaccaccccgacggccccgagggccaggcctacgacgtggacttcaccccccccttcagaagaatcaacatggtggaggagctggagaaggccctgggcatgaagctgcccgagaccaacctgttcgagaccgaggagaccagaaagatcctggacgacatctgcgtggccaaggccgtggagtgccccccccccagaaccaccgccagactgctggacaagctggtgggcgagttcctggaggtgacctgcatcaaccccaccttcatctgcgaccacccccagatcatgagccccctggccaagtggcacagaagcaaggagggcctgaccgagagattcgagctgttcgtgatgaagaaggagatctgcaacgcctacaccgagctgaacgaccccatgagacagagacagctgttcgaggagcaggccaaggccaaggccgccggcgacgacgaggccatgttcatcgacgagaacttctgcaccgccctggagtacggcctgccccccaccgccggctggggcatgggcatcgacagagtggccatgttcctgaccgacagcaacaacatcaaggaggtgctgctgttccccgccatgaagcccgaggacaagaaggagaacgtggccaccaccgacaccctggagagcaccaccgtgggcaccagcgtgtag

SEQ ID NO: 87582 - DNA, 1569 bp, Artificial Sequence
  Description of Artificial Sequence: Synthetic coding sequence
atgcagccctggcacggcaaggccatgcagagagccagcgaggccggcgccaccgcccccaaggccagcgccagaaacgccagaggcgcccccatggaccccaccgagagccccgccgcccccgaggccgccctgcccaaggccggcaagttcggccccgccagaaagagcggcagcagacagaagaagagcgcccccgacacccaggagagaccccccgtgagagccaccggcgccagagccaagaaggccccccagagagcccaggacacccagcccagcgacgccaccagcgcccccggcgccgagggcctggagccccccgccgccagagagcccgccctgagcagagccggcagctgcagacagagaggcgccagatgcagcaccaagcccagacccccccccggcccctgggacgtgcccagccccggcctgcccgtgagcgcccccatcctggtgagaagagacgccgcccccggcgccagcaagctgagagccgtgctggagaagctgaagctgagcagagacgacatcagcaccgccgccggcatggtgaagggcgtggtggaccacctgctgctgagactgaagtgcgacagcgccttcagaggcgtgggcctgctgaacaccggcagctactacgagcacgtgaagatcagcgcccccaacgagttcgacgtgatgttcaagctggaggtgcccagaatccagctggaggagtacagcaacaccagagcctactacttcgtgaagttcaagagaaaccccaaggagaaccccctgagccagttcctggagggcgagatcctgagcgccagcaagatgctgagcaagttcagaaagatcatcaaggaggagatcaacgacatcaaggacaccgacgtgatcatgaagagaaagagaggcggcagccccgccgtgaccctgctgatcagcgagaagatcagcgtggacatcaccctggccctggagagcaagagcagctggcccgccagcacccaggagggcctgagaatccagaactggctgagcgccaaggtgagaaagcagctgagactgaagcccttctacctggtgcccaagcacgccaaggagggcaacggcttccaggaggagacctggagactgagcttcagccacatcgagaaggagatcctgaacaaccacggcaagagcaagacctgctgcgagaacaaggaggagaagtgctgcagaaaggactgcctgaagctgatgaagtacctgctggagcagctgaaggagagattcaaggacaagaagcacctggacaagttcagcagctaccacgtgaagaccgccttcttccacgtgtgcacccagaacccccaggacagccagtgggacagaaaggacctgggcctgtgcttcgacaactgcgtgacctacttcctgcagtgcctgagaaccgagaagctggagaactacttcatccccgagttcaacctgttcagcagcaacctgatcgacaagagaagcaaggagttcctgaccaagcagatcgagtacgagagaaacaacgagttccccgtgttcgacgagttctag

SEQ ID NO: 87583 - DNA, 1344 bp, Artificial Sequence
  Description of Artificial Sequence: Synthetic coding sequence
atgcagccctggcacggcaaggccatgcagagagccagcgaggccggcgccaccgcccccaaggccagcgccagaaacgccagaggcgcccccatggaccccaccgagagccccgccgcccccgaggccgccctgcccaaggccggcaagttcggccccgccagaaagagcggcagcagacagaagaagagcgcccccgacacccaggagagaccccccgtgagagccaccggcgccagagccaagaaggccccccagagagcccaggacacccagcccagcgacgccaccagcgcccccggcgccgagggcctggagccccccgccgccagagagcccgccctgagcagagccggcagctgcagacagagaggcgccagatgcagcaccaagcccagacccccccccggcccctgggacgtgcccagccccggcctgcccgtgagcgcccccatcctggtgagaagagacgccgcccccggcgccagcaagctgagagccgtgctggagaagctgaagctgagcagagacgacatcagcaccgccgccggcatggtgaagggcgtggtggaccacctgctgctgagactgaagtgcgacagcgccttcagaggcgtgggcctgctgaacaccggcagctactacgagcacgtgaagatcagcgcccccaacgagttcgacgtgatgttcaagctggaggtgcccagaatccagctggaggagtacagcaacaccagagcctactacttcgtgaagttcaagagaaaccccaaggagaaccccctgagccagttcctggagggcgagatcctgagcgccagcaagatgctgagcaagttcagaaagatcatcaaggaggagatcaacgacatcaaggacaccgacgtgatcatgaagagaaagagaggcggcagccccgccgtgaccctgctgatcagcgagaagatcagcgtggacatcaccctggccctggagagcaagagcagctggcccgccagcacccaggagggcctgagaatccagaactggctgagcgccaaggtgagaaagcagctgagactgaagcccttctacctggtgcccaagcacgccaaggagggcaacggcttccaggaggagacctggagactgagcttcagccacatcgagaaggagatcctgaacaaccacggcaagagcaagacctgctgcgagaacaaggaggagaagtgctgcagaaaggactgcctgaagctgatgaagtacctgctggagcagctgaaggagagattcaaggacaagaagcacctggacaagttcagcagctaccacgtgaagaccgccttcttccacagactgtactag

SEQ ID NO: 87584 - DNA, 1080 bp, Artificial Sequence
  Description of Artificial Sequence: Synthetic coding sequence
atgatcgccgcccaggccaagctggtgtaccacctgaacaagtactacaacgagaagtgccaggccagaaaggccgccatcgccaagaccatcagagaggtgtgcaaggtggtgagcgacgtgctgaaggaggtggaggtgcaggagcccagattcatcagcagcctgaacgagatggacaacagatacgagggcctggaggtgatcagccccaccgagttcgaggtggtgctgtacctgaaccagatgggcgtgttcaacttcgtggacgacggcagcctgcccggctgcgccgtgctgaagctgagcgacggcagaaagagaagcatgagcctgtgggtggagttcatcaccgccagcggctacctgagcgccagaaagatcagaagcagattccagaccctggtggcccaggccgtggacaagtgcagctacagagacgtggtgaagatggtggccgacaccagcgaggtgaagctgagaatcagagacagatacgtggtgcagatcacccccgccttcaagtgcaccggcatctggcccagaagcgccgcccactggcccctgccccacatcccctggcccggccccaacagagtggccgaggtgaaggccgagggcttcaacctgctgagcaaggagtgccacagcctggccggcaagcagagcagcgccgagagcgacgcctgggtgctgcagttcgccgaggccgagaacagactgcagatgggcggctgcagaaagaagtgcctgagcatcctgaagaccctgagagacagacacctggagctgcccggccagcccctgaacaactaccacatgaagaccctggtgagctacgagtgcgagaagcaccccagagagagcgactgggacgagagctgcctgggcgacagactgaacggcatcctgctgcagctgatcagctgcctgcagtgcagaagatgcccccactacttcctgcccaacctggacctgttccagggcaagccccacagcgccctggagaacgccgccaagcagacctggagactggccagagagatcctgaccaaccccaagagcctggagaagctgtag

SEQ ID NO: 87585 - DNA, 1176 bp, Artificial Sequence
  Description of Artificial Sequence: Synthetic coding sequence
atgagcggccccgtgcccagcagagccagagtgtacaccgacgtgaacacccacagacccagagagtactgggactacgagagccacgtggtggagtggggcaaccaggacgactaccagctggtgagaaagctgggcagaggcaagtacagcgaggtgttcgaggccatcaacatcaccaacaacgagaaggtggtggtgaagatcctgaagcccgtgaagaagaagaagatcaagagagagatcaagatcctggagaacctgagaggcggccccaacatcatcaccctggccgacatcgtgaaggaccccgtgagcagaacccccgccctggtgttcgagcacgtgaacaacaccgacttcaagcagctgtaccagaccctgaccgactacgacatcagattctacatgtacgagatcctgaaggccctggactactgccacagcatgggcatcatgcacagagacgtgaagccccacaacgtgatgatcgaccacgagcacagaaagctgagactgatcgactggggcctggccgagttctaccaccccggccaggagtacaacgtgagagtggccagcagatacttcaagggccccgagctgctggtggactaccagatgtacgactacagcctggacatgtggagcctgggctgcatgctggccagcatgatcttcagaaaggagcccttcttccacggccacgacaactacgaccagctggtgagaatcgccaaggtgctgggcaccgaggacctgtacgactacatcgacaagtacaacatcgagctggaccccagattcaacgacatcctgggcagacacagcagaaagagatgggagagattcgtgcacagcgagaaccagcacctggtgagccccgaggccctggacttcctggacaagctgctgagatacgaccaccagagcagactgaccgccagagaggccatggagcacccctacttctacaccgtggtgaaggaccaggccagaatgggcagcagcagcatgcccggcggcagcacccccgtgagcagcgccaacatgatgagcggcatcagcagcgtgcccacccccagccccctgggccccctggccggcagccccgtgatcgccgccgccaaccccctgggcatgcccgtgcccgccgccgccggcgcccagcagtag

SEQ ID NO: 87586 - DNA, 1347 bp, Artificial Sequence
  Description of Artificial Sequence: Synthetic coding sequence
atgtaccccagcaacaagaagaagaaggtgtggagagaggagaaggagagactgctgaagatgaccctggaggagagaagaaaggagtacctgagagactacatccccctgaacagcatcctgagctggaaggaggagatgaagggcaagggccagaacgacgaggagaacacccaggagaccagccaggtgaagaagagcctgaccgagaaggtgagcctgtacagaggcgacatcaccctgctggaggtggacgccatcgtgaacgccgccaacgccagcctgctgggcggcggcggcgtggacggctgcatccacagagccgccggcccctgcctgctggccgagtgcagaaacctgaacggctgcgacaccggccacgccaagatcacctgcggctacgacctgcccgccaagtacgtgatccacaccgtgggccccatcgccagaggccacatcaacggcagccacaaggaggacctggccaactgctacaagagcagcctgaagctggtgaaggagaacaacatcagaagcgtggccttcccctgcatcagcaccggcatctacggcttccccaacgagcccgccgccgtgatcgccctgaacaccatcaaggagtggctggccaagaaccaccacgaggtggacagaatcatcttctgcgtgttcctggaggtggacttcaagatctacaagaagaagatgaacgagttcttcagcgtggacgacaacaacgaggaggaggaggacgtggagatgaaggaggacagcgacgagaacggccccgaggagaagcagagcgtggaggagatggaggagcagagccaggacgccgacggcgtgaacaccgtgaccgtgcccggccccgccagcgaggaggccgtggaggactgcaaggacgaggacttcgccaaggacgagaacatcaccaagggcggcgaggtgaccgaccacagcgtgagagaccaggaccaccccgacggccaggagaacgacagcaccaagaacgagatcaagatcgagaccgagagccagagcagctacatggagaccgaggagctgagcagcaaccaggaggacgccgtgatcgtggagcagcccgaggtgatccccctgaccgaggaccaggaggagaaggagggcgagaaggcccccggcgaggacacccccagaatgcccggcaagagcgagggcagcagcgacctggagaacacccccggccccgacgtggagatgaacagccaggtggacaaggtgaacgaccccaccgagagccagcaggaggaccagctgatcgccggcgcccaggacgaggccaaggagcagagaaacggcaccaagtag

SEQ ID NO: 87587 - DNA, 642 bp, Artificial Sequence
  Description of Artificial Sequence: Synthetic coding sequence
atgaacgagttcttcagcgtggacgacaacaacgaggaggaggaggacgtggagatgaaggaggacagcgacgagaacggccccgaggagaagcagagcgtggaggagatggaggagcagagccaggacgccgacggcgtgaacaccgtgaccgtgcccggccccgccagcgaggaggccgtggaggactgcaaggacgaggacttcgccaaggacgagaacatcaccaagggcggcgaggtgaccgaccacagcgtgagagaccaggaccaccccgacggccaggagaacgacagcaccaagaacgagatcaagatcgagaccgagagccagagcagctacatggagaccgaggagctgagcagcaaccaggaggacgccgtgatcgtggagcagcccgaggtgatccccctgaccgaggaccaggaggagaaggagggcgagaaggcccccggcgaggacacccccagaatgcccggcaagagcgagggcagcagcgacctggagaacacccccggccccgacgtggagatgaacagccaggtggacaaggtgaacgaccccaccgagagccagcaggaggaccagctgatcgccggcgcccaggacgaggccaaggagcagagaaacggcaccaagtag

SEQ ID NO: 87588 - DNA, 642 bp, Artificial Sequence; identical to SEQ ID NO: 87587
  Description of Artificial Sequence: Synthetic coding sequence

SEQ ID NO: 87589 - DNA, 1068 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87590 - DNA, 1191 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgaggacctggtgaacatcgagatgttcctgaccgccaaggaggtggaggagagcctggagagaagagagaccgccacctgcctggcctggtgccacgacaacaagagcagactgagaaagatgaagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87591 - DNA, 987 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgagacctgcaagaaggccctgcagcccagcagaagagagcccgccggcagaggcgcccccggccacggccacgccggcctgcccgccagacacgcccacctgcccgtgcagggccccagcggcccctgcaccgtggccgacgccgaccccgccgtgcccgtgagacagctgcccaccacccccgccggcaagcagttctgcgtgcacccccaccccgccggctggcccctgagccaccaggagcagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87592 - DNA, 954 bp, Artificial Sequence
  Description of Artificial Sequence: Synthetic coding sequence
atgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggacctggtgaacatcgagatgttcctgaccgccaaggaggtggaggagagcctggagagaagagagaccgccacctgcctggcctggtgccacgacaacaagagcagactgagaaagatgaagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87593 - DNA, 1305 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgaggacctggtgaacatcgagatgttcctgaccgccaaggaggtggaggagagcctggagagaagagagaccgccacctgcctggcctggtgccacgacaacaagagcagactgagaaagatgaagggcagacagaacaagcacgaggccaagaccggcagaaagagcagagccgccagcagcagccccaaggagagcctggacctgggcatggagaccctgaagggcaagcccgagctgagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87594 - DNA, 1047 bp, Artificial Sequence
  Description of Artificial Sequence: Synthetic coding sequence
atggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgaggacctggtgaacatcgagatgttcctgaccgccaaggaggtggaggagagcctggagagaagagagaccgccacctgcctggcctggtgccacgacaacaagagcagactgagaaagatgaagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87595 - DNA, 1188 bp, Artificial Sequence
  Description of Artificial Sequence: Synthetic coding sequence
atgtggaccctgagagccaccggcagagaggtgggcagcagcagctgcgaggacaccgtggcccccgtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgaggacctggtgaacatcgagatgttcctgaccgccaaggaggtggaggagagcctggagagaagagagaccgccacctgcctggcctggtgccacgacaacaagagcagactgagaaagatgaagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87596 - DNA, 987 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagaccctgagcggctgccccgccgtggacagcgtggtgagcctgctggacggcgtggtggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgagacctgcaagaaggccctgcagcccagcagaagagagcccgccggcagaggcgcccccggccacggccacgccggcctgcccgccagacacgcccacctgcccgtgcagggccccagcggcccctgcaccgtggccgacgccgaccccgccgtgcccgtgagacagctgcccaccacccccgccggcaagcagttctgcgtgcacccccaccccgccggctggcccctgagccaccaggacacctgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87597 - DNA, 1128 bp, Artificial Sequence
  Description of Artificial Sequence: Synthetic coding sequence
atggccgtgcaggagagcgccgcccagctgagcatgaccctgaaggtgcaggagtaccccaccctgaaggtgccctacgagaccctgaacaagagattcagagccgcccagaagaacatcgacagagagaccagccacgtgaccatggtggtggccgagctggagaagctgagcgtgctgaagagaaaggccgtggagagcatccaggccgaggacgagagcgccaagctgtgcaagagaagaatcgagcacctgaaggagcacagcagcgaccagcccgccgccgccagcgtgtggaagagaaagagaatggacagaatgatggtggagcacctgctgagatgcggctactacaacaccgccgtgaagctggccagacagagcggcatcgaggacctggtgaacatcgagatgttcctgaccgccaaggaggtggaggagagcctggagagaagagagaccgccacctgcctggcctggtgccacgacaacaagagcagactgagaaagatgaagagctgcctggagttcagcctgagaatccaggagttcatcgagctgatcagacagaacaagagactggacgccgtgagacacgccagaaagcacttcagccaggccgagggcagccagctggacgaggtgagacaggccatgggcatgctggccttcccccccgacacccacatcagcccctacaaggacctgctggaccccgccagatggagaatgctgatccagcagttcagatacgacaactacagactgcaccagctgggcaacaacagcgtgttcaccctgaccctgcaggccggcctgagcgccatcaagaccccccagtgctacaaggaggacggcagcagcaagagccccgactgccccgtgtgcagcagaagcctgaacaagctggcccagcccctgcccatggcccactgcgccaacagcagactggtgtgcaagatcagcggcgacgtgatgaacgagaacaacccccccatgatgctgcccaacggctacgtgtacggctacaacagcctgctgagcatcagacaggacgacaaggtggtgtgccccagaaccaaggaggtgttccacttcagccaggccgagaaggtgtacatcatgtag

SEQ ID NO: 87598 - DNA, 1467 bp, Artificial Sequence
  Description of Artificial Sequence: Synthetic coding sequence
atggcccccgccgcctggctgagaagcgccgccgccagagccctgctgccccccatgctgctgctgctgctgcagcccccccccctgctggccagagccctgccccccgacgcccaccacctgcacgccgagagaagaggcccccagccctggcacgccgccctgcccagcagccccgcccccgcccccgccacccaggaggcccccagacccgccagcagcctgagaccccccagatgcggcgtgcccgaccccagcgacggcctgagcgccagaaacagacagaagagattcgtgctgagcggcggcagatgggagaagaccgacctgacctacagaatcctgagattcccctggcagctggtgcaggagcaggtgagacagaccatggccgaggccctgaaggtgtggagcgacgtgacccccctgaccttcaccgaggtgcacgagggcagagccgacatcatgatcgacttcgccagatactggcacggcgacgacctgcccttcgacggccccggcggcatcctggcccacgccttcttccccaagacccacagagagggcgacgtgcacttcgactacgacgagacctggaccatcggcgacgaccagggcaccgacctgctgcaggtggccgcccacgagttcggccacgtgctgggcctgcagcacaccaccgccgccaaggccctgatgagcgccttctacaccttcagataccccctgagcctgagccccgacgactgcagaggcgtgcagcacctgtacggccagccctggcccaccgtgaccagcagaacccccgccctgggcccccaggccggcatcgacaccaacgagatcgcccccctggagcccgacgccccccccgacgcctgcgaggccagcttcgacgccgtgagcaccatcagaggcgagctgttcttcttcaaggccggcttcgtgtggagactgagaggcggccagctgcagcccggctaccccgccctggccagcagacactggcagggcctgcccagccccgtggacgccgccttcgaggacgcccagggccacatctggttcttccagggcgcccagtactgggtgtacgacggcgagaagcccgtgctgggccccgcccccctgaccgagctgggcctggtgagattccccgtgcacgccgccctggtgtggggccccgagaagaacaagatctacttcttcagaggcagagactactggagattccaccccagcaccagaagagtggacagccccgtgcccagaagagccaccgactggagaggcgtgcccagcgagatcgacgccgccttccaggacgccgacggctacgcctacttcctgagaggcagactgtactggaagttcgaccccgtgaaggtgaaggccctggagggcttccccagactggtgggccccgacttcttcggctgcgccgagcccgccaacaccttcctgtag

SEQ ID NO: 87599 - DNA, 1563 bp, Artificial Sequence
  Description of Artificial Sequence: Synthetic coding sequence
atgagaaacaagaagatcctgaaggaggacgagctgctgagcgagacccagcaggccgccttccaccagatcgccatggagcccttcgagatcaacgtgcccaagcccaagagaagaaacggcgtgaacttcagcctggccgtggtggtgatctacctgatcctgctgaccgccggcgccggcctgctggtggtgcaggtgctgaacctgcaggccagactgagagtgctggagatgtacttcctgaacgacaccctggccgccgaggacagccccagcttcagcctgctgcagagcgcccaccccggcgagcacctggcccagggcgccagcagactgcaggtgctgcaggcccagctgacctgggtgagagtgagccacgagcacctgctgcagagagtggacaacttcacccagaaccccggcatgttcagaatcaagggcgagcagggcgcccccggcctgcagggccacaagggcgccatgggcatgcccggcgcccccggcccccccggcccccccgccgagaagggcgccaagggcgccatgggcagagacggcgccaccggccccagcggcccccagggcccccccggcgtgaagggcgaggccggcctgcagggcccccagggcgcccccggcaagcagggcgccaccggcacccccggcccccagggcgagaagggcagcaagggcgacggcggcctgatcggccccaagggcgagaccggcaccaagggcgagaagggcgacctgggcctgcccggcagcaagggcgacagaggcatgaagggcgacgccggcgtgatgggcccccccggcgcccagggcagcaagggcgacttcggcagacccggcccccccggcctggccggcttccccggcgccaagggcgaccagggccagcccggcctgcagggcgtgcccggcccccccggcgccgtgggccaccccggcgccaagggcgagcccggcagcgccggcagccccggcagagccggcctgcccggcagccccggcagccccggcgccaccggcctgaagggcagcaagggcgacaccggcctgcagggccagcagggcagaaagggcgagagcggcgtgcccggccccgccggcgtgaagggcgagcagggcagccccggcctggccggccccaagggcgcccccggccaggccggccagaagggcgaccagggcgtgaagggcagcagcggcgagcagggcgtgaagggcgagaagggcgagagaggcgagaacagcgtgagcgtgagaatcgtgggcagcagcaacagaggcagagccgaggtgtactacagcggcacctggggcaccatctgcgacgacgagtggcagaacagcgacgccatcgtgttctgcagaatgctgggctacagcaagggcagagccctgtacaaggtgggcgccggcaccggccagatctggctggacaacgtgcagtgcagaggcaccgagagcaccctgtggagctgcaccaagaacagctggggccaccacgactgcagccacgaggaggacgccggcgtggagtgcagcgtgtag

SEQ ID NO: 87600 - DNA, 1329 bp, Artificial Sequence
  Description of Artificial Sequence: Synthetic coding sequence
atgtacttcctgaacgacaccctggccgccgaggacagccccagcttcagcctgctgcagagcgcccaccccggcgagcacctggcccagggcgccagcagactgcaggtgctgcaggcccagctgacctgggtgagagtgagccacgagcacctgctgcagagagtggacaacttcacccagaaccccggcatgttcagaatcaagggcgagcagggcgcccccggcctgcagggccacaagggcgccatgggcatgcccggcgcccccggcccccccggcccccccgccgagaagggcgccaagggcgccatgggcagagacggcgccaccggccccagcggcccccagggcccccccggcgtgaagggcgaggccggcctgcagggcccccagggcgcccccggcaagcagggcgccaccggcacccccggcccccagggcgagaagggcagcaagggcgacggcggcctgatcggccccaagggcgagaccggcaccaagggcgagaagggcgacctgggcctgcccggcagcaagggcgacagaggcatgaagggcgacgccggcgtgatgggcccccccggcgcccagggcagcaagggcgacttcggcagacccggcccccccggcctggccggcttccccggcgccaagggcgaccagggccagcccggcctgcagggcgtgcccggcccccccggcgccgtgggccaccccggcgccaagggcgagcccggcagcgccggcagccccggcagagccggcctgcccggcagccccggcagccccggcgccaccggcctgaagggcagcaagggcgacaccggcctgcagggccagcagggcagaaagggcgagagcggcgtgcccggccccgccggcgtgaagggcgagcagggcagccccggcctggccggccccaagggcgcccccggccaggccggccagaagggcgaccagggcgtgaagggcagcagcggcgagcagggcgtgaagggcgagaagggcgagagaggcgagaacagcgtgagcgtgagaatcgtgggcagcagcaacagaggcagagccgaggtgtactacagcggcacctggggcaccatctgcgacgacgagtggcagaacagcgacgccatcgtgttctgcagaatgctgggctacagcaagggcagagccctgtacaaggtgggcgccggcaccggccagatctggctggacaacgtgcagtgcagaggcaccgagagcaccctgtggagctgcaccaagaacagctggggccaccacgactgcagccacgaggaggacgccggcgtggagtgcagcgtgtag

SEQ ID NO: 87601 - DNA, 1356 bp, Artificial Sequence
  Description of Artificial Sequence: Synthetic coding sequence
atggagcagtgggaccacttccacaaccagcaggaggacaccgacagctgcagcgagagcgtgaagttcgacgccagaagcatgaccgccctgctgccccccaaccccaagaacagccccagcctgcaggagaagctgaagagcttcaaggccgccctgatcgccctgtacctgctggtgttcgccgtgctgatccccctgatcggcatcgtggccgcccagctgctgaagtgggagaccaagaactgcagcgtgagcagcaccaacgccaacgacatcacccagagcctgaccggcaagggcaacgacagcgaggaggagatgagattccaggaggtgttcatggagcacatgagcaacatggagaagagaatccagcacatcctggacatggaggccaacctgatggacaccgagcacttccagaacttcagcatgaccaccgaccagagattcaacgacatcctgctgcagctgagcaccctgttcagcagcgtgcagggccacggcaacgccatcgacgagatcagcaagagcctgatcagcctgaacaccaccctgctggacctgcagctgaacatcgagaacctgaacggcaagatccaggagaacaccttcaagcagcaggaggagatcagcaagctggaggagagagtgtacaacgtgagcgccgagatcatggccatgaaggaggagcaggtgcacctggagcaggagatcaagggcgaggtgaaggtgctgaacaacatcaccaacgacctgagactgaaggactgggagcacagccagaccctgagaaacatcaccctgatccagggcccccccggcccccccggcgagaagggcgacagaggccccaccggcgagagcggccccagaggcttccccggccccatcggcccccccggcctgaagggcgacagaggcgccatcggcttccccggcagcagaggcctgcccggctacgccggcagacccggcaacagcggccccaagggccagaagggcgagaagggcagcggcaacaccctgacccccttcaccaaggtgagactggtgggcggcagcggcccccacgagggcagagtggagatcctgcacagcggccagtggggcaccatctgcgacgacagatgggaggtgagagtgggccaggtggtgtgcagaagcctgggctaccccggcgtgcaggccgtgcacaaggccgcccacttcggccagggcaccggccccatctggctgaacgaggtgttctgcttcggcagagagagcagcatcgaggagtgcaagatcagacagtggggcaccagagcctgcagccacagcgaggacgccggcgtgacctgcaccctgtag

SEQ ID NO: 87602 - DNA, 1167 bp, Artificial Sequence
  Description of Artificial Sequence: Synthetic coding sequence
atggagcagtgggaccacttccacaaccagcaggaggacaccgacagctgcagcgagagcgtgaagttcgacgccagaagcatgaccgccctgctgccccccaaccccaagaacagccccagcctgcaggagaagctgaagagcttcaaggccgccctgatcgccctgtacctgctggtgttcgccgtgctgatccccctgatcggcatcgtggccgcccagctgctgaagtgggagaccaagaactgcagcgtgagcagcaccaacgccaacgacatcacccagagcctgaccggcaagggcaacgacagcgaggaggagatgagattccaggaggtgttcatggagcacatgagcaacatggagaagagaatccagcacatcctggacatggaggccaacctgatggacaccgagcacttccagaacttcagcatgaccaccgaccagagattcaacgacatcctgctgcagctgagcaccctgttcagcagcgtgcagggccacggcaacgccatcgacgagatcagcaagagcctgatcagcctgaacaccaccctgctggacctgcagctgaacatcgagaacctgaacggcaagatccaggagaacaccttcaagcagcaggaggagatcagcaagctggaggagagagtgtacaacgtgagcgccgagatcatggccatgaaggaggagcaggtgcacctggagcaggagatcaagggcgaggtgaaggtgctgaacaacatcaccaacgacctgagactgaaggactgggagcacagccagaccctgagaaacatcaccctgatccagggcccccccggcccccccggcgagaagggcgacagaggccccaccggcgagagcggccccagaggcttccccggccccatcggcccccccggcctgaagggcgacagaggcgccatcggcttccccggcagcagaggcctgcccggctacgccggcagacccggcaacagcggccccaagggccagaagggcgagaagggcagcggcaacaccctgagcaccggccccatctggctgaacgaggtgttctgcttcggcagagagagcagcatcgaggagtgcaagatcagacagtggggcaccagagcctgcagccacagcgaggacgccggcgtgacctgcaccctgtag

SEQ ID NO: 87603 - DNA, 1167 bp, Artificial Sequence; identical to SEQ ID NO: 87602
  Description of Artificial Sequence: Synthetic coding sequence

SEQ ID NO: 87604 - DNA, 1077 bp, Artificial Sequence
  Description of Artificial Sequence: Synthetic coding sequence
atggagcagtgggaccacttccacaaccagcaggaggacaccgacagctgcagcgagagcgtgaagttcgacgccagaagcatgaccgccctgctgccccccaaccccaagaacagccccagcctgcaggagaagctgaagagcttcaaggccgccctgatcgccctgtacctgctggtgttcgccgtgctgatccccctgatcggcatcgtggccgcccagctgctgaagtgggagaccaagaactgcagcgtgagcagcaccaacgccaacgacatcacccagagcctgaccggcaagggcaacgacagcgaggaggagatgagattccaggaggtgttcatggagcacatgagcaacatggagaagagaatccagcacatcctggacatggaggccaacctgatggacaccgagcacttccagaacttcagcatgaccaccgaccagagattcaacgacatcctgctgcagctgagcaccctgttcagcagcgtgcagggccacggcaacgccatcgacgagatcagcaagagcctgatcagcctgaacaccaccctgctggacctgcagctgaacatcgagaacctgaacggcaagatccaggagaacaccttcaagcagcaggaggagatcagcaagctggaggagagagtgtacaacgtgagcgccgagatcatggccatgaaggaggagcaggtgcacctggagcaggagatcaagggcgaggtgaaggtgctgaacaacatcaccaacgacctgagactgaaggactgggagcacagccagaccctgagaaacatcaccctgatccagggcccccccggcccccccggcgagaagggcgacagaggccccaccggcgagagcggccccagaggcttccccggccccatcggcccccccggcctgaagggcgacagaggcgccatcggcttccccggcagcagaggcctgcccggctacgccggcagacccggcaacagcggccccaagggccagaagggcgagaagggcagcggcaacaccctgagacccgtgcagctgaccgaccacatcagagccggccccagctag

SEQ ID NO: 87605 - DNA, 1410 bp, Artificial Sequence
  Description of Artificial Sequence: Synthetic coding sequence
atgtgctacctgagcgccatcatcagcatcagcctgctgaacaagaagcccagcatggagcagtgggaccacttccacaaccagcaggaggacaccgacagctgcagcgagagcgtgaagttcgacgccagaagcatgaccgccctgctgccccccaaccccaagaacagccccagcctgcaggagaagctgaagagcttcaaggccgccctgatcgccctgtacctgctggtgttcgccgtgctgatccccctgatcggcatcgtggccgcccagctgctgaagtgggagaccaagaactgcagcgtgagcagcaccaacgccaacgacatcacccagagcctgaccggcaagggcaacgacagcgaggaggagatgagattccaggaggtgttcatggagcacatgagcaacatggagaagagaatccagcacatcctggacatggaggccaacctgatggacaccgagcacttccagaacttcagcatgaccaccgaccagagattcaacgacatcctgctgcagctgagcaccctgttcagcagcgtgcagggccacggcaacgccatcgacgagatcagcaagagcctgatcagcctgaacaccaccctgctggacctgcagctgaacatcgagaacctgaacggcaagatccaggagaacaccttcaagcagcaggaggagatcagcaagctggaggagagagtgtacaacgtgagcgccgagatcatggccatgaaggaggagcaggtgcacctggagcaggagatcaagggcgaggtgaaggtgctgaacaacatcaccaacgacctgagactgaaggactgggagcacagccagaccctgagaaacatcaccctgatccagggcccccccggcccccccggcgagaagggcgacagaggccccaccggcgagagcggccccagaggcttccccggccccatcggcccccccggcctgaagggcgacagaggcgccatcggcttccccggcagcagaggcctgcccggctacgccggcagacccggcaacagcggccccaagggccagaagggcgagaagggcagcggcaacaccctgacccccttcaccaaggtgagactggtgggcggcagcggcccccacgagggcagagtggagatcctgcacagcggccagtggggcaccatctgcgacgacagatgggaggtgagagtgggccaggtggtgtgcagaagcctgggctaccccggcgtgcaggccgtgcacaaggccgcccacttcggccagggcaccggccccatctggctgaacgaggtgttctgcttcggcagagagagcagcatcgaggagtgcaagatcagacagtggggcaccagagcctgcagccacagcgaggacgccggcgtgacctgcaccctgtag

SEQ ID NO: 87606 - DNA, 195 bp, Artificial Sequence
  Description of Artificial Sequence: Synthetic coding sequence
atggagcagtgggaccacttccacaaccagcaggaggacaccgacagctgcagcgagagcgtgaagttcgacgccagaagcatgaccgccctgctgccccccaaccccaagaacagccccagcctgcaggagaagctgaagagcttcaaggccgccctgatcgccctgtacctgctggtgttcgccgtgctgtag

SEQ ID NO: 87607 - DNA, 399 bp, Artificial Sequence
  Description of Artificial Sequence: Synthetic coding sequence
atggccatgaaggaggagcaggtgcacctggagcaggagatcaagggcgaggtgaaggtgctgaacaacatcaccaacgacctgagactgaaggactgggagcacagccagaccctgagaaacatcaccctgatccagggcccccccggcccccccggcgagaagggcgacagaggccccaccggcgagagcggccccagaggcttccccggccccatcggcccccccggcctgaagggcgacagaggcgccatcggcttccccggcagcagaggcctgcccggctacgccggcagacccggcaacagcggccccaagggccagaagggcgagaagggcagcggcaacaccctgagacccgtgcagctgaccgaccacatcagagccggccccagctag

SEQ ID NO: 87608 - DNA, 4203 bp, Artificial Sequence
  Description of Artificial Sequence: Synthetic coding sequence
atggagctgctgccccccctgccccagagcttcctgctgctgctgctgctgcccgccaagcccgccgccggcgaggactggcagtgccccagaaccccctacgccgccagcagagacttcgacgtgaagtacgtggtgcccagcttcagcgccggcggcctggtgcaggccatggtgacctacgagggcgacagaaacgagagcgccgtgttcgtggccatcagaaacagactgcacgtgctgggccccgacctgaagagcgtgcagagcctggccaccggccccgccggcgaccccggctgccagacctgcgccgcctgcggccccggcccccacggcccccccggcgacaccgacaccaaggtgctggtgctggaccccgccctgcccgccctggtgagctgcggcagcagcctgcagggcagatgcttcctgcacgacctggagccccagggcaccgccgtgcacctggccgcccccgcctgcctgttcagcgcccaccacaacagacccgacgactgccccgactgcgtggccagccccctgggcaccagagtgaccgtggtggagcagggccaggccagctacttctacgtggccagcagcctggacgccgccgtggccgccagcttcagccccagaagcgtgagcatcagaagactgaaggccgacgccagcggcttcgcccccggcttcgtggccctgagcgtgctgcccaagcacctggtgagctacagcatcgagtacgtgcacagcttccacaccggcgccttcgtgtacttcctgaccgtgcagcccgccagcgtgaccgacgaccccagcgccctgcacaccagactggccagactgagcgccaccgagcccgagctgggcgactacagagagctggtgctggactgcagattcgcccccaagagaagaagaagaggcgcccccgagggcggccagccctaccccgtgctgagagtggcccacagcgcccccgtgggcgcccagctggccaccgagctgagcatcgccgagggccaggaggtgctgttcggcgtgttcgtgaccggcaaggacggcggccccggcgtgggccccaacagcgtggtgtgcgccttccccatcgacctgctggacaccctgatcgacgagggcgtggagagatgctgcgagagccccgtgcaccccggcctgagaagaggcctggacttcttccagagccccagcttctgccccaacccccccggcctggaggccctgagccccaacaccagctgcagacacttccccctgctggtgagcagcagcttcagcagagtggacctgttcaacggcctgctgggccccgtgcaggtgaccgccctgtacgtgaccagactggacaacgtgaccgtggcccacatgggcaccatggacggcagaatcctgcaggtggagctggtgagaagcctgaactacctgctgtacgtgagcaacttcagcctgggcgacagcggccagcccgtgcagagagacgtgagcagactgggcgaccacctgctgttcgccagcggcgaccaggtgttccaggtgcccatccagggccccggctgcagacacttcctgacctgcggcagatgcctgagagcctggcacttcatgggctgcggctggtgcggcaacatgtgcggccagcagaaggagtgccccggcagctggcagcaggaccactgcccccccaagctgaccgagttccacccccacagcggccccctgagaggcagcaccagactgaccctgtgcggcagcaacttctacctgcaccccagcggcctggtgcccgagggcacccaccaggtgaccgtgggccagagcccctgcagacccctgcccaaggacagcagcaagctgagacccgtgcccagaaaggacttcgtggaggagttcgagtgcgagctggagcccctgggcacccaggccgtgggccccaccaacgtgagcctgaccgtgaccaacatgccccccggcaagcacttcagagtggacggcaccagcgtgctgagaggcttcagcttcatggagcccgtgctgatcgccgtgcagcccctgttcggccccagagccggcggcacctgcctgaccctggagggccagagcctgagcgtgggcaccagcagagccgtgctggtgaacggcaccgagtgcctgctggccagagtgagcgagggccagctgctgtgcgccaccccccccggcgccaccgtggccagcgtgcccctgagcctgcaggtgggcggcgcccaggtgcccggcagctggaccttccagtacagagaggaccccgtggtgctgagcatcagccccaactgcggctacatcaacagccacatcaccatctgcggccagcacctgaccagcgcctggcacctggtgctgagcttccacgacggcctgagagccgtggagagcagatgcgagagacagctgcccgagcagcagctgtgcagactgcccgagtacgtggtgagagacccccagggctgggtggccggcaacctgagcgccagaggcgacggcgccgccggcttcaccctgcccggcttcagattcctgccccccccccacccccccagcgccaacctggtgcccctgaagcccgaggagcacgccatcaagttcgagtacatcggcctgggcgccgtggccgactgcgtgggcatcaacgtgaccgtgggcggcgagagctgccagcacgagttcagaggcgacatggtggtgtgccccctgccccccagcctgcagctgggccaggacggcgcccccctgcaggtgtgcgtggacggcgagtgccacatcctgggcagagtggtgagacccggccccgacggcgtgccccagagcaccctgctgggcatcctgctgcccctgctgctgctggtggccgccctggccaccgccctggtgttcagctactggtggagaagaaagcagctggtgctgccccccaacctgaacgacctggccagcctggaccagaccgccggcgccacccccctgcccatcctgtacagcggcagcgactacagaagcggcctggccctgcccgccatcgacggcctggacagcaccacctgcgtgcacggcgccagcttcagcgacagcgaggacgagagctgcgtgcccctgctgagaaaggagagcatccagctgagagacctggacagcgccctgctggccgaggtgaaggacgtgctgatcccccacgagagagtggtgacccacagcgacagagtgatcggcaagggccacttcggcgtggtgtaccacggcgagtacatcgaccaggcccagaacagaatccagtgcgccatcaagagcctgagcagaatcaccgagatgcagcaggtggaggccttcctgagagagggcctgctgatgagaggcctgaaccaccccaacgtgctggccctgatcggcatcatgctgccccccgagggcctgccccacgtgctgctgccctacatgtgccacggcgacctgctgcagttcatcagaagcccccagagaaaccccaccgtgaaggacctgatcagcttcggcctgcaggtggccagaagcatggagtacctggccgagcagaagttcgtgcacagagacctggccgccagaaactgcatgctggacgagagcttcaccgtgaaggtggccgacttcggcctggccagagacatcctggacagagagtactacagcgtgcagcagcacagacacgccagactgcccgtgaagtggatggccctggagagcctgcagacctacagattcaccaccaagagcgacgtgtggagcttcggcgtgctgctgtgggagctgctgaccagaggcgcccccccctacagacacatcgaccccttcgacctgacccacttcctggcccagggcagaagactgccccagcccgagtactgccccgacagcctgtaccaggtgatgcagcagtgctgggaggccgaccccgccgtgagacccaccttcagagtgctggtgggcgaggtggagcagatcgtgagcgccctgctgggcgaccactacgtgcagctgcccgccacctacatgaacctgggccccagcaccagccacgagatgaacgtgagacccgagcagccccagttcagccccatgcccggcaacgtgagaagacccagacccctgagcgagccccccagacccacctag

SEQ ID NO: 87609 - DNA, 4056 bp, Artificial Sequence
  Description of Artificial Sequence: Synthetic coding sequence
atggagctgctgccccccctgccccagagcttcctgctgctgctgctgctgcccgccaagcccgccgccggcgaggactggcagtgccccagaaccccctacgccgccagcagagacttcgacgtgaagtacgtggtgcccagcttcagcgccggcggcctggtgcaggccatggtgacctacgagggcgacagaaacgagagcgccgtgttcgtggccatcagaaacagactgcacgtgctgggccccgacctgaagagcgtgcagagcctggccaccggccccgccggcgaccccggctgccagacctgcgccgcctgcggccccggcccccacggcccccccggcgacaccgacaccaaggtgctggtgctggaccccgccctgcccgccctggtgagctgcggcagcagcctgcagggcagatgcttcctgcacgacctggagccccagggcaccgccgtgcacctggccgcccccgcctgcctgttcagcgcccaccacaacagacccgacgactgccccgactgcgtggccagccccctgggcaccagagtgaccgtggtggagcagggccaggccagctacttctacgtggccagcagcctggacgccgccgtggccgccagcttcagccccagaagcgtgagcatcagaagactgaaggccgacgccagcggcttcgcccccggcttcgtggccctgagcgtgctgcccaagcacctggtgagctacagcatcgagtacgtgcacagcttccacaccggcgccttcgtgtacttcctgaccgtgcagcccgccagcgtgaccgacgaccccagcgccctgcacaccagactggccagactgagcgccaccgagcccgagctgggcgactacagagagctggtgctggactgcagattcgcccccaagagaagaagaagaggcgcccccgagggcggccagccctaccccgtgctgagagtggcccacagcgcccccgtgggcgcccagctggccaccgagctgagcatcgccgagggccaggaggtgctgttcggcgtgttcgtgaccggcaaggacggcggccccggcgtgggccccaacagcgtggtgtgcgccttccccatcgacctgctggacaccctgatcgacgagggcgtggagagatgctgcgagagccccgtgcaccccggcctgagaagaggcctggacttcttccagagccccagcttctgccccaacccccccggcctggaggccctgagccccaacaccagctgcagacacttccccctgctggtgagcagcagcttcagcagagtggacctgttcaacggcctgctgggccccgtgcaggtgaccgccctgtacgtgaccagactggacaacgtgaccgtggcccacatgggcaccatggacggcagaatcctgcaggtggagctggtgagaagcctgaactacctgctgtacgtgagcaacttcagcctgggcgacagcggccagcccgtgcagagagacgtgagcagactgggcgaccacctgctgttcgccagcggcgaccaggtgttccaggtgcccatccagggccccggctgcagacacttcctgacctgcggcagatgcctgagagcctggcacttcatgggctgcggctggtgcggcaacatgtgcggccagcagaaggagtgccccggcagctggcagcaggaccactgcccccccaagctgaccgagttccacccccacagcggccccctgagaggcagcaccagactgaccctgtgcggcagcaacttctacctgcaccccagcggcctggtgcccgagggcacccaccaggtgaccgtgggccagagcccctgcagacccctgcccaaggacagcagcaagctgagacccgtgcccagaaaggacttcgtggaggagttcgagtgcgagctggagcccctgggcacccaggccgtgggccccaccaacgtgagcctgaccgtgaccaacatgccccccggcaagcacttcagagtggacggcaccagcgtgctgagaggcttcagcttcatggagcccgtgctgatcgccgtgcagcccctgttcggccccagagccggcggcacctgcctgaccctggagggccagagcctgagcgtgggcaccagcagagccgtgctggtgaacggcaccgagtgcctgctggccagagtgagcgagggccagctgctgtgcgccaccccccccggcgccaccgtggccagcgtgcccctgagcctgcaggtgggcggcgcccaggtgcccggcagctggaccttccagtacagagaggaccccgtggtgctgagcatcagccccaactgcggctacatcaacagccacatcaccatctgcggccagcacctgaccagcgcctggcacctggtgctgagcttccacgacggcctgagagccgtggagagcagatgcgagagacagctgcccgagcagcagctgtgcagactgcccgagtacgtggtgagagacccccagggctgggtggccggcaacctgagcgccagaggcgacggcgccgccggcttcaccctgcccggcttcagattcctgccccccccccacccccccagcgccaacctggtgcccctgaagcccgaggagcacgccatcaagttcgaggtgtgcgtggacggcgagtgccacatcctgggcagagtggtgagacccggccccgacggcgtgccccagagcaccctgctgggcatcctgctgcccctgctgctgctggtggccgccctggccaccgccctggtgttcagctactggtggagaagaaagcagctggtgctgccccccaacctgaacgacctggccagcctggaccagaccgccggcgccacccccctgcccatcctgtacagcggcagcgactacagaagcggcctggccctgcccgccatcgacggcctggacagcaccacctgcgtgcacggcgccagcttcagcgacagcgaggacgagagctgcgtgcccctgctgagaaaggagagcatccagctgagagacctggacagcgccctgctggccgaggtgaaggacgtgctgatcccccacgagagagtggtgacccacagcgacagagtgatcggcaagggccacttcggcgtggtgtaccacggcgagtacatcgaccaggcccagaacagaatccagtgcgccatcaagagcctgagcagaatcaccgagatgcagcaggtggaggccttcctgagagagggcctgctgatgagaggcctgaaccaccccaacgtgctggccctgatcggcatcatgctgccccccgagggcctgccccacgtgctgctgccctacatgtgccacggcgacctgctgcagttcatcagaagcccccagagaaaccccaccgtgaaggacctgatcagcttcggcctgcaggtggccagaagcatggagtacctggccgagcagaagttcgtgcacagagacctggccgccagaaactgcatgctggacgagagcttcaccgtgaaggtggccgacttcggcctggccagagacatcctggacagagagtactacagcgtgcagcagcacagacacgccagactgcccgtgaagtggatggccctggagagcctgcagacctacagattcaccaccaagagcgacgtgtggagcttcggcgtgctgctgtgggagctgctgaccagaggcgcccccccctacagacacatcgaccccttcgacctgacccacttcctggcccagggcagaagactgccccagcccgagtactgccccgacagcctgtaccaggtgatgcagcagtgctgggaggccgaccccgccgtgagacccaccttcagagtgctggtgggcgaggtggagcagatcgtgagcgccctgctgggcgaccactacgtgcagctgcccgccacctacatgaacctgggccccagcaccagccacgagatgaacgtgagacccgagcagccccagttcagccccatgcccggcaacgtgagaagacccagacccctgagcgagccccccagacccacctag

SEQ ID NO: 87610 - DNA, 2157 bp, Artificial Sequence
  Description of Artificial Sequence: Synthetic coding sequence
atggaggacctgggcgagaacaccatggtgctgagcaccctgagaagcctgaacaacttcatcagccagagagtggagggcggcagcggcctggacatcagcaccagcgcccccggcagcctgcagatgcagtaccagcagagcatgcagctggaggagagagccgagcagatcagaagcaagagccacctgatccaggtggagagagagaagatgcagatggagctgagccacaagagagccagagtggagctggagagagccgccagcaccagcgccagaaactacgagagagaggtggacagaaaccaggagctgctgaccagaatcagacagctgcaggagagagaggccggcgccgaggagaagatgcaggagcagctggagagaaacagacagtgccagcagaacctggacgccgccagcaagagactgagagagaaggaggacagcctggcccaggccggcgagaccatcaacgccctgaagggcagaatcagcgagctgcagtggagcgtgatggaccaggagatgagagtgaagagactggagagcgagaagcaggagctgcaggagcagctggacctgcagcacaagaagtgccaggaggccaaccagaagatccaggagctgcaggccagccaggaggccagagccgaccacgagcagcagatcaaggacctggagcagaagctgagcctgcaggagcaggacgccgccatcgtgaagaacatgaagagcgagctggtgagactgcccagactggagagagagctgaagcagctgagagaggagagcgcccacctgagagagatgagagagaccaacggcctgctgcaggaggagctggagggcctgcagagaaagctgggcagacaggagaagatgcaggagaccctggtgggcctggagctggagaacgagagactgctggccaagctgcagagctgggagagactggaccagaccatgggcctgagcatcagaacccccgaggacctgagcagattcgtggtggagctgcagcagagagagctggccctgaaggacaagaacagcgccgtgaccagcagcgccagaggcctggagaaggccagacagcagctgcaggaggagctgagacaggtgagcggccagctgctggaggagagaaagaagagagagacccacgaggccctggccagaagactgcagaagagagtgctgctgctgaccaaggagagagacggcatgagagccatcctgggcagctacgacagcgagctgacccccgccgagtacagcccccagctgaccagaagaatgagagaggccgaggacatggtgcagaaggtgcacagccacagcgccgagatggaggcccagctgagccaggccctggaggagctgggcggccagaagcagagagccgacatgctggagatggagctgaagatgctgaagagccagagcagcagcgccgagcagagcttcctgttcagcagagaggaggccgacaccctgagactgaaggtggaggagctggagggcgagagaagcagactggaggaggagaagagaatgctggaggcccagctggagagaagagccctgcagggcgactacgaccagagcagaaccaaggtgctgcacatgagcctgaaccccaccagcgtggccagacagagactgagagaggaccacagccagctgcaggccgagtgcgagagactgagaggcctgctgagagccatggagagaggcggcaccgtgcccgccgacctggaggccgccgccgccagcctgcccagcagcaaggaggtggccgagctgaagaagcaggtggagagcgccgagctgaagaaccagagactgaaggaggtgttccagaccaagatccaggagttcagaaaggcctgctacaccctgaccggctaccagatcgacatcaccaccgagaaccagtacagactgaccagcctgtacgccgagcaccccggcgactgcctgatcttcaaggccaccagccccagcggcagcaagatgcagctgctggagaccgagttcagccacaccgtgggcgagctgatcgaggtgcacctgagaagacaggacagcatccccgccttcctgagcagcctgaccctggagctgttcagcagacagaccgtggcctag

SEQ ID NO: 87611 - DNA, 2157 bp, Artificial Sequence; identical to SEQ ID NO: 87610
  Description of Artificial Sequence: Synthetic coding sequence

SEQ ID NO: 87612 - DNA, 1881 bp, Artificial Sequence
  Description of Artificial Sequence: Synthetic coding sequence
atgctgcccgccagaggctgcgtgagaaagagaaccgtgtggcccagactggccagagtgctgatcgtgaccctgctgaccctggagctgagctacgcccccctgccctgccagctgagcggcgtgccctacaacaccggcgaccccgtgggcagatgggccagaccctgcatctggccctgcccctggcacaccaccatcaacgccctgaagggcagaatcagcgagctgcagtggagcgtgatggaccaggagatgagagtgaagagactggagagcgagaagcaggagctgcaggagcagctggacctgcagcacaagaagtgccaggaggccaaccagaagatccaggagctgcaggccagccaggaggccagagccgaccacgagcagcagatcaaggacctggagcagaagctgagcctgcaggagcaggacgccgccatcgtgaagaacatgaagagcgagctggtgagactgcccagactggagagagagctgaagcagctgagagaggagagcgcccacctgagagagatgagagagaccaacggcctgctgcaggaggagctggagggcctgcagagaaagctgggcagacaggagaagatgcaggagaccctggtgggcctggagctggagaacgagagactgctggccaagctgcagagctgggagagactggaccagaccatgggcctgagcatcagaacccccgaggacctgagcagattcgtggtggagctgcagcagagagagctggccctgaaggacaagaacagcgccgtgaccagcagcgccagaggcctggagaaggccagacagcagctgcaggaggagctgagacaggtgagcggccagctgctggaggagagaaagaagagagagacccacgaggccctggccagaagactgcagaagagagtgctgctgctgaccaaggagagagacggcatgagagccatcctgggcagctacgacagcgagctgacccccgccgagtacagcccccagctgaccagaagaatgagagaggccgaggacatggtgcagaaggtgcacagccacagcgccgagatggaggcccagctgagccaggccctggaggagctgggcggccagaagcagagagccgacatgctggagatggagctgaagatgctgaagagccagagcagcagcgccgagcagagcttcctgttcagcagagaggaggccgacaccctgagactgaaggtggaggagctggagggcgagagaagcagactggaggaggagaagagaatgctggaggcccagctggagagaagagccctgcagggcgactacgaccagagcagaaccaaggtgctgcacatgagcctgaaccccaccagcgtggccagacagagactgagagaggaccacagccagctgcaggccgagtgcgagagactgagaggcctgctgagagccatggagagaggcggcaccgtgcccgccgacctggaggccgccgccgccagcctgcccagcagcaaggaggtggccgagctgaagaagcaggtggagagcgccgagctgaagaaccagagactgaaggaggtgttccagaccaagatccaggagttcagaaaggcctgctacaccctgaccggctaccagatcgacatcaccaccgagaaccagtacagactgaccagcctgtacgccgagcaccccggcgactgcctgatcttcaaggccaccagccccagcggcagcaagatgcagctgctggagaccgagttcagccacaccgtgggcgagctgatcgaggtgcacctgagaagacaggacagcatccccgccttcctgagcagcctgaccctggagctgttcagcagacagaccgtggcctag

SEQ ID NO: 87613 - DNA, 2157 bp, Artificial Sequence; identical to SEQ ID NO: 87610
  Description of Artificial Sequence: Synthetic coding sequence

SEQ ID NO: 87614 - DNA, 474 bp, Artificial Sequence
  Description of Artificial Sequence: Synthetic coding sequence
atggaggacctgggcgagaacaccatggtgctgagcaccctgagaagcctgaacaacttcatcagccagagagtggagggcggcagcggcctggacatcagcaccagcgcccccggcagcctgcagatgcagtaccagcagagcatgcagctggaggagagagccgagcagatcagaagcaagagccacctgatccaggtggagagagagaagatgcagatggagctgagccacaagagagccagagtggagctggagagagccgccagcaccagcgccagaaactacgagagagaggtggacagaaaccaggagctgctgaccagaatcagacagctgcaggagagagaggccggcgccgaggagaagatgcaggagcagctggagagaaacagacagtgccagcagaacctggacgccgccagcaagagactgagagagaaggaggacagcctggcccaggccggcgagtag

SEQ ID NO: 87615 - DNA, 810 bp, Artificial Sequence
  Description of Artificial Sequence: Synthetic coding sequence
atgagagagctggagttcgccaagctggagtgctgcctggcctggcagctgcaggccagcagaagagagctggagatggagctgaagatgctgaagagccagagcagcagcgccgagcagagcttcctgttcagcagagaggaggccgacaccctgagactgaaggtggaggagctggagggcgagagaagcagactggaggaggagaagagaatgctggaggcccagctggagagaagagccctgcagggcgactacgaccagagcagaaccaaggtgctgcacatgagcctgaaccccaccagcgtggccagacagagactgagagaggaccacagccagctgcaggccgagtgcgagagactgagaggcctgctgagagccatggagagaggcggcaccgtgcccgccgacctggaggccgccgccgccagcctgcccagcagcaaggaggtggccgagctgaagaagcaggtggagagcgccgagctgaagaaccagagactgaaggaggtgttccagaccaagatccaggagttcagaaaggcctgctacaccctgaccggctaccagatcgacatcaccaccgagaaccagtacagactgaccagcctgtacgccgagcaccccggcgactgcctgatcttcaaggccaccagccccagcggcagcaagatgcagctgctggagaccgagttcagccacaccgtgggcgagctgatcgaggtgcacctgagaagacaggacagcatccccgccttcctgagcagcctgaccctggagctgttcagcagacagaccgtggcctag

SEQ ID NO: 87616 - DNA, 618 bp, Artificial Sequence
  Description of Artificial Sequence: Synthetic coding sequence
atggccctgcagctgagcagagagcagggcatcaccctgagaggcagcgccgagatcgtggccgagttcttcagcttcggcatcaacagcatcctgtaccagagaggcatctaccccagcgagaccttcaccagagtgcagaagtacggcctgaccctgctggtgaccaccgacctggagctgatcaagtacctgaacaacgtggtggagcagctgaaggactggctgtacaagtgcagcgtgcagaagctggtggtggtgatcagcaacatcgagagcggcgaggtgctggagagatggcagttcgacatcgagtgcgacaagaccgccaaggacgacagcgcccccagagagaagagccagaaggccatccaggacgagatcagaagcgtgatcagacagatcaccgccaccgtgaccttcctgcccctgctggaggtgagctgcagcttcgacctgctgatctacaccgacaaggacctggtggtgcccgagaagtgggaggagagcggcccccagttcatcaccaacagcgaggaggtgagactgagaagcttcaccaccaccatccacaaggtgaacagcatggtggcctacaagatccccgtgaacgactag

SEQ ID NO: 87617 - DNA, 1212 bp, Artificial Sequence
  Description of Artificial Sequence: Synthetic coding sequence
atgcccaacagaaaggccagcagaaacgcctactacttcttcgtgcaggagaagatccccgagctgagaagaagaggcctgcccgtggccagagtggccgacgccatcccctactgcagcagcgactgggccaagcccgtgttcacccccctgagaagacccggcatgctggtgcccaagcagaacgtgagcccccccgacatgagcgccctgagcctgaagggcgaccaggccctgctgggcggcatcttctacttcctgaacatcttcagccacggcgagctgcccccccactgcgagcagagattcctgccctgcgagatcggctgcgtgaagtacagcctgcaggagggcatcatggccgacttccacagcttcatcaaccccggcgagatccccagaggcttcagattccactgccaggccgccagcgacagcagccacaagatccccatcagcaacttcgagagaggccacaaccaggccaccgtgctgcagaacctgtacagattcatccaccccaaccccggcaactggccccccatctactgcaagagcgacgacagaaccagagtgaactggtgcctgaagcacatggccaaggccagcgagatcagacaggacctgcagctgctgaccgtggaggacctggtggtgggcatctaccagcagaagttcctgaaggagcccagcaagacctggatcagaagcctgctggacgtggccatgtgggactacagcagcaacaccagatgcaagtggcacgaggagaacgacatcctgttctgcgccctggccgtgtgcaagaagatcgcctactgcatcagcaacagcctggccaccctgttcggcatccagctgaccgaggcccacgtgcccctgcaggactacgaggccagcaacagcgtgacccccaagatggtggtgctggacgccggcagataccagaagctgagagtgggcagcagcggcttcagccacttcaacagcagcaacgaggagcagagaagcaacacccccatcggcgactaccccagcagagccaagatcagcggccagaacagcagcgtgagaggcagaggcatcaccagactgctggagagcatcagcaacagcagcagcaacatccacaagttcagcaactgcgacaccagcctgagcccctacatgagccagaaggacggctacaagagcttcagcagcctgagctag

SEQ ID NO: 87618 - DNA, 1305 bp, Artificial Sequence
  Description of Artificial Sequence: Synthetic coding sequence
atgcccaacagaaaggccagcagaaacgcctactacttcttcgtgcaggagaagatccccgagctgagaagaagaggcctgcccgtggccagagtggccgacgccatcccctactgcagcagcgactgggccctgctgagagaggaggagaaggagaagtacgccgagatggccagagagtggagagccgcccagggcaaggaccccggccccagcgagaagcagaagcccgtgttcacccccctgagaagacccggcatgctggtgcccaagcagaacgtgagcccccccgacatgagcgccctgagcctgaagggcgaccaggccctgctgggcggcatcttctacttcctgaacatcttcagccacggcgagctgcccccccactgcgagcagagattcctgccctgcgagatcggctgcgtgaagtacagcctgcaggagggcatcatggccgacttccacagcttcatcaaccccggcgagatccccagaggcttcagattccactgccaggccgccagcgacagcagccacaagatccccatcagcaacttcgagagaggccacaaccaggccaccgtgctgcagaacctgtacagattcatccaccccaaccccggcaactggccccccatctactgcaagagcgacgacagaaccagagtgaactggtgcctgaagcacatggccaaggccagcgagatcagacaggacctgcagctgctgaccgtggaggacctggtggtgggcatctaccagcagaagttcctgaaggagcccagcaagacctggatcagaagcctgctggacgtggccatgtgggactacagcagcaacaccagatgcaagtggcacgaggagaacgacatcctgttctgcgccctggccgtgtgcaagaagatcgcctactgcatcagcaacagcctggccaccctgttcggcatccagctgaccgaggcccacgtgcccctgcaggactacgaggccagcaacagcgtgacccccaagatggtggtgctggacgccggcagataccagaagctgagagtgggcagcagcggcttcagccacttcaacagcagcaacgaggagcagagaagcaacacccccatcggcgactaccccagcagagccaagatcagcggccagaacagcagcgtgagaggcagaggcatcaccagactgctggagagcatcagcaacagcagcagcaacatccacaagttcagcaactgcgacaccagcctgagcccctacatgagccagaaggacggctacaagagcttcagcagcctgagctag

SEQ ID NO: 87619 - DNA, 951 bp, Artificial Sequence
  Description of Artificial Sequence: Synthetic coding sequence
atgcccaacagaaaggccagcagaaacgcctactacttcttcgtgcaggagaagatccccgagctgagaagaagaggcctgcccgtggccagagtggccgacgccatcccctactgcagcagcgactgggccaagcccgtgttcacccccctgagaagacccggcatgctggtgcccaagcagaacgtgagcccccccgacatgagcgccctgagcctgaagggcgaccaggccctgctgggcggcatcttctacttcctgaacatcttcagccacggcgagctgcccccccactgcgagcagagattcctgccctgcgagatcggctgcgtgaagtacagcctgcaggagggcatcatggccgacttccacagcttcatcaaccccggcgagatccccagaggcttcagattccactgccaggccgccagcgacagcagccacaagatccccatcagcaacttcgagagaggccacaaccaggccaccgtgctgcagaacctgtacagattcatccaccccaaccccggcaactggccccccatctactgcaagagcgacgacagaaccagagtgaactggtgcctgaagcacatggccaaggccagcgagatcagacaggacctgcagctgctgaccgtggaggacctggtggtgggcatctaccagcagaagttcctgaaggagcccagcaagacctggatcagaagcctgctggacgtggccatgtgggactacagcagcaacaccagatgcaagtggcacgaggagaacgacatcctgttctgcgccctggccgtgtgcaagaagatcgcctactgcatcagcaacagcctggccaccctgttcggcatccagctgaccgaggcccacgtgcccctgcaggactacgaggccagcaacagcgtgacccccaagatggtggtgctggacgccggcagataccagtag

SEQ ID NO: 87620 - DNA, 471 bp, Artificial Sequence
  Description of Artificial Sequence: Synthetic coding sequence
ctgctgcagagatgcaagtggcacgaggagaacgacatcctgttctgcgccctggccgtgtgcaagaagatcgcctactgcatcagcaacagcctggccaccctgttcggcatccagctgaccgaggcccacgtgcccctgcaggactacgaggccagcaacagcgtgacccccaagatggtggtgctggacgccggcagataccagaagctgagagtgggcagcagcggcttcagccacttcaacagcagcaacgaggagcagagaagcaacacccccatcggcgactaccccagcagagccaagatcagcggccagaacagcagcgtgagaggcagaggcatcaccagactgctggagagcatcagcaacagcagcagcaacatccacaagttcagcaactgcgacaccagcctgagcccctacatgagccagaaggacggctacaagagcttcagcagcctgagctag

SEQ ID NO: 87621 - DNA, 747 bp, Artificial Sequence
  Description of Artificial Sequence: Synthetic coding sequence
atggaccagagacagagaagaatcctgggccagcccctgagcatccccaccagccagcccaagcagaagagaaccagcatgatcagcttcttcagcaaggtgagctggaagctgagattccagaagagagagcccctgaagaacgtgttcttcatcctggccgagagagccagagaccccagcgccaagaagagacacatggccatgagaaacctgggcaccatggcctacgaggcccccgacaaggtgagaaagtacaagaagatcgtgctggacctgctggtgtacggcctgtacgaccccgtgaacctggaggtgatccacgagagcatgaagaccctgaccgtggtgctgggcaagatccagggcaagggcctgggcagcttcttcatcgacatcaccctgcagaccagaaccctgctggacgacgagaacgacagcctgagatacagcgccttcgtgctgttcggccagctggccgccttcgccggcagaaagtggaagaagttcttcaccagccaggtgaagcagaccagagacagcctgctgatccacctgcaggacagaaacccccaggtggccaaggcctgcaagaccaccttccaggcctgcagcccctacctgaagctgaaggaggagtacagcttccagagcgaggaggaccagagaaacaccaagctgtaccagcagctgagccactaccaccccgagatcctgcagttcttctacgccaacaagatcctgtag

SEQ ID NO: 87622 - DNA, 747 bp, Artificial Sequence; identical to SEQ ID NO: 87621
  Description of Artificial Sequence: Synthetic coding sequence

SEQ ID NO: 87623 - DNA, 591 bp, Artificial Sequence
  Description of Artificial Sequence: Synthetic coding sequence
atggaccagagacagagaagaatcctgggccagcccctgagcatccccaccagccagcccaagcagaagagaaccagcatgatcagcttcttcagcaaggtgagctggaagctgagattccagaagagagagcccctgaagaacgtgttcttcatcctggccgagagagccagagaccccagcgccaagaagagacacatggccatgagaaacctgggcaccatggcctacgaggcccccgacaaggtgagaaagtacaagaagatcgtgctggacctgctggtgtacggcctgtacgaccccgtgaacctggaggtgatccacgagagcatgaagaccctgaccgtggtgctgggcaagatccagggcaagggcctgggcagcttcttcatcgacatcaccctgcagaccagaaccctgctggacgacgcctgcaagaccaccttccaggcctgcagcccctacctgaagctgaaggaggagtacagcttccagagcgaggaggaccagagaaacaccaagctgtaccagcagctgagccactaccaccccgagatcctgcagttcttctacgccaacaagatcctgtag

SEQ ID NO: 87624 - DNA, 633 bp, Artificial Sequence
  Description of Artificial Sequence: Synthetic coding sequence
atggcctggggcagcaagggcatccagggctgggagaacctggccgagagcagccacctggccaccaccagagagagcagcccccccgagagcggcaccggcagcggcagcagcagaggcagcagactgcaggagccccaggtgagctggaagctgagattccagaagagagagcccctgaagaacgtgttcttcatcctggccgagagagccagagaccccagcgccaagaagagacacatggccatgagaaacctgggcaccatggcctacgaggcccccgacaaggtgagaaagtacaagaagatcgtgctggacctgctggtgtacggcctgtacgaccccgtgaacctggaggtgatccacgagagcatgaagaccctgaccgtggtgctgggcaagatccagggcaagggcctgggcagcttcttcatcgacatcaccctgcagaccagaaccctgctggacgacgcctgcaagaccaccttccaggcctgcagcccctacctgaagctgaaggaggagtacagcttccagagcgaggaggaccagagaaacaccaagctgtaccagcagctgagccactaccaccccgagatcctgcagttcttctacgccaacaagatcctgtag

SEQ ID NO: 87625 - DNA, 789 bp, Artificial Sequence
  Description of Artificial Sequence: Synthetic coding sequence
atggcctggggcagcaagggcatccagggctgggagaacctggccgagagcagccacctggccaccaccagagagagcagcccccccgagagcggcaccggcagcggcagcagcagaggcagcagactgcaggagccccaggtgagctggaagctgagattccagaagagagagcccctgaagaacgtgttcttcatcctggccgagagagccagagaccccagcgccaagaagagacacatggccatgagaaacctgggcaccatggcctacgaggcccccgacaaggtgagaaagtacaagaagatcgtgctggacctgctggtgtacggcctgtacgaccccgtgaacctggaggtgatccacgagagcatgaagaccctgaccgtggtgctgggcaagatccagggcaagggcctgggcagcttcttcatcgacatcaccctgcagaccagaaccctgctggacgacgagaacgacagcctgagatacagcgccttcgtgctgttcggccagctggccgccttcgccggcagaaagtggaagaagttcttcaccagccaggtgaagcagaccagagacagcctgctgatccacctgcaggacagaaacccccaggtggccaaggcctgcaagaccaccttccaggcctgcagcccctacctgaagctgaaggaggagtacagcttccagagcgaggaggaccagagaaacaccaagctgtaccagcagctgagccactaccaccccgagatcctgcagttcttctacgccaacaagatcctgtag

SEQ ID NO: 87626 - DNA, 591 bp, Artificial Sequence; identical to SEQ ID NO: 87623
  Description of Artificial Sequence: Synthetic coding sequence

SEQ ID NO: 87627 - DNA, 771 bp, Artificial Sequence
  Description of Artificial Sequence: Synthetic coding sequence
atgaagctgctggagaacagcagcttcgaggccatcaacagccagctgaccgtggagaccggcgacgcccacatcatcggcagaatcgagagctacagctgcaagatggccggcgacgacaagcacatgttcaagcagttctgccaggagggccagccccacgtgctggaggccctgagccccccccagaccagcggcctgagccccagcagactgagcaagagccagggcggcgaggaggagggccccctgagcgacaagtgcagcagaaagaccctgttctacctgatcgccaccctgaacgagagcttcagacccgactacgacttcagcaccgccagaagccacgagttcagcagagagcccagcctgagctgggtggtgaacgccgtgaactgcagcctgttcagcgccgtgagagaggacttcaaggacctgaagccccagctgtggaacgccgtggacgaggagatctgcctggccgagtgcgacatctacagctacaaccccgacctggacagcgaccccttcggcgaggacggcagcctgtggagcttcaactacttcttctacaacaagagactgaagagaatcgtgttcttcagctgcagaagcatcagcggcagcacctacacccccagcgaggccggcaacgagctggacatggagctgggcgaggaggaggtggaggaggagagcagaagcggcggcagcggcgccgaggagaccagcaccatggaggaggacagagtgcccgtgatctgcatctag

SEQ ID NO: 87628 - DNA, 213 bp, Artificial Sequence
  Description of Artificial Sequence: Synthetic coding sequence
atgaagctgctggagaacagcagcttcgaggccatcaacagccagctgaccgtggagaccggcgacgcccacatcatcggcagaatcgagagctacagctgcaagatggccggcgacgacaagcacatgttcaagcagttctgccaggagggccagccccacgtgctggaggccctgagccccccccagaccagcggcctgagccccagctag

SEQ ID NO: 87629 - DNA, 771 bp, Artificial Sequence; identical to SEQ ID NO: 87627
  Description of Artificial Sequence: Synthetic coding sequence

SEQ ID NO: 87630 - DNA, 1104 bp, Artificial Sequence
  Description of Artificial Sequence: Synthetic coding sequence
atgagaaagggcaagggccccatctgcctgttcagcagacccaccctgagacccagcagaagcaaggtgagcctgatcgagggcagaggcgccaacatggccgccagatggagattctggtgcgtgagcgtgaccatggtggtggccctgctgatcgtgtgcgacgtgcccagcgccagcgcccagagaaagaaggagatggtgctgagcgagaaggtgagccagctgatggagtggaccaacaagagacccgtgatcagaatgaacggcgacaagttcagaagactggtgaaggccccccccagaaactacagcgtgatcgtgatgttcaccgccctgcagctgcacagacagtgcgtggtgtgcaagcaggccgacgaggagttccagatcctggccaacagctggagatacagcagcgccttcaccaacagaatcttcttcgccatggtggacttcgacgagggcagcgacgtgttccagatgctgaacatgaacagcgcccccaccttcatcaacttccccgccaagggcaagcccaagagaggcgacacctacgagctgcaggtgagaggcttcagcgccgagcagatcgccagatggatcgccgacagaaccgacgtgaacatcagagtgatcagaccccccaactacgccggccccctgatgctgggcctgctgctggccgtgatcggcggcctggtgtacctgagaagaagcaacatggagttcctgttcaacaagaccggctgggccttcgccgccctgtgcttcgtgctggccatgaccagcggccagatgtggaaccacatcagaggccccccctacgcccacaagaacccccacaccggccacgtgaactacatccacggcagcagccaggcccagttcgtggccgagacccacatcgtgctgctgttcaacggcggcgtgaccctgggcatggtgctgctgtgcgaggccgccaccagcgacatggacatcggcaagagaaagatcatgtgcgtggccggcatcggcctggtggtgctgttcttcagctggatgctgagcatcttcagaagcaagtaccacggctacccctacagcttcctgatgagctag

SEQ ID NO: 87631 - DNA, 657 bp, Artificial Sequence
  Description of Artificial Sequence: Synthetic coding sequence
atggtggacttcgacgagggcagcgacgtgttccagatgctgaacatgaacagcgcccccaccttcatcaacttccccgccaagggcaagcccaagagaggcgacacctacgagctgcaggtgagaggcttcagcgccgagcagatcgccagatggatcgccgacagaaccgacgtgaacatcagagtgatcagaccccccaactacgccggccccctgatgctgggcctgctgctggccgtgatcggcggcctggtgtacctgagaagaagcaacatggagttcctgttcaacaagaccggctgggccttcgccgccctgtgcttcgtgctggccatgaccagcggccagatgtggaaccacatcagaggccccccctacgcccacaagaacccccacaccggccacgtgaactacatccacggcagcagccaggcccagttcgtggccgagacccacatcgtgctgctgttcaacggcggcgtgaccctgggcatggtgctgctgtgcgaggccgccaccagcgacatggacatcggcaagagaaagatcatgtgcgtggccggcatcggcctggtggtgctgttcttcagctggatgctgagcatcttcagaagcaagtaccacggctacccctacagcttcctgatgagctag

SEQ ID NO: 87632 - DNA, 330 bp, Artificial Sequence
  Description of Artificial Sequence: Synthetic coding sequence
atggagagcgacttctacctgagatactacgtgggccacaagggcaagttcggccacgagttcctggagttcgagttcagacccgacggcaagctgagatacgccaacaacagcaactacaagaacgacgtgatgatcagaaaggaggagctggagatcgtgatcggcgacgagcacatcagcttcaccaccagcaagatcggcagcctgatcgacgtgaaccagagcaaggaccccgagggcctgagagtgttctactacctggtgcaggacctgaagtgcctggtgttcagcctgatcggcctgcacttcaagatcaagcccatctag

SEQ ID NO: 87633 - DNA, 441 bp, Artificial Sequence
  Description of Artificial Sequence: Synthetic coding sequence
atggagagcgacttctacctgagatactacgtgggccacaagggcaagttcggccacgagttcctggagttcgagttcagacccgacggcaagctgagatacgccaacaacagcaactacaagaacgacgtgatgatcagaaaggaggcctacgtgcacaagagcgtgatggaggagctgaagagaatcatcgacgacagcgagatcaccaaggaggacgacgccctgtggcccccccccgacagagtgggcagacaggagctggagatcgtgatcggcgacgagcacatcagcttcaccaccagcaagatcggcagcctgatcgacgtgaaccagagcaaggaccccgagggcctgagagtgttctactacctggtgcaggacctgaagtgcctggtgttcagcctgatcggcctgcacttcaagatcaagcccatctag

SEQ ID NO: 87634 - DNA, 1731 bp, Artificial Sequence
  Description of Artificial Sequence: Synthetic coding sequence
atgggcagcatcctgagcagaagaatcgccggcgtggaggacatcgacatccaggccaacagcgcctacagatacccccccaagagcggcaactacttcgccagccacttcttcatgggcggcgagaagttcgacaccccccaccccgagggctacctgttcggcgagaacatggacctgaacttcctgggcagcagacccgtgcagttcccctacgtgacccccgccccccacgagcccgtgaagaccctgagaagcctggtgaacatcagaaaggacagcctgagactggtgagatacaaggacgacgccgacagccccaccgaggacggcgacaagcccagagtgctgtacagcctggagttcaccttcgacgccgacgccagagtggccatcaccatctactgccaggccagcgaggagttcctgaacggcagagccgtgtacagccccaagagccccagcctgcagagcgagaccgtgcactacaagagaggcgtgagccagcagttcagcctgcccagcttcaagatcgacttcagcgagtggaaggacgacgagctgaacttcgacctggacagaggcgtgttccccgtggtgatccaggccgtggtggacgagggcgacgtggtggaggtgaccggccacgcccacgtgctgctggccgccttcgagaagcacatggacggcagcttcagcgtgaagcccctgaagcagaagcagatcgtggacagagtgagctacctgctgcaggagatctacggcatcgagaacaagaacaaccaggagaccaagcccagcgacgacgagaacagcgacaacagcaacgagtgcgtggtgtgcctgagcgacctgagagacaccctgatcctgccctgcagacacctgtgcctgtgcaccagctgcgccgacaccctgagataccaggccaacaactgccccatctgcagactgcccttcagagccctgctgcagatcagagccgtgagaaagaagcccggcgccctgagccccgtgagcttcagccccgtgctggcccagagcctggagcacgacgagcacagctgccccttcaagaagagcaagccccaccccgccagcctggccagcaagaagcccaagagagagaccaacagcgacagcgtgccccccggctacgagcccatcagcctgctggaggccctgaacggcctgagagccgtgagccccgccatccccagcgcccccctgtacgaggagatcacctacagcggcatcagcgacggcctgagccaggccagctgccccctggccgccatcgaccacatcctggacagcagcagacagaagggcagaccccagagcaaggcccccgacagcaccctgagaagccccagcagccccatccacgaggaggacgaggagaagctgagcgaggacgtggacgcccccccccccctgggcggcgccgagctggccctgagagagagcagcagccccgagagcttcatcaccgaggaggtggacgagagcagcagcccccagcagggcaccagagccgccagcatcgagaacgtgctgcaggacagcagccccgagcactgcggcagaggcccccccgccgacatctacctgcccggcagacccaccagcatggagaccgcccacggcctggccaccaccagccccacctggccccccctgggcggccccagccccgaccccagcgccgccgagctgacccccctgtag

SEQ ID NO: 87635 - DNA, 1659 bp, Artificial Sequence
  Description of Artificial Sequence: Synthetic coding sequence
atgggcagcatcctgagcagaagaatcgccggcgtggaggacatcgacatccaggccaacagcgcctacagatacccccccaagagcggcaactacttcgccagccacttcttcatgggcggcgagaagttcgacaccccccaccccgagggctacctgttcggcgagaacatggacctgaacttcctgggcagcagacccgtgcagttcccctacgtgacccccgccccccacgagcccgtgaagaccctgagaagcctggtgaacatcagaaaggacagcctgagactggtgagatacaaggacgacgccgacagccccaccgaggacggcgacaagcccagagtgctgtacagcctggagttcaccttcgacgccgacgccagagtggccatcaccatctactgccaggccagcgaggagttcctgaacggcagagccgtgtacagccccaagagccccagcctgcagagcgagaccgtgcactacaagagaggcgtgagccagcagttcagcctgcccagcttcaagatcgacttcagcgagtggaaggacgacgagctgaacttcgacctggacagaggcgtgttccccgtggtgatccaggccgtggtggacgagggcgacgtggtggaggtgaccggccacgcccacgtgctgctggccgccttcgagaagcacatggacggcagcttcagcgtgaagcccctgaagcagaagcagatcgtggacagagtgagctacctgctgcaggagatctacggcatcgagaacaagaacaaccaggagaccaagcccagcgacgacgagaacagcgacaacagcaacgagtgcgtggtgtgcctgagcgacctgagagacaccctgatcctgccctgcagacacctgtgcctgtgcaccagctgcgccgacaccctgagataccaggccaacaactgccccatctgcagactgcccttcagagccctgctgcagatcagagccgtgagaaagaagcccggcgccctgagccccgtgagcttcagccccgtgctggcccagagcctggagcacgacgagcacagctgccccttcaagaagagcaagccccaccccgccagcctggccagcaagaagcccaagagagagaccaacagcgacagcgtgccccccggctacgagcccatcagcctgctggaggccctgaacggcctgagagccgtgagccccgccatccccagcgcccccctgtacgaggagatcacctacagcggcatcagcgacggcctgagccaggccagctgccccctggccgccatcgaccacatcctggacagcagcagacagaagggcagaccccagagcaaggcccccgacagcaccctgagaagccccagcagccccatccacgaggaggacgaggagaagctgagcgaggacgtggacgcccccccccccctgggcggcgccgagctggccctgagagagagcagcagccccgagagcttcatcaccgaggaggtggacgagagcagcagcccccagcagggcaccagagccgccagcatcgagaacgtgctgcaggacagcagccccgagcactgcggcagaggcccccccgccgacatctacctgcccgccctgggccccgacagctgcagcgtgggcatcgacgagtag

SEQ ID NO: 87636 - DNA, 1596 bp, Artificial Sequence
  Description of Artificial Sequence: Synthetic coding sequence
atgggcagcatcctgagcagaagaatcgccggcgtggaggacatcgacatccaggccaacagcgcctacagatacccccccaagagcggcaactacttcgccagccacttcttcatgggcggcgagaagttcgacaccccccaccccgagggctacctgttcggcgagaacatggacctgaacttcctgggcagcagacccgtgcagttcccctacgtgacccccgccccccacgagcccgtgaagaccctgagaagcctggtgaacatcagaaaggacagcctgagactggtgagatacaaggacgacgccgacagccccaccgaggacggcgacaagcccagagtgctgtacagcctggagttcaccttcgacgccgacgccagagtggccatcaccatctactgccaggccagcgaggagttcctgaacggcagagccgtgtacagccccaagagccccagcctgcagagcgagaccgtgcactacaagagaggcgtgagccagcagttcagcctgcccagcttcaagatcgacttcagcgagtggaaggacgacgagctgaacttcgacctggacagaggcgtgttccccgtggtgatccaggccgtggtggacgagggcgacgccgtggtggaggtgaccggccacgcccacgtgctgctggccgccttcgagaagcacatggacggcagcttcagcgtgaagcccctgaagcagaagcagatcgtggacagagtgagctacctgctgcaggagatctacggcatcgagaacaagaacaaccaggagaccaagcccagcgacgacgagaacagcgacaacagcaacgagtgcgtggtgtgcctgagcgacctgagagacaccctgatcctgccctgcagacacctgtgcctgtgcaccagctgcgccgacaccctgagataccaggccaacaactgccccatctgcagactgcccttcagagccctgctgcagatcagagccgtgagaaagaagcccggcgccctgagccccgtgagcttcagccccgtgctggcccagagcctggagcacgacgagcacagcaacagcgacagcgtgccccccggctacgagcccatcagcctgctggaggccctgaacggcctgagagccgtgagccccgccatccccagcgcccccctgtacgaggagatcacctacagcggcatcagcgacggcctgagccaggccagctgccccctggccgccatcgaccacatcctggacagcagcagacagaagggcagaccccagagcaaggcccccgacagcaccctgagaagccccagcagccccatccacgaggaggacgaggagaagctgagcgaggacgtggacgcccccccccccctgggcggcgccgagctggccctgagagagagcagcagccccgagagcttcatcaccgaggaggtggacgagagcagcagcccccagcagggcaccagagccgccagcatcgagaacgtgctgcaggacagcagccccgagcactgcggcagaggcccccccgccgacatctacctgcccgccctgggccccgacagctgcagcgtgggcatcgacgagtag

SEQ ID NO: 87637 - DNA, 963 bp, Artificial Sequence
  Description of Artificial Sequence: Synthetic coding sequence
atgggcagcatcctgagcagaagaatcgccggcgtggaggacatcgacatccaggccaacagcgcctacagatacccccccaagagcggcaactacttcgccagccacttcttcatgggcggcgagaagttcgacaccccccaccccgagggctacctgttcggcgagaacatggacctgaacttcctgggcagcagacccgtgcagttcccctacgtgacccccgccccccacgagcccgtgaagaccctgagaagcctggtgaacatcagaaaggacagcctgagactggtgagatacaaggacgacgccgacagccccaccgaggacggcgacaagcccagagtgctgtacagcctggagttcaccttcgacgccgacgccagagtggccatcaccatctactgccaggccagcgaggagttcctgaacggcagagccgtgtacagccccaagagccccagcctgcagagcgagaccgtgcactacaagagaggcgtgagccagcagttcagcctgcccagcttcaagatcgacttcagcgagtggaaggacgacgagctgaacttcgacctggacagaggcgtgttccccgtggtgatccaggccgtggtggacgagggcgacgtggtggaggtgaccggccacgcccacgtgctgctggccgccttcgagaagcacatggacggcagcttcagcgtgaagcccctgaagcagaagcagatcgtggacagagtgagctacctgctgcaggagatctacggcatcgagaacaagaacaaccaggagaccaagcccagcgacgacgagaacagcgacaacagcaacgagtgcgtggtgtgcctgagcgacctgagagacaccctgatcctgccctgcagacacctgtgcctgtgcaccagctgcgccgacaccctgagataccaggccaacaactgccccatctgcagactgcagctgtag

SEQ ID NO: 87638 - DNA, 1632 bp, Artificial Sequence
  Description of Artificial Sequence: Synthetic coding sequence
atggccaagggcgagggcgccgagagcggcagcgccgccggcctgctgcccaccagcatcctgcagagcaccgagagacccgcccaggtgaagaaggagcccaagaagaagaagcagcagctgagcgtgtgcaacaagctgtgctacgccctgggcggcgccccctaccaggtgaccggctgcgccctgggcttcttcctgcagatctacctgctggacgtggcccagaaggacgaggaggtggtgttctgcttcagcagcttccaggtgggccccttcagcgccagcatcatcctgttcgtgggcagagcctgggacgccatcaccgaccccctggtgggcctgtgcatcagcaagagcccctggacctgcctgggcagactgatgccctggatcatcttcagcacccccctggccgtgatcgcctacttcctgatctggttcgtgcccgacttcccccacggccagacctactggtacctgctgttctactgcctgttcgagaccatggtgacctgcttccacgtgccctacagcgccctgaccatgttcatcagcaccgagcagaccgagagagacagcgccaccgcctacagaatgaccgtggaggtgctgggcaccgtgctgggcaccgccatccagggccagatcgtgggccaggccgacaccccctgcttccaggacctgaacagcagcaccgtggccagccagagcgccaaccacacccacggcaccaccagccacagagagacccagaaggcctacctgctggccgccggcgtgatcgtgtgcatctacatcatctgcgccgtgatcctgatcctgggcgtgagagagcagagagagccctacgaggcccagcagagcgagcccatcgcctacttcagaggcctgagactggtgatgagccacggcccctacatcaagctgatcaccggcttcctgttcaccagcctggccttcatgctggtggagggcaacttcgtgctgttctgcacctacaccctgggcttcagaaacgagttccagaacctgctgctggccatcatgctgagcgccaccctgaccatccccatctggcagtggttcctgaccagattcggcaagaagaccgccgtgtacgtgggcatcagcagcgccgtgcccttcctgatcctggtggccctgatggagagcaacctgatcatcacctacgccgtggccgtggccgccggcatcagcgtggccgccgccttcctgctgccctggagcatgctgcccgacgtgatcgacgacttccacctgaagcagccccacttccacggcaccgagcccatcttcttcagcttctacgtgttcttcaccaagttcgccagcggcgtgagcctgggcatcagcaccctgagcctggacttcgccggctaccagaccagaggctgcagccagcccgagagagtgaagttcaccctgaacatgctggtgaccatggcccccatcgtgctgatcctgctgggcctgctgctgttcaagatgtaccccatcgacgaggagagaagaagacagaacaagaaggccctgcaggccctgagagacgaggccagcagcagcggctgcagcgagaccgacagcaccgagctggccagcatcctgtag

SEQ ID NO: 87639 - DNA, 1593 bp, Artificial Sequence
  Description of Artificial Sequence: Synthetic coding sequence
atggccaagggcgagggcgccgagagcggcagcgccgccggcctgctgcccaccagcatcctgcagagcaccgagagacccgcccaggtgaagaaggagcccaagaagaagaagcagcagctgagcgtgtgcaacaagctgtgctacgccctgggcggcgccccctaccaggtgaccggctgcgccctgggcttcttcctgcagatctacctgctggacgtggcccaggtgggccccttcagcgccagcatcatcctgttcgtgggcagagcctgggacgccatcaccgaccccctggtgggcctgtgcatcagcaagagcccctggacctgcctgggcagactgatgccctggatcatcttcagcacccccctggccgtgatcgcctacttcctgatctggttcgtgcccgacttcccccacggccagacctactggtacctgctgttctactgcctgttcgagaccatggtgacctgcttccacgtgccctacagcgccctgaccatgttcatcagcaccgagcagaccgagagagacagcgccaccgcctacagaatgaccgtggaggtgctgggcaccgtgctgggcaccgccatccagggccagatcgtgggccaggccgacaccccctgcttccaggacctgaacagcagcaccgtggccagccagagcgccaaccacacccacggcaccaccagccacagagagacccagaaggcctacctgctggccgccggcgtgatcgtgtgcatctacatcatctgcgccgtgatcctgatcctgggcgtgagagagcagagagagccctacgaggcccagcagagcgagcccatcgcctacttcagaggcctgagactggtgatgagccacggcccctacatcaagctgatcaccggcttcctgttcaccagcctggccttcatgctggtggagggcaacttcgtgctgttctgcacctacaccctgggcttcagaaacgagttccagaacctgctgctggccatcatgctgagcgccaccctgaccatccccatctggcagtggttcctgaccagattcggcaagaagaccgccgtgtacgtgggcatcagcagcgccgtgcccttcctgatcctggtggccctgatggagagcaacctgatcatcacctacgccgtggccgtggccgccggcatcagcgtggccgccgccttcctgctgccctggagcatgctgcccgacgtgatcgacgacttccacctgaagcagccccacttccacggcaccgagcccatcttcttcagcttctacgtgttcttcaccaagttcgccagcggcgtgagcctgggcatcagcaccctgagcctggacttcgccggctaccagaccagaggctgcagccagcccgagagagtgaagttcaccctgaacatgctggtgaccatggcccccatcgtgctgatcctgctgggcctgctgctgttcaagatgtaccccatcgacgaggagagaagaagacagaacaagaaggccctgcaggccctgagagacgaggccagcagcagcggctgcagcgagaccgacagcaccgagctggccagcatcctgtag

SEQ ID NO: 87640 - DNA, 1125 bp, Artificial Sequence
  Description of Artificial Sequence: Synthetic coding sequence
atggtgacctgcttccacgtgccctacagcgccctgaccatgttcatcagcaccgagcagaccgagagagacagcgccaccgcctacagaatgaccgtggaggtgctgggcaccgtgctgggcaccgccatccagggccagatcgtgggccaggccgacaccccctgcttccaggacctgaacagcagcaccgtggccagccagagcgccaaccacacccacggcaccaccagccacagagagacccagaaggcctacctgctggccgccggcgtgatcgtgtgcatctacatcatctgcgccgtgatcctgatcctgggcgtgagagagcagagagagccctacgaggcccagcagagcgagcccatcgcctacttcagaggcctgagactggtgatgagccacggcccctacatcaagctgatcaccggcttcctgttcaccagcctggccttcatgctggtggagggcaacttcgtgctgttctgcacctacaccctgggcttcagaaacgagttccagaacctgctgctggccatcatgctgagcgccaccctgaccatccccatctggcagtggttcctgaccagattcggcaagaagaccgccgtgtacgtgggcatcagcagcgccgtgcccttcctgatcctggtggccctgatggagagcaacctgatcatcacctacgccgtggccgtggccgccggcatcagcgtggccgccgccttcctgctgccctggagcatgctgcccgacgtgatcgacgacttccacctgaagcagccccacttccacggcaccgagcccatcttcttcagcttctacgtgttcttcaccaagttcgccagcggcgtgagcctgggcatcagcaccctgagcctggacttcgccggctaccagaccagaggctgcagccagcccgagagagtgaagttcaccctgaacatgctggtgaccatggcccccatcgtgctgatcctgctgggcctgctgctgttcaagatgtaccccatcgacgaggagagaagaagacagaacaagaaggccctgcaggccctgagagacgaggccagcagcagcggctgcagcgagaccgacagcaccgagctggccagcatcctgtag

SEQ ID NO: 87641 - DNA, 801 bp, Artificial Sequence
  Description of Artificial Sequence: Synthetic coding sequence
atggccaagggcgagggcgccgagagcggcagcgccgccggcctgctgcccaccagcatcctgcagagcaccgagagacccgcccagaaggagcccaagaagaagaagcagcagctgagcgtgtgcaacaagctgtgctacgccctgggcggcgccccctaccaggtgaccggctgcgccctgggcttcttcctgcagatctacctgctggacgtggcccaggtgggccccttcagcgccagcatcatcctgttcgtgggcagagcctgggacgccatcaccgaccccctggtgggcctgtgcatcagcaagagcccctggacctgcctgggcagactgatgccctggatcatcttcagcacccccctggccgtgatcgcctacttcctgatctggttcgtgcccgacttcccccacggccagacctactggtacctgctgttctactgcctgttcgagaccatggtgacctgcttccacgtgccctacagcgccctgaccatgttcatcagcaccgagcagaccgagagagacagcgccaccgcctacagaatgaccgtggaggtgctgggcaccgtgctgggcaccgccatccagggccagatcgtgggccaggccgacaccccctgcttccaggacctgaacagcagcaccgtggccagccagagcgccaaccacacccacggcaccaccagccacagagagacccagaaggcctacctgctggccgccggcgtgatcgtgtgcatctacatcatctgcgccgtgatcctgatcctgggcgtgagagagcagagatag

SEQ ID NO: 87642 - DNA, 2376 bp, Artificial Sequence
  Description of Artificial Sequence: Synthetic coding sequence
atggccgacgacaaggtggccatcctgaccgacgacgaggaggagcagaagagaaagtacgtgctggccgaccccttcaacggcatcagcagagagcccgagccccccagcaacgagacccccagcagcaccgagaccagcgccatccccgaggaggagatcgactggatcgagaagcactgcgtgaagatcaacaacgacctgctgatcagcaaggtgttctacttcttcttctacagcgcctacggcagcctgtaccccctgctgcccgtgtactacaagcagctgggcatgagccccagccagagcggcctgctggtgggcatcagatacttcatcgagttctgcagcgcccccttctggggcgtggtggccgacagattcaagaagggcaagatcgtgctgctgttcagcctgctgtgctgggtgctgttcaacctgggcatcggcttcgtgaagcccgccaccctgagatgcgtgcccaagatcagacccaccacccaccccaccaacgccagccaccagctgaccatcctgcccaccaacagcagcttcaccagcttcctgaccatcagccccaagatgagagagaagagaaacctgctggagaccagactgaacgtgagcgacaccgtgaccctgcccaccgcccccaacatgaacagcgagcccaccctgcagccccagaccggcgagatcaccaacagaatgatggacctgaccctgaacagcagcaccgccacccccgtgagccccggcagcgtgaccaaggagaccaccaccgtgatcgtgaccaccaccaagagcctgcccagcgaccaggtgatgctggtgtacgaccagcaggaggtggaggccatcttcctggtgatcctggtggtggtgatcatcggcgagttcttcagcgccagcagcgtgaccatcgtggacaccgtgaccctgcagtacctgggcaagcacagagacagatacggcctgcagagaatgtggggcagcctgggctggggcctggccatgctgagcgtgggcatcggcatcgactacacccacatcgaggtgctgatcgacggcaagggctgcaagccccccgagtacagaaactaccagatcgtgttcatcgtgttcggcgtgctgatgaccatggccctgatcgtggccacccagttcagattcagatacaaccacttcaagaacgacgacagcaagggcaaggaggtggagatcccccaggtggagagaaacaacagcaccgagagcagcgaggagacccccaccaccaccagccacagccaggccttcaacttctgggacctgatcaagctgctgtgcagcgtgcagtacggcagcgtgctgttcgtggcctggttcatgggcttcggctacggcttcgtgttcaccttcctgtactggcacctggaggacctgaacggcaccaccaccctgttcggcgtgtgcagcgtgctgagccacgtgagcgagctgaccgcctacttcttcagccacaagctgatcgagctgatcggccacatcagagtgctgtacatcggcctggcctgcaacaccgccagatacatctacatcagctacctggagaacgcctggaccgtgctgcccatggaggtgctgcagggcgtgacccacgccgccatctgggccgcctgcatcagctacctgagcgccgccgtgccccccgagctgagaaccagcgcccagggcatcctgcagggcctgcacctgggcctgggcagaggctgcggcgccatgatcggcggcgtgctggtgaactacttcggcgccgccgccaccttcagaggcatcggcatggcctgcctggtgatcctgctgctgttcgccctgatccagtggctggccgtgcccgacgaggaggaggacaagaccatgctggccgagagaatccccgtgcccagcagccccgtgcccatcgccaccatcgacctggtgcagcagcagaccgaggacgtgatgcccagaatcgagcccagactgccccccaagaagaccaagcaccaggaggagcaggaggacgtgaacaagcccgcctggggcgtgagcagcagcccctgggtgaccttcgtgtacgccctgtaccagatcaaggagatgatgcagctgaccagagacaacagagccagcgagatccagcccctgcagggcaccaacgagaacagagagaacagccccgccggcagagcccagcccgtgccctgcgagacccacagcgaccccagcagaaaccagcccagccccgacgccgccgccagccagacccagaccagccccgcccaccccagcgtggacccctgcaccgaggagagcgaggagcagcaggcccagctggccgccggcggccactag

SEQ ID NO: 87643 - DNA, 2376 bp, Artificial Sequence; identical to SEQ ID NO: 87642
  Description of Artificial Sequence: Synthetic coding sequence

SEQ ID NO: 87644 - DNA, 129 bp, Artificial Sequence
  Description of Artificial Sequence: Synthetic coding sequence
atggccgacgacaaggtggccatcctgaccgacgacgaggaggagcagaagagaaagtacgtgctggccgaccccttcaacggcatcagcagagagcccgagccccccagcaacgagacccccagctag

SEQ ID NO: 87645 - DNA, 345 bp, Artificial Sequence
  Description of Artificial Sequence: Synthetic coding sequence
atggccgacgacaaggtggccatcctgaccgacgacgaggaggagcagaagagaaagtacgtgctggccgaccccttcaacggcatcagcagagagcccgagccccccagcaacgagacccccagcagcaccgagaccagcgccatccccgaggaggagatcgactggatcgagaagcactgcgtgaagatcaacaacgacctgctgatcagcaaggtgttctacttcttcttctacagcgcctacggcagcctgtaccccctgctgcccgtgtactacaagcagctgggcatgagccccagccagagcggcctgctggtgggcatcagatacttcatcgagtag

SEQ ID NO: 87646 - DNA, 471 bp, Artificial Sequence
  Description of Artificial Sequence: Synthetic coding sequence
atggccgacgacaaggtggccatcctgaccgacgacgaggaggagcagaagagaaagtacgtgctggccgaccccttcaacggcatcagcagagagcccgagccccccagcaacgagacccccagcagcaccgagaccagcgccatccccgaggaggagatcgactggatcgagaagcactgcgtgaagatcaacaacgacctgctgatcagcaaggtgttctacttcttcttctacagcgcctacggcagcctgtaccccctgctgcccgtgtactacaagcagctgggcatgagccccagccagagcggcctgctggtgggcatcagatacttcatcgagttctgcagcgcccccttctggggcgtggtggccgacagattcaagaagggcaagatcgtgctgctgttcagcctgctgtgctgggtgctgttcaacctgggcatcggcttcgtgaagcccgccacctag

SEQ ID NO: 87647 - DNA, 762 bp, Artificial Sequence
  Description of Artificial Sequence: Synthetic coding sequence
atggaggtgctgcagggcgtgacccacgccgccatctgggccgcctgcatcagctacctgagcgccgccgtgccccccgagctgagaaccagcgcccagggcatcctgcagggcctgcacctgggcctgggcagaggctgcggcgccatgatcggcggcgtgctggtgaactacttcggcgccgccgccaccttcagaggcatcggcatggcctgcctggtgatcctgctgctgttcgccctgatccagtggctggccgtgcccgacgaggaggaggacaagaccatgctggccgagagaatccccgtgcccagcagccccgtgcccatcgccaccatcgacctggtgcagcagcagaccgaggacgtgatgcccagaatcgagcccagactgccccccaagaagaccaagcaccaggaggagcaggaggacgtgaacaagcccgcctggggcgtgagcagcagcccctgggtgaccttcgtgtacgccctgtaccagatcaaggagatgatgcagctgaccagagacaacagagccagcgagatccagcccctgcagggcaccaacgagaacagagagaacagccccgccggcagagcccagcccgtgccctgcgagacccacagcgaccccagcagaaaccagcccagccccgacgccgccgccagccagacccagaccagccccgcccaccccagcgtggacccctgcaccgaggagagcgaggagcagcaggcccagctggccgccggcggccactag

SEQ ID NO: 87648 - DNA, 696 bp, Artificial Sequence
  Description of Artificial Sequence: Synthetic coding sequence
atggaggtgctgcagggcgtgacccacgccgccatctgggccgcctgcatcagctacctgagcgccgccgtgccccccgagctgagaaccagcgcccagggcatcctgcagggcctgcacctgggcctgggcagaggctgcggcgccatgatcggcggcgtgctggtgaactacttcggcgccgccgccaccttcagaggcatcggcatggcctgcctggtgatcctgctgctgttcgccctgatccagtggctggccgtgcccgacgaggaggaggacaagaccatgctggccgagagaatccccgtgcccagcagccccgtgcccatcgccaccatcgacctggtgcagcagcagaccgaggacgtgaacaagcccgcctggggcgtgagcagcagcccctgggtgaccttcgtgtacgccctgtaccagatcaaggagatgatgcagctgaccagagacaacagagccagcgagatccagcccctgcagggcaccaacgagaacagagagaacagccccgccggcagagcccagcccgtgccctgcgagacccacagcgaccccagcagaaaccagcccagccccgacgccgccgccagccagacccagaccagccccgcccaccccagcgtggacccctgcaccgaggagagcgaggagcagcaggcccagctggccgccggcggccactag

SEQ ID NO: 87649 - DNA, 1557 bp, Artificial Sequence
  Description of Artificial Sequence: Synthetic coding sequence
atggccggcctgagaaacgagagcgagcaggagcccctgctgggcgacacccccggcagcagagagtgggacatcctggagaccgaggagcactacaagagcagatggagaagcatcagaatcctgtacctgaccatgttcctgagcagcgtgggcttcagcgtggtgatgatgagcatctggccctacctgcagaagatcgaccccaccgccgacaccagcttcctgggctgggtgatcgccagctacagcctgggccagatggtggccagccccatcttcggcctgtggagcaactacagacccagaaaggagcccctgatcgtgagcatcctgatcagcgtggccgccaactgcctgtacgcctacctgcacatccccgccagccacaacaagtactacatgctggtggccagaggcctgctgggcatcggcgccggcaacgtggccgtggtgagaagctacaccgccggcgccaccagcctgcaggagagaaccagcagcatggccaacatcagcatgtgccaggccctgggcttcatcctgggccccgtgttccagacctgcttcaccttcctgggcgagaagggcgtgacctgggacgtgatcaagctgcagatcaacatgtacaccacccccgtgctgctgagcgccttcctgggcatcctgaacatcatcctgatcctggccatcctgagagagcacagagtggacgacagcggcagacagtgcaagagcatcaacttcgaggaggccagcaccgacgaggcccaggtgccccagggcaacatcgaccaggtggccgtggtggccatcaacgtgctgttcttcgtgaccctgttcatcttcgccctgttcgagaccatcatcacccccctgaccatggacatgtacgcctggacccaggagcaggccgtgctgtacaacggcatcatcctggccgccctgggcgtggaggccgtggtgatcttcctgggcgtgaagctgctgagcaagaagatcggcgagagagccatcctgctgggcggcctgatcgtggtgtgggtgggcttcttcatcctgctgccctggggcaaccagttccccaagatccagtgggaggacctgcacaacaacagcatccccaacaccaccttcggcgagatcatcatcggcctgtggaagagccccatggaggacgacaacgagagacccaccggctgcagcatcgagcaggcctggtgcctgtacacccccgtgatccacctggcccagttcctgaccagcgccgtgctgatcggcctgggctaccccgtgtgcaacctgatgagctacaccctgtacagcaagatcctgggccccaagccccagggcgtgtacatgggctggctgaccgccagcggcagcggcgccagaatcctgggccccatgttcatcagccaggtgtacgcccactggggccccagatgggccttcagcctggtgtgcggcatcatcgtgctgaccatcaccctgctgggcgtggtgtacaagagactgatcgccctgagcgtgagatacggcagaatccaggagtag

SEQ ID NO: 87650 - DNA, 462 bp, Artificial Sequence
  Description of Artificial Sequence: Synthetic coding sequence
atgttcctgagcagcgtgggcttcagcgtggtgatgatgagcatctggccctacctgcagaagatcgaccccaccgccgacaccagcttcctgggctgggtgatcgccagctacagcctgggccagatggtggccagccccatcttcggcctgtggagcaactacagacccagaaaggagcccctgatcgtgagcatcctgatcagcgtggccgccaactgcctgtacgcctacctgcacatccccgccagccacaacaagtactacatgctggtggccagaggcctgctgggcatcggcgccgtgttccagacctgcttcaccttcctgggcgagaagggcgtgacctgggacgtgatcaagctgcagatcaacatgtacaccacccccgtgctgctgagcgccttcctgggcatcctgaacatcatcctgatcctggccatcctgagcaagtacagatag

SEQ ID NO: 87651 - DNA, 555 bp, Artificial Sequence
  Description of Artificial Sequence: Synthetic coding sequence
atgttcctgagcagcgtgggcttcagcgtggtgatgatgagcatctggccctacctgcagaagatcgaccccaccgccgacaccagcttcctgggctgggtgatcgccagctacagcctgggccagatggtggccagccccatcttcggcctgtggagcaactacagacccagaaaggagcccctgatcgtgagcatcctgatcagcgtggccgccaactgcctgtacgcctacctgcacatccccgccagccacaacaagtactacatgctggtggccagaggcctgctgggcatcggcgccggcaacgtggccgtggtgagaagctacaccgccggcgccaccagcctgcaggagagaaccagcagcatggccaacatcagcatgtgccaggccctgggcttcatcctgggccccgagaacatcgtgtggatgacccaggaggacagcgtgaaggtgctgatcctgaagaagcaggtgcagatgaagctgagattccccaaggagatcctgaccagactgctgctgtggcccagcatgttctgcttcctgtag

SEQ ID NO: 87652 - DNA, 750 bp, Artificial Sequence
  Description of Artificial Sequence: Synthetic coding sequence
atgggcgagctgatggccttcctgctgcccctgatcatcgtgctgatggtgaagcacagcgacagcagaacccacagcctgagatacttcagactgggcgtgagcgaccccatccacggcgtgcccgagttcatcagcgtgggctacgtggacagccaccccatcaccacctacgacagcgtgaccagacagaaggagcccagagccccctggatggccgagaacctggcccccgaccactgggagagatacacccagctgctgagaggctggcagcagatgttcaaggtggagctgaagagactgcagagacactacaaccacagcggcagccacacctaccagagaatgatcggctgcgagctgctggaggacggcagcaccaccggcttcctgcagtacgcctacgacggccaggacttcctgatcttcaacaaggacaccctgagctggctggccgtggacaacgtggcccacaccatcaagcaggcctgggaggccaaccagcacgagctgctgtaccagaagaactggctggaggaggagtgcatcgcctggctgaagagattcctggagtacggcaaggacaccctgcagagaaccgagagcgagaccatccccctggtgatgaaggccgtgagcggcagcatcgtgctggtgatcgtgctggccggcgtgggcgtgctggtgtggagaagaagacccagagagcagaacggcgccatctacctgcccacccccgacagatag

SEQ ID NO: 87653 - DNA, 783 bp, Artificial Sequence
  Description of Artificial Sequence: Synthetic coding sequence
atgagacccgaggacagaatgttccacatcagagccgtgatcctgagagccctgagcctggccttcctgctgagcctgagaggcgccggcgccatcaaggccgaccacgtgagcacctacgccgccttcgtgcagacccacagacccaccggcgagttcatgttcgagttcgacgaggacgagatgttctacgtggacctggacaagaaggagaccgtgtggcacctggaggagttcggccaggccttcagcttcgaggcccagggcggcctggccaacatcgccatcctgaacaacaacctgaacaccctgatccagagaagcaaccacacccaggccaccaacgacccccccgaggtgaccgtgttccccaaggagcccgtggagctgggccagcccaacaccctgatctgccacatcgacaagttcttcccccccgtgctgaacgtgacctggctgtgcaacggcgagctggtgaccgagggcgtggccgagagcctgttcctgcccagaaccgactacagcttccacaagttccactacctgaccttcgtgcccagcgccgaggacttctacgactgcagagtggagcactggggcctggaccagcccctgctgaagcactgggaggcccaggagcccatccagatgcccgagaccaccgagaccgtgctgtgcgccctgggcctggtgctgggcctggtgggcatcatcgtgggcaccgtgctgatcatcaagagcctgagaagcggccacgaccccagagcccagggcaccctgtag

SEQ ID NO: 87654 - DNA, 783 bp, Artificial Sequence; identical to SEQ ID NO: 87653
  Description of Artificial Sequence: Synthetic coding sequence

SEQ ID NO: 87655 - DNA, 72 bp, Artificial Sequence
  Description of Artificial Sequence: Synthetic coding sequence
atgagacccgaggacagaatgttccacatcagagccgtgatcctgagagccctgagcctggccttcctgtag

SEQ ID NO: 87656 - DNA, 387 bp, Artificial Sequence
  Description of Artificial Sequence: Synthetic coding sequence
tgaaacaccctgatctgccacatcgacaagttcttcccccccgtgctgaacgtgacctggctgtgcaacggcgagctggtgaccgagggcgtggccgagagcctgttcctgcccagaaccgactacagcttccacaagttccactacctgaccttcgtgcccagcgccgaggacttctacgactgcagagtggagcactggggcctggaccagcccctgctgaagcactgggaggcccaggagcccatccagatgcccgagaccaccgagaccgtgctgtgcgccctgggcctggtgctgggcctggtgggcatcatcgtgggcaccgtgctgatcatcaagagcctgagaagcggccacgaccccagagcccagggcaccctgtag

SEQ ID NO: 87657 - DNA, 630 bp, Artificial Sequence
  Description of Artificial Sequence: Synthetic coding sequence
atgagacccgaggacagaatgttccacatcagagccgtgatcctgagagccctgagcctggccttcctgctgagcctgagaggcgccggcgccatcaaggccgaccacgtgagcacctacgccgccttcgtgcagacccacagacccaccggcgagttcatgttcgagttcgacgaggacgagatgttctacgtggacctggacaagaaggagaccgtgtggcacctggaggagttcggccaggccttcagcttcgaggcccagggcggcctggccaacatcgccatcctgaacaacaacctgaacaccctgatccagagaagcaaccacacccaggccaccaacgacccccccgaggtgaccgtgttccccaaggagcccgtggagctgggccagcccaacaccctgatctgccacatcgacaagttcttcccccccgtgctgaacgtgacctggctgtgcaacggcgagctggtgaccgagggcgtggccgagagcctgttcctgcccagaaccgactacagcttccacaagttccactacctgaccttcgtgcccagcgccgaggacttctacgactgcagagtggagcactggggcctggaccagcccctgctgaagcactggtag

SEQ ID NO: 87658 - DNA, 783 bp, Artificial Sequence; identical to SEQ ID NO: 87653
  Description of Artificial Sequence: Synthetic coding sequence

SEQ ID NO: 87659 - DNA, 72 bp, Artificial Sequence; identical to SEQ ID NO: 87655
  Description of Artificial Sequence: Synthetic coding sequence

SEQ ID NO: 87660 - DNA, 783 bp, Artificial Sequence; identical to SEQ ID NO: 87653
  Description of Artificial Sequence: Synthetic coding sequence

SEQ ID NO: 87661 - DNA, 387 bp, Artificial Sequence; identical to SEQ ID NO: 87656
  Description of Artificial Sequence: Synthetic coding sequence

SEQ ID NO: 87662 - DNA, 783 bp, Artificial Sequence; identical to SEQ ID NO: 87653
  Description of Artificial Sequence: Synthetic coding sequence

SEQ ID NO: 87663 - DNA, 72 bp, Artificial Sequence; identical to SEQ ID NO: 87655
  Description of Artificial Sequence: Synthetic coding sequence

SEQ ID NO: 87664 - DNA, 630 bp, Artificial Sequence; identical to SEQ ID NO: 87657
  Description of Artificial Sequence: Synthetic coding sequence

SEQ ID NO: 87665 - DNA, 72 bp, Artificial Sequence; identical to SEQ ID NO: 87655
  Description of Artificial Sequence: Synthetic coding sequence

SEQ ID NO: 87666 - DNA, 387 bp, Artificial Sequence; identical to SEQ ID NO: 87656
  Description of Artificial Sequence: Synthetic coding sequence

SEQ ID NO: 87667 - DNA, 783 bp, Artificial Sequence; identical to SEQ ID NO: 87653
  Description of Artificial Sequence: Synthetic coding sequence

SEQ ID NO: 87668 - DNA, 387 bp, Artificial Sequence; identical to SEQ ID NO: 87656
  Description of Artificial Sequence: Synthetic coding sequence

SEQ ID NO: 87669 - DNA, 72 bp, Artificial Sequence; identical to SEQ ID NO: 87655
  Description of Artificial Sequence: Synthetic coding sequence

SEQ ID NO: 87670 - DNA, 630 bp, Artificial Sequence; identical to SEQ ID NO: 87657
  Description of Artificial Sequence: Synthetic coding sequence

SEQ ID NO: 87671 - DNA, 639 bp, Artificial Sequence
  Description of Artificial Sequence: Synthetic coding sequence
atgagacccgaggacagaatgttccacatcagagccgtgatcctgagagccctgagcctggccttcctgctgagcctgagaggcgccggcgccatcaaggccgaccacgtgagcacctacgccgccttcgtgcagacccacagacccaccggcgagttcatgttcgagttcgacgaggacgagatgttctacgtggacctggacaagaaggagaccgtgtggcacctggaggagttcggccaggccttcagcttcgaggtgaccgtgttccccaaggagcccgtggagctgggccagcccaacaccctgatctgccacatcgacaagttcttcccccccgtgctgaacgtgacctggctgtgcaacggcgagctggtgaccgagggcgtggccgagagcctgttcctgcccagaaccgactacagcttccacaagttccactacctgaccttcgtgcccagcgccgaggacttctacgactgcagagtggagcactggggcctggaccagcccctgctgaagcactgggaggcccaggagcccatccagatgcccgagaccaccgagaccgtgctgtgcgccctgggcctggtgctgggcctggtgggcatcatcgtgggcaccgtgctgatcatctag

SEQ ID NO: 87672 - DNA, 639 bp, Artificial Sequence; identical to SEQ ID NO: 87671
  Description of Artificial Sequence: Synthetic coding sequence

SEQ ID NO: 87673 - DNA, 387 bp, Artificial Sequence; identical to SEQ ID NO: 87656
  Description of Artificial Sequence: Synthetic coding sequence

SEQ ID NO: 87674 - DNA, 639 bp, Artificial Sequence; identical to SEQ ID NO: 87671
  Description of Artificial Sequence: Synthetic coding sequence

SEQ ID NO: 87675 - DNA, 630 bp, Artificial Sequence; identical to SEQ ID NO: 87657
  Description of Artificial Sequence: Synthetic coding sequence

SEQ ID NO: 87676 - DNA, 72 bp, Artificial Sequence; identical to SEQ ID NO: 87655
  Description of Artificial Sequence: Synthetic coding sequence

SEQ ID NO: 87677 - DNA, 639 bp, Artificial Sequence; identical to SEQ ID NO: 87671
  Description of Artificial Sequence: Synthetic coding sequence

SEQ ID NO: 87678 - DNA, 630 bp, Artificial Sequence; identical to SEQ ID NO: 87657
  Description of Artificial Sequence: Synthetic coding sequence

SEQ ID NO: 87679 - DNA, 387 bp, Artificial Sequence; identical to SEQ ID NO: 87656
  Description of Artificial Sequence: Synthetic coding sequence

SEQ ID NO: 87680 - DNA, 783 bp, Artificial Sequence; identical to SEQ ID NO: 87653
  Description of Artificial Sequence: Synthetic coding sequence

SEQ ID NO: 87681 - DNA, 639 bp, Artificial Sequence; identical to SEQ ID NO: 87671
  Description of Artificial Sequence: Synthetic coding sequence

SEQ ID NO: 87682 - DNA, 72 bp, Artificial Sequence; identical to SEQ ID NO: 87655
  Description of Artificial Sequence: Synthetic coding sequence

SEQ ID NO: 87683 - DNA, 639 bp, Artificial Sequence; identical to SEQ ID NO: 87671
  Description of Artificial Sequence: Synthetic coding sequence

SEQ ID NO: 87684 - DNA, 72 bp, Artificial Sequence; identical to SEQ ID NO: 87655
  Description of Artificial Sequence: Synthetic coding sequence

SEQ ID NO: 87685 - DNA, 639 bp, Artificial Sequence; identical to SEQ ID NO: 87671
  Description of Artificial Sequence: Synthetic coding sequence

SEQ ID NO: 87686 - DNA, 387 bp, Artificial Sequence; identical to SEQ ID NO: 87656
  Description of Artificial Sequence: Synthetic coding sequence

SEQ ID NO: 87687 - DNA, 630 bp, Artificial Sequence; identical to SEQ ID NO: 87657
  Description of Artificial Sequence: Synthetic coding sequence

SEQ ID NO: 87688 - DNA, 783 bp, Artificial Sequence; identical to SEQ ID NO: 87653
  Description of Artificial Sequence: Synthetic coding sequence

SEQ ID NO: 87689 - DNA, 387 bp, Artificial Sequence; identical to SEQ ID NO: 87656
  Description of Artificial Sequence: Synthetic coding sequence

SEQ ID NO: 87690 - DNA, 630 bp, Artificial Sequence; identical to SEQ ID NO: 87657
  Description of Artificial Sequence: Synthetic coding sequence

SEQ ID NO: 87691 - DNA, 630 bp, Artificial Sequence; identical to SEQ ID NO: 87657
  Description of Artificial Sequence: Synthetic coding sequence

SEQ ID NO: 87692 - DNA, 783 bp, Artificial Sequence; identical to SEQ ID NO: 87653
  Description of Artificial Sequence: Synthetic coding sequence

SEQ ID NO: 87693 - DNA, 639 bp, Artificial Sequence; identical to SEQ ID NO: 87671
  Description of Artificial Sequence: Synthetic coding sequence

SEQ ID NO: 87694 - DNA, 783 bp, Artificial Sequence; identical to SEQ ID NO: 87653
  Description of Artificial Sequence: Synthetic coding sequence

SEQ ID NO: 87695 - DNA, 783 bp, Artificial Sequence; identical to SEQ ID NO: 87653
  Description of Artificial Sequence: Synthetic coding sequence

SEQ ID NO: 87696 - DNA, 783 bp, Artificial Sequence; identical to SEQ ID NO: 87653
  Description of Artificial Sequence: Synthetic coding sequence

SEQ ID NO: 87697 - DNA, 783 bp, Artificial Sequence; identical to SEQ ID NO: 87653
  Description of Artificial Sequence: Synthetic coding sequence

SEQ ID NO: 87698 - DNA, 783 bp, Artificial Sequence; identical to SEQ ID NO: 87653
  Description of Artificial Sequence: Synthetic coding sequence

SEQ ID NO: 87699 - DNA, 783 bp, Artificial Sequence; identical to SEQ ID NO: 87653
  Description of Artificial Sequence: Synthetic coding sequence

SEQ ID NO: 87700 - DNA, 777 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacgtgtaccagctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagagtgcagcccaaggtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacatctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87701 - DNA, 687 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagctggtgagattcgacagcgacgtgggcgagttcagagccgtgaccgagctgggcagacccgaggccgagtactggaacagccagaaggacatcctggaggaggagagagccgtgcccgacagaatgtgcagacacaactacgagctgggcggccccatgaccctgcagagaagaggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87702 - DNA, 777 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagctggtgagattcgacagcgacgtgggcgagttcagagccgtgaccgagctgggcagacccgaggccgagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87703 - DNA, 690 bp, Artificial Sequence
  Description of Artificial Sequence: Synthetic coding sequence
aagcaggcctggagaggcagcgccaccagactgggcccccagaacagcggcagacaggagtgctacgccttcaacggcacccagagattcctggagagatacatctacaacagagaggagctggtgagattcgacagcgacgtgggcgagttcagagccgtgaccgagctgggcagacccgaggccgagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagtag

SEQ ID NO: 87704 - DNA, 687 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgccagattcgacagcgacgtgggcgagttcagagccgtgaccgagctgggcagacccgccgccgagtactggaacagccagaaggacatcctggaggagaagagagccgtgcccgacagaatgtgcagacacaactacgagctgggcggccccatgaccctgcagagaagaggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87705 - DNA, 687 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggagaagagagccgtgcccgacagaatgtgcagacacaactacgagctgggcggccccatgaccctgcagagaagaggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcatggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87706 - DNA, 708 bp, Artificial Sequence
  Description of Artificial Sequence: Synthetic coding sequence
tgaaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcatggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcagattcaacgaggacctgcacaagcagggcagctag

SEQ ID NO: 87707 - DNA, 777 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcatggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87708 - DNA, 687 bp, Artificial Sequence; identical to SEQ ID NO: 87704
  Description of Artificial Sequence: Synthetic coding sequence

SEQ ID NO: 87709 - DNA, 690 bp, Artificial Sequence
  Description of Artificial Sequence: Synthetic coding sequence
aagcaggcctggagaggcagcgccaccagactgggcccccagaacagcggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagtag

SEQ ID NO: 87710 - DNA, 777 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87711 - DNA, 708 bp, Artificial Sequence
  Description of Artificial Sequence: Synthetic coding sequence
tgaaactacctgttccagggcagacaggagtgctacgccttcaacggcacccagagattcctggagagatacatctacaacagagaggagttcgccagattcgacagcgacgtgggcgagttcagagccgtgaccgagctgggcagacccgccgccgagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcagattcaacgaggacctgcacaagcagggcagctag

SEQ ID NO: 87712 - DNA, 690 bp, Artificial Sequence
  Description of Artificial Sequence: Synthetic coding sequence
aagcaggcctggagaggcagcgccaccagactgggcccccagaacagcggcagacaggagtgctacgccttcaacggcacccagagattcctggagagatacatctacaacagagaggagttcgccagattcgacagcgacgtgggcgagttcagagccgtgaccgagctgggcagacccgccgccgagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagtag

SEQ ID NO: 87713 - DNA, 777 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgccagattcgacagcgacgtgggcgagttcagagccgtgaccgagctgggcagacccgccgccgagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87714 - DNA, 249 bp, Artificial Sequence
  Description of Artificial Sequence: Synthetic coding sequence
atgaccccccagcagggcgacgtgtacacctgccaggtggagcacaccagcctggacagccccgtgaccgtggagtggaaggcccagagcgacagcgccagaagcaagaccctgaccggcgccggcggcagagccggcgcccaccacctgtggagcggccacctgcacgcccaggaggagcaggagagcagcaccagaatctgcatcaacagagtgcccgagctgaccgagaagaccatcgtgccctag

SEQ ID NO: 87715 - DNA, 777 bp, Artificial Sequence; identical to SEQ ID NO: 87707
  Description of Artificial Sequence: Synthetic coding sequence

SEQ ID NO: 87716 - DNA, 690 bp, Artificial Sequence; identical to SEQ ID NO: 87712
  Description of Artificial Sequence: Synthetic coding sequence

SEQ ID NO: 87717 - DNA, 708 bp, Artificial Sequence
  Description of Artificial Sequence: Synthetic coding sequence
tgaaactacctgttccagggcagacaggagtgctacgccttcaacggcacccagagattcctggagagatacatctacaacagagaggagctggtgagattcgacagcgacgtgggcgagttcagagccgtgaccgagctgggcagacccgaggccgagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcagattcaacgaggacctgcacaagcagggcagctag

SEQ ID NO: 87718 - DNA, 777 bp, Artificial Sequence; identical to SEQ ID NO: 87713
  Description of Artificial Sequence: Synthetic coding sequence

SEQ ID NO: 87719 - DNA, 708 bp, Artificial Sequence
  Description of Artificial Sequence: Synthetic coding sequence
tgaaactacgtgtaccagctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagagtgcagcccaaggtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacatctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcaagttcaacgaggacctgcacaagcagggcagctag

SEQ ID NO: 87720 - DNA, 690 bp, Artificial Sequence
  Description of Artificial Sequence: Synthetic coding sequence
aagcaggcctggagaggcagcgccaccagactgggcccccagaacagcggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggagaagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcatggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagtag

SEQ ID NO: 87721 - DNA, 687 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacgtgtaccagctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagaggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacatctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87722 - DNA, 687 bp, Artificial Sequence; identical to SEQ ID NO: 87705
  Description of Artificial Sequence: Synthetic coding sequence

SEQ ID NO: 87723 - DNA, 687 bp, Artificial Sequence; identical to SEQ ID NO: 87704
  Description of Artificial Sequence: Synthetic coding sequence

SEQ ID NO: 87724 - DNA, 690 bp, Artificial Sequence; identical to SEQ ID NO: 87720
  Description of Artificial Sequence: Synthetic coding sequence

SEQ ID NO: 87725 - DNA, 708 bp, Artificial Sequence
  Description of Artificial Sequence: Synthetic coding sequence
tgaaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggaggagagagccgtgcccgacagaatgtgcagacacaactacgagctgggcggccccatgaccctgcagagaagagtgcagcccagagtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcagattcaacgaggacctgcacaagcagggcagctag

SEQ ID NO: 87726 - DNA, 708 bp, Artificial Sequence; identical to SEQ ID NO: 87711
  Description of Artificial Sequence: Synthetic coding sequence

SEQ ID NO: 87727 - DNA, 687 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggaggagagagccgtgcccgacagaatgtgcagacacaactacgagctgggcggccccatgaccctgcagagaagaggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacacctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaaggtgcagagaggcagcgcctag

SEQ ID NO: 87728 - DNA, 690 bp, Artificial Sequence
  Description of Artificial Sequence: Synthetic coding sequence
aagcaggcctggagaggcagcgccaccagactgggcccccagaacagcctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagagtgcagcccaaggtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacatctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagtag

SEQ ID NO: 87729 - DNA, 777 bp, Artificial Sequence; identical to SEQ ID NO: 87713
  Description of Artificial Sequence: Synthetic coding sequence

SEQ ID NO: 87730 - DNA, 708 bp, Artificial Sequence; identical to SEQ ID NO: 87706
  Description of Artificial Sequence: Synthetic coding sequence

SEQ ID NO: 87731 - DNA, 690 bp, Artificial Sequence; identical to SEQ ID NO: 87712
  Description of Artificial Sequence: Synthetic coding sequence

SEQ ID NO: 87732 - DNA, 708 bp, Artificial Sequence; identical to SEQ ID NO: 87711
  Description of Artificial Sequence: Synthetic coding sequence

SEQ ID NO: 87733 - DNA, 372 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgccagattcgacagcgacgtgggcgagttcagagccgtgaccgagctgggcagacccgccgccgagtactggaacagccagaaggacatcctggaggagaagagagccgtgcccgacagaatgtgcagacacaactacgagctgggcggccccatgaccctgcagagaagaggcgagtag

SEQ ID NO: 87734 - DNA, 249 bp, Artificial Sequence; identical to SEQ ID NO: 87714
  Description of Artificial Sequence: Synthetic coding sequence

SEQ ID NO: 87735 - DNA, 249 bp, Artificial Sequence; identical to SEQ ID NO: 87714
  Description of Artificial Sequence: Synthetic coding sequence

SEQ ID NO: 87736 - DNA, 372 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagctggtgagattcgacagcgacgtgggcgagttcagagccgtgaccgagctgggcagacccgaggccgagtactggaacagccagaaggacatcctggaggaggagagagccgtgcccgacagaatgtgcagacacaactacgagctgggcggccccatgaccctgcagagaagaggcgagtag

SEQ ID NO: 87737 - DNA, 372 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggagaagagagccgtgcccgacagaatgtgcagacacaactacgagctgggcggccccatgaccctgcagagaagaggcgagtag

SEQ ID NO: 87738 - DNA, 372 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacctgttccagggcagacaggagtgctacgccttcaacggcacccagagattcctggagagatacatctacaacagagaggagttcgtgagattcgacagcgacgtgggcgagttcagagccgtgaccgagctgggcagacccgacgaggagtactggaacagccagaaggacatcctggaggaggagagagccgtgcccgacagaatgtgcagacacaactacgagctgggcggccccatgaccctgcagagaagaggcgagtag

SEQ ID NO: 87739 - DNA, 750 bp, Artificial Sequence
  Description of Artificial Sequence: Synthetic coding sequence
atggtgctgctgaccagcgtggtgcagggcagagccacccccgagaactacgtgtaccagctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagagtgcagcccaaggtgaacgtgagccccagcaagaagggccccctgcagcaccacaacctgctggtgtgccacgtgaccgacttctaccccggcagcatccaggtgagatggttcctgaacggccaggaggagaccgccggcgtggtgagcaccaacctgatcagaaacggcgactggaccttccagatcctggtgatgctggagatgaccccccagcagggcgacgtgtacatctgccaggtggagcacaccagcctggacagccccgtgaccgtggagtggaaggcccagagcgacagcgccagaagcaagaccctgaccggcgccggcggcttcgtgctgggcctgatcatctgcggcgtgggcatcttcatgcacagaagaagcaagaagggcgagaaggcctgcaagttcaacgaggacctgcacaagcagggcagctag

SEQ ID NO: 87740 - DNA, 249 bp, Artificial Sequence; identical to SEQ ID NO: 87714
  Description of Artificial Sequence: Synthetic coding sequence

SEQ ID NO: 87741 - DNA, 372 bp, Artificial Sequence; identical to SEQ ID NO: 87733
  Description of Artificial Sequence: Synthetic coding sequence

SEQ ID NO: 87742 - DNA, 372 bp, Artificial Sequence; identical to SEQ ID NO: 87733
  Description of Artificial Sequence: Synthetic coding sequence

SEQ ID NO: 87743 - DNA, 198 bp, Artificial Sequence
  Description of Artificial Sequence: Synthetic coding sequence
atggacagccccgtgaccgtggagtggaaggcccagagcgacagcgccagaagcaagaccctgaccggcgccggcggcagagccggcgcccaccacctgtggagcggccacctgcacgcccaggaggagcaggagagcagcaccagaatctgcatcaacagagtgcccgagctgaccgagaagaccatcgtgccctag

SEQ ID NO: 87744 - DNA, 381 bp, Artificial Sequence
  Description of Artificial Sequence: Synthetic coding sequence
atgatggtgctgcaggtgagcgccgcccccagaaccgtggccctgaccgccctgctgatggtgctgctgaccagcgtggtgcagggcagagccacccccgagaactacgtgtaccagctgagacaggagtgctacgccttcaacggcacccagagattcctggagagatacatctacaacagagaggagttcgtgagattcgacagcgacgtgggcgagttcagagccgtgaccgagctgggcagacccgacgaggactactggaacagccagaaggacctgctggaggagaagagagccgtgcccgacagagtgtgcagacacaactacgagctggacgaggccgtgaccctgcagagaagagagagaggcaagaagtag

SEQ ID NO: 87745 - DNA, 249 bp, Artificial Sequence
  Description of Artificial Sequence: Synthetic coding sequence
atgaccccccagcagggcgacgtgtacatctgccaggtggagcacaccagcctggacagccccgtgaccgtggagtggaaggcccagagcgacagcgccagaagcaagaccctgaccggcgccggcggcagagccggcgcccaccacctgtggagcggccacctgcacgcccaggaggagcaggagagcagcaccagaatctgcatcaacagagtgcccgacctgaccgagaagaccaacgtgccctag

SEQ ID NO: 87746 - DNA, 249 bp, Artificial Sequence; identical to SEQ ID NO: 87714
  Description of Artificial Sequence: Synthetic coding sequence

SEQ ID NO: 87747 - DNA, 372 bp, Artificial Sequence; identical to SEQ ID NO: 87737
  Description of Artificial Sequence: Synthetic coding sequence

SEQ ID NO: 87748 - DNA, 198 bp, Artificial Sequence; identical to SEQ ID NO: 87743
  Description of Artificial Sequence: Synthetic coding sequence

SEQ ID NO: 87749 - DNA, 768 bp, Artificial Sequence
  Description of Artificial Sequence: Synthetic coding sequence
atgatcctgaacaaggccctgctgctgggcgccctggccctgaccaccgtgatgagcccctgcggcggcgaggacatcgtggccgaccacgtggccagctgcggcgtgaacctgtaccagttctacggccccagcggccagtacacccacgagttcgacggcgacgagcagttctacgtggacctggagagaaaggagaccgcctggagatggcccgagttcagcaagttcggcggcttcgacccccagggcgccctgagaaacatggccgtggccaagcacaacctgaacatcatgatcaagagatacaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccagagcgtgaccgagggcgtgagcgagaccagcttcctgagcaagagcgaccacagcttcttcaagatcagctacctgaccttcctgcccagcgccgacgagatctacgactgcaaggtggagcactggggcctggaccagcccctgctgaagcactgggagcccgagatccccgcccccatgagcgagctgaccgagaccgtggtgtgcgccctgggcctgagcgtgggcctgatgggcatcgtggtgggcaccgtgttcatcatccagggcctgagaagcgtgggcgccagcagacaccagggccccctgtag

SEQ ID NO: 87750 - DNA, 768 bp, Artificial Sequence; identical to SEQ ID NO: 87749
  Description of Artificial Sequence: Synthetic coding sequence

SEQ ID NO: 87751 - DNA, 765 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactgggagcccgagatccccgcccccatgagcgagctgaccgagaccgtggtgtgcgccctgggcctgagcgtgggcctggtgggcatcgtggtgggcaccgtgttcatcatcagaggcctgagaagcgtgggcgccagcagacaccagggccccctgtag

SEQ ID NO: 87752 - DNA, 768 bp, Artificial Sequence; identical to SEQ ID NO: 87749
  Description of Artificial Sequence: Synthetic coding sequence

SEQ ID NO: 87753 - DNA, 768 bp, Artificial Sequence; identical to SEQ ID NO: 87749
  Description of Artificial Sequence: Synthetic coding sequence

SEQ ID NO: 87754 - DNA, 765 bp, Artificial Sequence; identical to SEQ ID NO: 87751
  Description of Artificial Sequence: Synthetic coding sequence

SEQ ID NO: 87755 - DNA, 765 bp, Artificial Sequence; identical to SEQ ID NO: 87751
  Description of Artificial Sequence: Synthetic coding sequence

SEQ ID NO: 87756 - DNA, 75 bp, Artificial Sequence
  Description of Artificial Sequence: Synthetic coding sequence
atgatcctgaacaaggccctgatgctgggcgccctggccctgaccaccgtgatgagcccctgcggcggcgagtag

SEQ ID NO: 87757 - DNA, 765 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagttcacccacgagttcgacggcgacgaggagttctacgtggacctggagagaaaggagaccgtgtggaagctgcccctgttccacagactgagattcgacccccagttcgccctgaccaacatcgccgtgctgaagcacaacctgaacatcctgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccgcccccatgagcgagctgaccgagaccgtggtgtgcgccctgggcctgagcgtgggcctggtgggcatcgtggtgggcaccgtgctgatcatcagaggcctgagaagcgtgggcgccagcagacaccagggccccctgtag

SEQ ID NO: 87758 - DNA, 768 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccacccccatgagcgagctgaccgagaccgtggtgtgcgccctgggcctgagcgtgggcctggtgggcatcgtggtgggcaccgtgctgatcatcagaggcctgagaagcgtgggcgccagcagacaccagggccccctgtag

SEQ ID NO: 87759 - DNA, 768 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgacgacgagatctacgactgcaaggtggagcactggggcctggacgagcccctgctgaagcactgggagcccgagatccccacccccatgagcgagctgaccgagaccgtggtgtgcgccctgggcctgagcgtgggcctggtgggcatcgtggtgggcaccgtgctgatcatcagaggcctgagaagcgtgggcgccagcagacaccagggccccctgtag

SEQ ID NO: 87760 - DNA, 75 bp, Artificial Sequence
  Description of Artificial Sequence: Synthetic coding sequence
atgatcctgaacaaggccctgctgctgggcgccctggccctgaccaccgtgatgagcccctgcggcggcgagtag

SEQ ID NO: 87761 - DNA, 768 bp, Artificial Sequence; identical to SEQ ID NO: 87759
  Description of Artificial Sequence: Synthetic coding sequence

SEQ ID NO: 87762 - DNA, 765 bp, Artificial Sequence; identical to SEQ ID NO: 87757
  Description of Artificial Sequence: Synthetic coding sequence

SEQ ID NO: 87763 - DNA, 765 bp, Artificial Sequence; identical to SEQ ID NO: 87757
  Description of Artificial Sequence: Synthetic coding sequence

SEQ ID NO: 87764 - DNA, 765 bp, Artificial Sequence; identical to SEQ ID NO: 87757
  Description of Artificial Sequence: Synthetic coding sequence

SEQ ID NO: 87765 - DNA, 768 bp, Artificial Sequence; identical to SEQ ID NO: 87758
  Description of Artificial Sequence: Synthetic coding sequence

SEQ ID NO: 87766 - DNA, 75 bp, Artificial Sequence; identical to SEQ ID NO: 87756
  Description of Artificial Sequence: Synthetic coding sequence

SEQ ID NO: 87767 - DNA, 75 bp, Artificial Sequence; identical to SEQ ID NO: 87756
  Description of Artificial Sequence: Synthetic coding sequence

SEQ ID NO: 87768 - DNA, 768 bp, Artificial Sequence; identical to SEQ ID NO: 87759
  Description of Artificial Sequence: Synthetic coding sequence

SEQ ID NO: 87769 - DNA, 765 bp, Artificial Sequence; identical to SEQ ID NO: 87757
  Description of Artificial Sequence: Synthetic coding sequence

SEQ ID NO: 87770 - DNA, 765 bp, Artificial Sequence; identical to SEQ ID NO: 87757
  Description of Artificial Sequence: Synthetic coding sequence

SEQ ID NO: 87771 - DNA, 765 bp, Artificial Sequence; identical to SEQ ID NO: 87757
  Description of Artificial Sequence: Synthetic coding sequence

SEQ ID NO: 87772 - DNA, 768 bp, Artificial Sequence; identical to SEQ ID NO: 87759
  Description of Artificial Sequence: Synthetic coding sequence

SEQ ID NO: 87773 - DNA, 765 bp, Artificial Sequence; identical to SEQ ID NO: 87757
  Description of Artificial Sequence: Synthetic coding sequence

SEQ ID NO: 87774 - DNA, 645 bp, Artificial Sequence
  Description of Artificial Sequence: Synthetic coding sequence
atgatcctgaacaaggccctgctgctgggcgccctggccctgaccaccgtgatgagcccctgcggcggcgaggacatcgtggccgaccacgtggccagctgcggcgtgaacctgtaccagttctacggccccagcggccagtacacccacgagttcgacggcgacgagcagttctacgtggacctggagagaaaggagaccgcctggagatggcccgagttcagcaagttcggcggcttcgacccccagggcgccctgagaaacatggccgtggccaagcacaacctgaacatcatgatcaagagatacaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccagagcgtgaccgagggcgtgagcgagaccagcttcctgagcaagagcgaccacagcttcttcaagatcagctacctgaccttcctgcccagcgccgacgagatctacgactgcaaggtggagcactggggcctggaccagcccctgctgaagcactggggcgccagccccagcaccggcgccgaggagtag

SEQ ID NO: 87775 - DNA, 576 bp, Artificial Sequence
  Description of Artificial Sequence: Synthetic coding sequence
atgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactggggcctgctgcactag

SEQ ID NO: 87776 - DNA, 441 bp, Artificial Sequence
  Description of Artificial Sequence: Synthetic coding sequence
atgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatgtgcatcgccatctacagaagcagaagagtggacctgctgcacgacctggccctgttcagcggccccatctaccacatccccttcctgctgcagatgttcctgctgagccccctgctgtgggacctgaactgctacatctgcagcgagctgaccaacgccttcgagctgttcccctag

SEQ ID NO: 87777 - DNA, 762 bp, Artificial Sequence
  Description of Artificial Sequence: Synthetic coding sequence
ggctgcctgggcaagagaatgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactggggcaaggacgagttccaccacttcctgatgctgagctgcctgagcagcagcgagctgcccgccttctacagctacatccccaagctggtgttccacaccagctgggtgagcttcttcctgatcttcttcttctag

SEQ ID NO: 87778 - DNA, 603 bp, Artificial Sequence
  Description of Artificial Sequence: Synthetic coding sequence
atgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagagccagagcagagagagcgaggagagcaccaagagctag

SEQ ID NO: 87779 - DNA, 582 bp, Artificial Sequence
  Description of Artificial Sequence: Synthetic coding sequence
atgagcccctgcggcggcgaggacatcgtggccgaccacgtggccagctacggcgtgaacctgtaccagagctacggccccagcggccagtacacccacgagttcgacggcgacgagcagttctacgtggacctgggcagaaaggagaccgtgtggtgcctgcccgtgctgagacagttcagattcgacccccagttcgccctgaccaacatcgccgtgctgaagcacaacctgaacagcctgatcaagagaagcaacagcaccgccgccaccaacgaggtgcccgaggtgaccgtgttcagcaagagccccgtgaccctgggccagcccaacatcctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccctgctgcccagcgccgaggagagctacgactgcaaggtggagcactggggcctggacaagcccctgctgaagcactgggtgcacggcttcctgagcttctag

SEQ ID NO: 87780 - DNA, 606 bp, Artificial Sequence
  Description of Artificial Sequence: Synthetic coding sequence
atgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactggggcatccaggccgaggagggccagagaagaaagaagctgggctag

SEQ ID NO: 87781 - DNA, 258 bp, Artificial Sequence
  Description of Artificial Sequence: Synthetic coding sequence
aacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactggggcaaggacttcatgagcttcttctactag

SEQ ID NO: 87782 - DNA, 390 bp, Artificial Sequence
  Description of Artificial Sequence: Synthetic coding sequence
ggctgcctgggcaagagaatgatcctgaacaaggccctgatgctgggcgccctggccctgaccaccgtgatgagcccctgcggcggcgaggacatcgtggccgaccacgtggccagctacggcgtgaacctgtaccagagctacggccccagcggccagtacagccacgagttcgacggcgacgaggagttctacgtggacctggagagaaaggagaccgtgtggcagctgcccctgttcagaagattcagaagattcgacccccagttcgccctgaccaacatcgccgtgctgaagcacaacctgaacatcgtgatcaagagaagcaacagcaccgccgccaccaacgaggtgcccgaggtgaccgtgttcagcaagagccccgtgtag

SEQ ID NO: 87783 - DNA, 768 bp, Artificial Sequence
  Description of Artificial Sequence: Synthetic coding sequence
atgatcctgaacaaggccctgctgctgggcgccctggccctgaccgccgtgatgagcccctgcggcggcgaggacatcgtggccgaccacgtggccagctacggcgtgaacttctaccagagccacggccccagcggccagtacacccacgagttcgacggcgacgaggagttctacgtggacctggagaccaaggagaccgtgtggcagctgcccatgttcagcaagttcatcagcttcgacccccagagcgccctgagaaacatggccgtgggcaagcacaccctggagttcatgatgagacagagcaacagcaccgccgccaccaacgaggtgcccgaggtgaccgtgttcagcaagttccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccgcccccatgagcgagctgaccgagaccctggtgtgcgccctgggcctgagcgtgggcctgatgggcatcgtggtgggcaccgtgttcatcatccagggcctgagaagcgtggacgccagcagacaccagggcctgctgtag

SEQ ID NO: 87784 - DNA, 768 bp, Artificial Sequence
  Description of Artificial Sequence: Synthetic coding sequence
atgatcctgaacaaggccctgctgctgggcgccctggccctgaccgccgtgatgagcccctgcggcggcgaggacatcgtggccgaccacgtggccagctacggcgtgaacttctaccagagccacggccccagcggccagtacacccacgagttcgacggcgacgaggagttctacgtggacctggagaccaaggagaccgtgtggcagctgcccatgttcagcaagttcatcagcttcgacccccagagcgccctgagaaacatggccgtgggcaagcacaccctggagttcatgatgagacagagcaacagcaccgccgccaccaacgaggtgcccgaggtgaccgtgttcagcaagttccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccgcccccatgagcgagctgaccgagaccctggtgtgcgccctgggcctgagcgtgggcctgatgggcatcgtggtgggcaccgtgttcatcatccagggcctgagaagcgtgggcgccagcagacaccagggcctgctgtag

SEQ ID NO: 87785 - DNA, 768 bp, Artificial Sequence
  Description of Artificial Sequence: Synthetic coding sequence
atgatcctgaacaaggccctgctgctgggcgccctggccctgaccgccgtgatgagcccctgcggcggcgaggacatcgtggccgaccacgtggccagctacggcgtgaacttctaccagagccacggccccagcggccagtacacccacgagttcgacggcgacgaggagttctacgtggacctggagaccaaggagaccgtgtggcagctgcccatgttcagcaagttcatcagcttcgacccccagagcgccctgagaaacatggccgtgggcaagcacaccctggagttcatgatgggccagagcaacagcaccgccgccaccaacgaggtgcccgaggtgaccgtgttcagcaagttccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccgcccccatgagcgagctgaccgagaccctggtgtgcgccctgggcctgagcgtgggcctgatgggcatcgtggtgggcaccgtgttcatcatccagggcctgagaagcgtgggcgccagcagacaccagggcctgctgtag

SEQ ID NO: 87786 - DNA, 768 bp, Artificial Sequence; identical to SEQ ID NO: 87784
  Description of Artificial Sequence: Synthetic coding sequence

SEQ ID NO: 87787 - DNA, 768 bp, Artificial Sequence
  Description of Artificial Sequence: Synthetic coding sequence
atgatcctgaacaaggccctgctgctgggcgccctggccctgaccgccgtgatgagcccctgcggcggcgaggacatcgtggccgaccacgtggccagctacggcgtgaacttctaccagagccacggccccagcggccagtacacccacgagttcgacggcgacgaggagttctacgtggacctggagaccaaggagaccgtgtggcagctgcccatgttcagcaagttcatcagcttcgacccccagagcgccctgagaaacatggccgtgggcaagcacaccctggagttcatgatgagacagagcaacagcaccgccgccaccaacgaggtgcccgaggtgaccgtgttcagcaagttccccgtgaccctgggccagcccaacaccctgatctgcctggtggacaacatcttcccccccgtggtgaacatcacctggctgagcaacggccacagcgtgaccgagggcgtgagcgagaccagcttcctgagcaagagcgaccacagcttcttcaagatcagctacctgaccttcctgcccagcgccgacgagatctacgactgcaaggtggagcactggggcctggacgagcccctgctgaagcactgggagcccgagatccccgcccccatgagcgagctgaccgagaccctggtgtgcgccctgggcctgagcgccggcctgatgggcatcgtggtgggcaccgtgttcatcatccagggcctgagaagcgtgggcgccagcagacaccagggcctgctgtag

SEQ ID NO: 87788 - DNA, 768 bp, Artificial Sequence; identical to SEQ ID NO: 87784
  Description of Artificial Sequence: Synthetic coding sequence

SEQ ID NO: 87789 - DNA, 768 bp, Artificial Sequence; identical to SEQ ID NO: 87784
  Description of Artificial Sequence: Synthetic coding sequence

SEQ ID NO: 87790 - DNA, 768 bp, Artificial Sequence; identical to SEQ ID NO: 87787
  Description of Artificial Sequence: Synthetic coding sequence

SEQ ID NO: 87791 - DNA, 768 bp, Artificial Sequence; identical to SEQ ID NO: 87784
  Description of Artificial Sequence: Synthetic coding sequence

SEQ ID NO: 87792 - DNA, 249 bp, Artificial Sequence
  Description of Artificial Sequence: Synthetic coding sequence
gaccacgtggccagctacggcgtgaacttctaccagagccacggccccagcggccagtacacccacgagttcgacggcgacgaggagttctacgtggacctggagaccaaggagaccgtgtggcagctgcccatgttcagcaagttcatcagcttcgacccccagagcgccctgagaaacatggccgtgggcaagcacaccctggagttcatgatgagacagagcaacagcaccgccgccaccaactag

SEQ ID NO: 87793 - DNA, 768 bp, Artificial Sequence; identical to SEQ ID NO: 87784
  Description of Artificial Sequence: Synthetic coding sequence

SEQ ID NO: 87794 - DNA, 84 bp, Artificial Sequence
  Description of Artificial Sequence: Synthetic coding sequence
atgatcctgaacaaggccctgctgctgggcgccctggccctgaccgccgtgatgagcccctgcggcggcgaggacatcgtgtag

SEQ ID NO: 87795 - DNA, 810 bp, Artificial Sequence
  Description of Artificial Sequence: Synthetic coding sequence
atgagctggaagaaggccctgagaatccccggcgacctgagagtggccaccgtgaccctgatgctggccatgctgagcagcctgctggccgagggcagagacagccccgaggacttcgtgttccagttcaagggcatgtgctacttcaccaacggcaccgagagagtgagactggtgaccagatacatctacaacagagaggagtacgccagattcgacagcgacgtgggcgtgtacagagccgtgaccccccagggcagacccgacgccgagtactggaacagccagaaggaggtgctggagggcaccagagccgagctggacaccgtgtgcagacacaactacgaggtggccttcagaggcatcctgcagagaagagtggagcccaccgtgaccatcagccccagcagaaccgaggccctgaaccaccacaacctgctggtgtgcagcgtgaccgacttctaccccggccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcgtgggcggcttcgtgctgggcctgatcttcctgggcctgggcctgatcatcagacagagaagccagaagggcccccagggccccccccccgccggcctgctgcactag

SEQ ID NO: 87796 - DNA, 786 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87797 - DNA, 786 bp, Artificial Sequence; identical to SEQ ID NO: 87796
  Description of Artificial Sequence: Synthetic coding sequence

SEQ ID NO: 87798 - DNA, 810 bp, Artificial Sequence
  Description of Artificial Sequence: Synthetic coding sequence
atgagctggaagaaggccctgagaatccccggcggcctgagagccgccaccgtgaccctgatgctggccatgctgagcacccccgtggccgagggcagagacagccccgaggacttcgtgtaccagttcaaggccatgtgctacttcaccaacggcaccgagagagtgagatacgtgaccagatacatctacaacagagaggagtacgccagattcgacagcgacgtggaggtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagcacggcgacgtgtacacctgccacgtggagcaccccagcctgcagaaccccatcaccgtggagtggagagcccagagcgagagcgcccagagcaagatgctgagcggcatcggcggcttcgtgctgggcctgatcttcctgggcctgggcctgatcatccaccacagaagccagaagggcccccagggccccccccccgccggcctgctgcactag

SEQ ID NO: 87799 - DNA, 810 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagactggtgaccagatacatctacaacagagaggagtacgccagattcgacagcgacgtgggcgtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagagcccagagcgagagcgcccagagcaagatgctgagcggcatcggcggcttcgtgctgggcctgatcttcctgggcctgggcctgatcatccaccacagaagccagaagggcccccagggccccccccccgccggcctgctgcactag

SEQ ID NO: 87800 - DNA, 675 bp, Artificial Sequence
  Description of Artificial Sequence: Synthetic coding sequence
atgagctggaagaaggccctgagaatccccggcgacctgagagtggccaccgtgaccctgatgctggccatgctgagcagcctgctggccgagggcagagacagccccgaggacttcgtgttccagttcaagggcatgtgctacttcaccaacggcaccgagagagtgagactggtgaccagatacatctacaacagagaggagtacgccagattcgacagcgacgtgggcgtgtacagagccgtgaccccccagggcagacccgacgccgagtactggaacagccagaaggaggtgctggagggcaccagagccgagctggacaccgtgtgcagacacaactacgaggtggccttcagaggcatcctgcagagaagagtggagcccaccgtgaccatcagccccagcagaaccgaggccctgaaccaccacaacctgctggtgtgcagcgtgaccgacttctaccccggccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagactgctgcactag

SEQ ID NO: 87801 - DNA, 786 bp, Artificial Sequence
  Description of Artificial Sequence: Synthetic coding sequence
atgagctggaagaaggccctgagaatccccggcgacctgagagtggccaccgtgaccctgatgctggccatgctgagcagcctgctggccgagggcagagacagccccgaggacttcgtgttccagttcaagggcatgtgctacttcaccaacggcaccgagagagtgagactggtgaccagatacatctacaacagagaggagtacgccagattcgacagcgacgtgggcgtgtacagagccgtgaccccccagggcagacccgacgccgagtactggaacagccagaaggaggtgctggagggcaccagagccgagctggacaccgtgtgcagacacaactacgaggtggccttcagaggcatcctgcagagaagagtggagcccaccgtgaccatcagccccagcagaaccgaggccctgaaccaccacaacctgctggtgtgcagcgtgaccgacttctaccccggccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcgtgggcggcttcgtgctgggcctgatcttcctgggcctgggcctgatcatcagacagagaagccagaagggcctgctgcactag

SEQ ID NO: 87802 - DNA, 786 bp, Artificial Sequence
  Description of Artificial Sequence: Synthetic coding sequence
atgagctggaagaaggccctgagaatccccggcggcctgagagccgccaccgtgaccctgatgctggccatgctgagcacccccgtggccgagggcagagacagccccgaggacttcgtgtaccagttcaaggccatgtgctacttcaccaacggcaccgagagagtgagatacgtgaccagatacatctacaacagagaggagtacgccagattcgacagcgacgtggaggtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagcacggcgacgtgtacacctgccacgtggagcaccccagcctgcagaaccccatcaccgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87803 - DNA, 675 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagactgctgcactag

SEQ ID NO: 87804 - DNA, 786 bp, Artificial Sequence; identical to SEQ ID NO: 87802
  Description of Artificial Sequence: Synthetic coding sequence

SEQ ID NO: 87805 - DNA, 786 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagaggcgtgaccagatacatctacaacagagaggagtacgccagattcgacagcgacgtgggcgtgtacagagccgtgacccccctgggcccccccgccgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87806 - DNA, 675 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagactgctgcactag

SEQ ID NO: 87807 - DNA, 786 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagactggtgaccagatacatctacaacagagaggagtacgccagattcgacagcgacgtgggcgtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87808 - DNA, 786 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87809 - DNA, 810 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcatcggcggcttcgtgctgggcctgatcttcctgggcctgggcctgatcatccaccacagaagccagaagggcccccagggccccccccccgccggcctgctgcactag

SEQ ID NO: 87810 - DNA, 786 bp, Artificial Sequence; identical to SEQ ID NO: 87807
  Description of Artificial Sequence: Synthetic coding sequence

SEQ ID NO: 87811 - DNA, 675 bp, Artificial Sequence
  Description of Artificial Sequence: Synthetic coding sequence
atgagctggaagaaggccctgagaatccccggcggcctgagagccgccaccgtgaccctgatgctggccatgctgagcacccccgtggccgagggcagagacagccccgaggacttcgtgtaccagttcaaggccatgtgctacttcaccaacggcaccgagagagtgagatacgtgaccagatacatctacaacagagaggagtacgccagattcgacagcgacgtggaggtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagcacggcgacgtgtacacctgccacgtggagcaccccagcctgcagaaccccatcaccgtggagtggagactgctgcactag

SEQ ID NO: 87812 - DNA, 786 bp, Artificial Sequence; identical to SEQ ID NO: 87808
  Description of Artificial Sequence: Synthetic coding sequence

SEQ ID NO: 87813 - DNA, 405 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagactgctgcactag

SEQ ID NO: 87814 - DNA, 405 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagactgctgcactag

SEQ ID NO: 87815 - DNA, 435 bp, Artificial Sequence
  Description of Artificial Sequence: Synthetic coding sequence
atgagctggaagaaggccctgagaatccccggcggcctgagagtggccaccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagtag

SEQ ID NO: 87816 - DNA, 405 bp, Artificial Sequence
  Description of Artificial Sequence: Synthetic coding sequence
atgagctggaagaaggccctgagaatccccggcggcctgagagccgccaccgtgaccctgatgctggccatgctgagcacccccgtggccgagggcagagacagccccgtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagcacggcgacgtgtacacctgccacgtggagcaccccagcctgcagaaccccatcaccgtggagtggagactgctgcactag

SEQ ID NO: 87817 - DNA, 786 bp, Artificial Sequence; identical to SEQ ID NO: 87801
  Description of Artificial Sequence: Synthetic coding sequence

SEQ ID NO: 87818 - DNA, 675 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagactggtgaccagatacatctacaacagagaggagtacgccagattcgacagcgacgtgggcgtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagactgctgcactag

SEQ ID NO: 87819 - DNA, 435 bp, Artificial Sequence
  Description of Artificial Sequence: Synthetic coding sequence
atgagctggaagaaggccctgagaatccccggcgacctgagagtggccaccgtgaccccccagggcagacccgacgccgagtactggaacagccagaaggaggtgctggagggcaccagagccgagctggacaccgtgtgcagacacaactacgaggtggccttcagaggcatcctgcagagaagagtggagcccaccgtgaccatcagccccagcagaaccgaggccctgaaccaccacaacctgctggtgtgcagcgtgaccgacttctaccccggccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagtag

SEQ ID NO: 87820 - DNA, 435 bp, Artificial Sequence
  Description of Artificial Sequence: Synthetic coding sequence
atgagctggaagaaggccctgagaatccccggcggcctgagagccgccaccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagtag

SEQ ID NO: 87821 - DNA, 435 bp, Artificial Sequence
  Description of Artificial Sequence: Synthetic coding sequence
atgagctggaagaaggccctgagaatccccggcggcctgagagccgccaccgtgacccccctgggcccccccgacgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagcacggcgacgtgtacacctgccacgtggagtag

SEQ ID NO: 87822 - DNA, 411 bp, Artificial Sequence
  Description of Artificial Sequence: Synthetic coding sequence
atgagctggaagaaggccctgagaatccccggcggcctgagagccgccaccgtgaccctgatgctgagcatgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagaggcatggtgaccggccccagcagaagctggtag

SEQ ID NO: 87823 - DNA, 411 bp, Artificial Sequence
  Description of Artificial Sequence: Synthetic coding sequence
atgagctggaagaaggccctgagaatccccggcggcctgagagccgccaccgtgaccctgatgctggccatgctgagcacccccgtggccgagggcagagacagccccgaggacttcgtgtaccagttcaaggccatgtgctacttcaccaacggcaccgagagagtgagatacgtgaccagatacatctacaacagagaggagtacgccagattcgacagcgacgtggaggtgtacagagccgtgacccccctgggcccccccgacgccgagtactggaacagccagaaggaggtgctggagagaaccagagccgagctggacaccgtgtgcagacacaactaccagctggagctgagaaccaccctgcagagaagaggcaccgtgaccggccccagcagaagctggtag

SEQ ID NO: 87824 - DNA, 411 bp, Artificial Sequence
  Description of Artificial Sequence: Synthetic coding sequence
atgagctggaagaaggccctgagaatccccggcgacctgagagtggccaccgtgaccctgatgctggccatgctgagcagcctgctggccgagggcagagacagccccgaggacttcgtgttccagttcaagggcatgtgctacttcaccaacggcaccgagagagtgagactggtgaccagatacatctacaacagagaggagtacgccagattcgacagcgacgtgggcgtgtacagagccgtgaccccccagggcagacccgacgccgagtactggaacagccagaaggaggtgctggagggcaccagagccgagctggacaccgtgtgcagacacaactacgaggtggccttcagaggcatcctgcagagaagaggcatggtgaccggcctgagcagaagctggtag

SEQ ID NO: 87825 - DNA, 717 bp, Artificial Sequence
  Description of Artificial Sequence: Synthetic coding sequence
atgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacggccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87826 - DNA, 543 bp, Artificial Sequence
  Description of Artificial Sequence: Synthetic coding sequence
atgtgctacttcaccaacggcaccgagagagtgagaggcgtgaccagatacatctacaacagagaggagtacgccagattcgacagcgacgtgggcgtgtacagagccgtgacccccctgggcccccccgccgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagaatggacgagttctag

SEQ ID NO: 87827 - DNA, 717 bp, Artificial Sequence
  Description of Artificial Sequence: Synthetic coding sequence
atgctgagcacccccgtggccgagggcagagacagccccgaggacttcgtgtaccagttcaagggcatgtgctacttcaccaacggcaccgagagagtgagactggtgagcagaagcatctacaacagagaggagatcgtgagattcgacagcgacgtgggcgagttcagagccgtgaccctgctgggcctgcccgccgccgagtactggaacagccagaaggacatcctggagagaaagagagccgccgtggacagagtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccgccggcgtggtgagcacccccctgatcagaaacggcgactggaccttccagatcctggtgatgctggagatgaccccccagagaggcgacgtgtacacctgccacgtggagcaccccagcctgcagagccccatcaccgtggagtggagagcccagagcgagagcgcccagagcaagatgctgagcggcatcggcggcttcgtgctgggcctgatcttcctgggcctgggcctgatcatccaccacagaagccagaagggcctgctgcactag

SEQ ID NO: 87828 - DNA, 744 bp, Artificial Sequence
  Description of Artificial Sequence: Synthetic coding sequence
atgctgagcacccccgtggccgagggcagagacagccccgaggacttcgtgtaccagttcaagggcatgtgctacttcaccaacggcaccgagagagtgagaggcgtgaccagatacatctacaacagagaggagtacgccagattcgacagcgacgtgggcgtgtacagagccgtgacccccctgggcccccccgccgccgagtactggaacagccagaaggaggtgctggagagaaccagagccgagctggacaccgtgtgcagacacaactaccagctggagctgagaaccaccctgcagagaagagtggagcccaccgtgaccatcagccccagcagaaccgaggccctgaaccaccacaacctgctggtgtgcagcgtgaccgacttctaccccgcccagatcaaggtgagatggttcagaaacgaccaggaggagaccaccggcgtggtgagcacccccctgatcagaaacggcgactggaccttccagatcctggtgatgctggagatgaccccccagagaggcgacgtgtacacctgccacgtggagcaccccagcctgcagaaccccatcatcgtggagtggagagcccagagcgagagcgcccagagcaagatgctgagcggcatcggcggcttcgtgctgggcctgatcttcctgggcctgggcctgatcatccaccacagaagccagaaggccctgccccagggccccccccccgccggcgacatcagctag

SEQ ID NO: 87829 - DNA, 717 bp, Artificial Sequence; identical to SEQ ID NO: 87827
  Description of Artificial Sequence: Synthetic coding sequence

SEQ ID NO: 87830 - DNA, 801 bp, Artificial Sequence
  Description of Artificial Sequence: Synthetic coding sequence
atggtgtgcctgagactgcccggcggcagctgcatggccgtgctgaccgtgaccctgatggtgctgagcagccccctggccctggccggcgacaccagacccagattcctggagtacagcaccagcgagtgccacttcttcaacggcaccgagagagtgagatacctggacagatacttccacaaccaggaggagaacgtgagattcgacagcgacgtgggcgagttcagagccgtgaccgagctgggcagacccgacgccgagtactggaacagccagaaggacctgctggagcagaagagaggcagagtggacaactactgcagacacaactacggcgtggtggagagcttcaccgtgcagagaagagtgcaccccaaggtgaccgtgtaccccagcaagacccagcccctgcagcaccacaacctgctggtgtgcagcgtgagcggcttctaccccggcagcatcgaggtgagatggttcagaaacggccaggaggagaagaccggcgtggtgagcaccggcctgatccacaacggcgactggaccttccagaccctggtgatgctggagaccgtgcccagaagcggcgaggtgtacacctgccaggtggagcaccccagcgtgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccagaggcttcctgagctag

SEQ ID NO: 87831 - DNA, 801 bp, Artificial Sequence
  Description of Artificial Sequence: Synthetic coding sequence
atggtgtgcctgaagctgcccggcggcagctgcatgaccgccctgaccgtgaccctgatggtgctgagcagccccctggccctgagcggcgacaccagacccagattcctgtggcagcccaagagagagtgccacttcttcaacggcaccgagagagtgagattcctggacagatacttctacaaccaggaggagagcgtgagattcgacagcgacgtgggcgagttcagagccgtgaccgagctgggcagacccgacgccgagtactggaacagccagaaggacatcctggagcaggccagagccgccgtggacacctactgcagacacaactacggcgtggtggagagcttcaccgtgcagagaagagtgcagcccaaggtgaccgtgtaccccagcaagacccagcccctgcagcaccacaacctgctggtgtgcagcgtgagcggcttctaccccggcagcatcgaggtgagatggttcctgaacggccaggaggagaaggccggcatggtgagcaccggcctgatccagaacggcgactggaccttccagaccctggtgatgctggagaccgtgcccagaagcggcgaggtgtacacctgccaggtggagcaccccagcgtgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87832 - DNA, 801 bp, Artificial Sequence; identical to SEQ ID NO: 87830
  Description of Artificial Sequence: Synthetic coding sequence

SEQ ID NO: 87833 - DNA, 753 bp, Artificial Sequence
  Description of Artificial Sequence: Synthetic coding sequence
ctgctgaagctgaccagagacttcccccagagacacgagaagtaccagagctgggccggcaccttccacctgtgcctgaagaagaacaagtaccccgacagcagaagcaccttcatcaagcacgccggcagctacctgaagagaggcgagttcctgagcatccacaccgccatcacctgcttcttcctgcagatcagcgccagattcctggagcaggtgaagcacgagtgccacttcttcaacggcaccgagagagtgagattcctggacagatacttctaccaccaggaggagtacgtgagattcgacagcgacgtgggcgagtacagagccgtgaccgagctgggcagacccgacgccgagtactggaacagccagaaggacctgctggagcagagaagagccgaggtggacacctactgcagacacaactacggcgtggtggagagcttcaccgtgcagagaagagtgtaccccgaggtgaccgtgtaccccgccaagacccagcccctgcagcaccacaacctgctggtgtgcagcgtgaacggcttctaccccggcagcatcgaggtgagatggttcagaaacggccaggaggagaagaccggcgtggtgagcaccggcctgatccagaacggcgactggaccttccagaccctggtgatgctggagaccgtgcccagaagcggcgaggtgtacacctgccaggtggagcaccccagcctgaccagccccctgaccgtggagtggtag

SEQ ID NO: 87834 - DNA, 756 bp, Artificial Sequence
  Description of Artificial Sequence: Synthetic coding sequence
tgactgctgaagctgaccagagacttcccccagagacacgagaagtaccagagctgggccggcaccttccacctgtgcctgaagaagaacaagtaccccgacagcagaagcaccttcatcaagcacgccggcagctacctgaagagaggcgagttcctggccatccacaccgccatcacctgcttcttcagacagatcagcgccagattcctggagtacagcaccagcgagtgccacttcttcaacggcaccgagagagtgagatacctggacagatacttccacaaccaggaggagaacgtgagattcgacagcgacgtgggcgagttcagagccgtgaccgagctgggcagacccgacgccgagtactggaacagccagaaggacctgctggagcagaagagaggcagagtggacaactactgcagacacaactacggcgtggtggagagcttcaccgtgcagagaagagtgcaccccaaggtgaccgtgtaccccagcaagacccagcccctgcagcaccacaacctgctggtgtgcagcgtgagcggcttctaccccggcagcatcgaggtgagatggttcagaaacggccaggaggagaagaccggcgtggtgagcaccggcctgatccacaacggcgactggaccttccagaccctggtgatgctggagaccgtgcccagaagcggcgaggtgtacacctgccaggtggagcaccccagcgtgaccagccccctgaccgtggagtggtag

SEQ ID NO: 87835 - DNA, 801 bp, Artificial Sequence
  Description of Artificial Sequence: Synthetic coding sequence
atggtgtgcctgaagttccccggcggcagctgcatggccgccctgaccgtgaccctgatggtgctgagcagccccctggccctggccggcgacaccagacccagattcctggagcaggtgaagcacgagtgccacttcttcaacggcaccgagagagtgagattcctggacagatacttctaccaccaggaggagtacgtgagattcgacagcgacgtgggcgagtacagagccgtgaccgagctgggcagacccgacgccgagtactggaacagccagaaggacctgctggagcagagaagagccgaggtggacacctactgcagacacaactacggcgtggtggagagcttcaccgtgcagagaagagtgtaccccgaggtgaccgtgtaccccgccaagacccagcccctgcagcaccacaacctgctggtgtgcagcgtgaacggcttctaccccggcagcatcgaggtgagatggttcagaaacggccaggaggagaagaccggcgtggtgagcaccggcctgatccagaacggcgactggaccttccagaccctggtgatgctggagaccgtgcccagaagcggcgaggtgtacacctgccaggtggagcaccccagcctgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87836 - DNA, 756 bp, Artificial Sequence; identical to SEQ ID NO: 87834
  Description of Artificial Sequence: Synthetic coding sequence

SEQ ID NO: 87837 - DNA, 753 bp, Artificial Sequence
  Description of Artificial Sequence: Synthetic coding sequence
tgactgctgaagctgaccagagacttcccccagagacacgagaagtaccagagctgggccggcaccttccacctgtgcctgaagaagaacaagtaccccgacagcagaagcaccttcatcaagcacgccggcagctacctgaagagaggcgagttcctgagcatccacaccgccatcacctgcttcttcctgcagatcagcgccagattcctgtggcagggcaagtacaagtgccacttcttcaacggcaccgagagagtgcagttcctggagagactgttctacaaccaggaggagttcgtgagattcgacagcgacgtgggcgagtacagagccgtgaccgagctgggcagacccgtggccgagagctggaacagccagaaggacatcctggaggacagaagaggccaggtggacaccgtgtgcagacacaactacggcgtgggcgagagcttcaccgtgcagagaagagtgcaccccgaggtgaccgtgtaccccgccaagacccagcccctgcagcaccacaacctgctggtgtgcagcgtgagcggcttctaccccggcagcatcgaggtgagatggttcagaaacggccaggaggagaaggccggcgtggtgagcaccggcctgatccagaacggcgactggaccttccagaccctggtgatgctggagaccgtgcccagaagcggcgaggtgtacacctgccaggtggagcaccccagcgtgatgagccccctgaccgtggagtag

SEQ ID NO: 87838 - DNA, 801 bp, Artificial Sequence
  Description of Artificial Sequence: Synthetic coding sequence
atggtgtgcctgaagctgcccggcggcagctgcatggccgccctgaccgtgaccctgatggtgctgagcagccccctggccctggccggcgacacccagcccagattcctgtggcagggcaagtacaagtgccacttcttcaacggcaccgagagagtgcagttcctggagagactgttctacaaccaggaggagttcgtgagattcgacagcgacgtgggcgagtacagagccgtgaccgagctgggcagacccgtggccgagagctggaacagccagaaggacatcctggaggacagaagaggccaggtggacaccgtgtgcagacacaactacggcgtgggcgagagcttcaccgtgcagagaagagtgcaccccgaggtgaccgtgtaccccgccaagacccagcccctgcagcaccacaacctgctggtgtgcagcgtgagcggcttctaccccggcagcatcgaggtgagatggttcagaaacggccaggaggagaaggccggcgtggtgagcaccggcctgatccagaacggcgactggaccttccagaccctggtgatgctggagaccgtgcccagaagcggcgaggtgtacacctgccaggtggagcaccccagcgtgatgagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87839 - DNA, 801 bp, Artificial Sequence; identical to SEQ ID NO: 87838
  Description of Artificial Sequence: Synthetic coding sequence

SEQ ID NO: 87840 - DNA, 810 bp, Artificial Sequence
  Description of Artificial Sequence: Synthetic coding sequence
atgagctggaagaaggccctgagaatccccggcggcctgagagtggccaccgtgaccctgatgctggccatgctgagcacccccgtggccgagggcagagacagccccgaggacttcgtgtaccagttcaagggcatgtgctacttcaccaacggcaccgagagagtgagaggcgtgaccagatacatctacaacagagaggagtacgccagattcgacagcgacgtgggcgtgtacagagccgtgacccccctgggcccccccgccgccgagtactggaacagccagaaggaggtgctggagagaaccagagccgagctggacaccgtgtgcagacacaactaccagctggagctgagaaccaccctgcagagaagagtgtaccccgaggtgaccgtgtaccccgccaagacccagcccctgcagcaccacaacctgctggtgtgcagcgtgaacggcttctaccccggcagcatcgaggtgagatggttcagaaacggccaggaggagaagaccggcgtggtgagcaccggcctgatccagaacggcgactggaccttccagaccctggtgatgctggagaccgtgcccagaagcggcgaggtgtacacctgccaggtggagcaccccagcctgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87841 - DNA, 792 bp, Artificial Sequence
  Description of Artificial Sequence: Synthetic coding sequence
atggtgtgcctgaagttccccggcggcagctgcatggccgccctgaccgtgaccctgatggtgctgagcagccccctggccctggccggcgacaccagacccagattcctggagcaggtgaagcacgagtgccacttcttcaacggcaccgagagagtgagattcctggacagatacttctaccaccaggaggagtacgtgagattcgacagcgacgtgggcgagtacagagccgtgaccgagctgggcagacccgacgccgagtactggaacagccagaaggacctgctggagcagagaagagccgaggtggacacctactgcagacacaactacggcgtggtggagagcttcaccgtgcagagaagagtgtaccccgaggtgaccgtgtaccccgccaagacccagcccctgcagcaccacaacctgctggtgtgcagcgtgaacggcttctaccccggcagcatcgaggtgagatggttcagaaacggccaggaggagaagaccggcgtggtgagcaccggcctgatccagaacggcgactggaccttccagaccctggtgatgctggagaccgtgcccagaagcggcgaggtgtacacctgccaggtggagcaccccagcctgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggctag

SEQ ID NO: 87842 - DNA, 141 bp, Artificial Sequence
  Description of Artificial Sequence: Synthetic coding sequence
cacagcggcctgcagcccaccggcaacaccttcagcagcagcctgagaaacagattcggcggccaggcccagcacgcctgcaaccccagcaccctgggcggcagaggcggcagaatcatgagaatccccgagctgaagtag

SEQ ID NO: 87843 - DNA, 891 bp, Artificial Sequence
  Description of Artificial Sequence: Synthetic coding sequence
atggtgtgcctgaagttccccggcggcagctgcatggccgccctgaccgtgaccctgatggtgctgagcagccccctggccctggccggcgacaccagacccagattcctggagcaggtgaagcacgagtgccacttcttcaacggcaccgagagagtgagattcctggacagatacttctaccaccaggaggagtacgtgagattcgacagcgacgtgggcgagtacagagccgtgaccgagctgggcagacccgacgccgagtactggaacagccagaaggacctgctggagcagagaagagccgaggtggacacctactgcagacacaactacggcgtggtggagagcttcaccgtgcagagaagagtgtaccccgaggtgaccgtgtaccccgccaagacccagcccctgcagcaccacaacctgctggtgtgcagcgtgaacggcttctaccccggcagcatcgaggtgagatggttcagaaacggccaggaggagaagaccggcgtggtgagcaccggcctgatccagaacggcgactggaccttccagaccctggtgatgctggagaccgtgcccagaagcggcgaggtgtacacctgccaggtggagcaccccagcctgaccagccccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcaacaccttcagcagcagcctgagaaacagattcggcggccaggcccagtggctgacccccgtgatccccgccctgtgggaggccgaggccggcgagagctag

SEQ ID NO: 87844 - DNA, 801 bp, Artificial Sequence
  Description of Artificial Sequence: Synthetic coding sequence
atggtgtgcctgaagctgcccggcggcagcagcctggccgccctgaccgtgaccctgatggtgctgagcagcagactggccttcgccggcgacaccagacccagattcctggagctgctgaagagcgagtgccacttcttcaacggcaccgagagagtgagattcctggagagacacttccacaaccaggaggagtacgccagattcgacagcgacgtgggcgagtacagagccgtgagagagctgggcagacccgacgccgagtactggaacagccagaaggacctgctggagcagaagagaggccaggtggacaactactgcagacacaactacggcgtgggcgagagcttcaccgtgcagagaagagtgcacccccaggtgaccgtgtaccccgccaagacccagcccctgcagcaccacaacctgctggtgtgcagcgtgagcggcttctaccccggcagcatcgaggtgagatggttcagaaacggccaggaggagaaggccggcgtggtgagcaccggcctgatccagaacggcgactggaccttccagaccctggtgatgctggagaccgtgcccagaagcggcgaggtgtacacctgccaggtggagcaccccagcgtgaccagccccctgaccgtggagtggagcgccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87845 - DNA, 801 bp, Artificial Sequence
  Description of Artificial Sequence: Synthetic coding sequence
atggtgtgcctgaagctgcccggcggcagcagcctggccgccctgaccgtgaccctgatggtgctgagcagcagactggccttcgccggcgacaccagacccagattcctggagctgagaaagagcgagtgccacttcttcaacggcaccgagagagtgagatacctggacagatacttccacaaccaggaggagttcctgagattcgacagcgacgtgggcgagtacagagccgtgaccgagctgggcagacccgtggccgagagctggaacagccagaaggacctgctggagcagaagagaggcagagtggacaactactgcagacacaactacggcgtgggcgagagcttcaccgtgcagagaagagtgcacccccaggtgaccgtgtaccccgccaagacccagcccctgcagcaccacaacctgctggtgtgcagcgtgagcggcttctaccccggcagcatcgaggtgagatggttcagaaacggccaggaggagaaggccggcgtggtgagcaccggcctgatccagaacggcgactggaccttccagaccctggtgatgctggagaccgtgcccagaagcggcgaggtgtacacctgccaggtggagcaccccagcgtgaccagcgccctgaccgtggagtggagagccagaagcgagagcgcccagagcaagatgctgagcggcgtgggcggcttcgtgctgggcctgctgttcctgggcgccggcctgttcatctacttcagaaaccagaagggccacagcggcctgcagcccaccggcttcctgagctag

SEQ ID NO: 87846 - DNA, 801 bp, Artificial Sequence; identical to SEQ ID NO: 87844
  Description of Artificial Sequence: Synthetic coding sequence

SEQ ID NO: 87847 - DNA, 801 bp, Artificial Sequence
  Description of Artificial Sequence: Synthetic coding sequence
atggtgtgcctgaagctgcccggcggcagctacatggccaagctgaccgtgaccctgatggtgctgagcagccccctggccctggccggcgacaccagacccagattcctgcagcaggacaagtacgagtgccacttcttcaacggcaccgagagagtgagattcctgcacagagacatctacaaccaggaggaggacctgagattcgacagcgacgtgggcgagtacagagccgtgaccgagctgggcagacccgacgccgagtactggaacagccagaaggacttcctggaggacagaagagccgccgtggacacctactgcagacacaactacggcgtgggcgagagcttcaccgtgcagagaagagtggagcccaaggtgaccgtgtaccccgccagaacccagaccctgcagcaccacaacctgctggtgtgcagcgtgaacggcttctaccccggcagcatcgaggtgagatggttcagaaacagccaggaggagaaggccggcgtggtgagcaccggcctgatccagaacggcgactggaccttccagaccctggtgatgctggagaccgtgcccagaagcggcgaggtgtacacctgccaggtggagcaccccagcgtgaccagccccctgaccgtggagtggagagcccagagcgagagcgcccagagcaagatgctgagcggcgtgggcggcttcgtgctgggcctgctgttcctgggcgccggcctgttcatctacttcaagaaccagaagggccacagcggcctgcaccccaccggcctggtgagctag

SEQ ID NO: 87848 - DNA, 891 bp, Artificial Sequence
  Description of Artificial Sequence: Synthetic coding sequence
atgggcgagctgatggccttcctgctgcccctgatcatcgtgctgatggtgaagcacagcgacagcagaacccacagcctgagatacttcagactgggcgtgagcgaccccatccacggcgtgcccgagttcatcagcgtgggctacgtggacagccaccccatcaccacctacgacagcgtgaccagacagaaggagcccagagccccctggatggccgagaacctggcccccgaccactgggagagatacacccagctgctgagaggctggcagcagatgttcaaggtggagctgaagagactgcagagacactacaaccacagcgacaacgtggcccacaccatcaagcaggcctgggaggccaaccagcacgagctgctgtaccagaagaactggctggaggaggagtgcatcgcctggctgaagagattcctggagtacggcaaggacaccctgcagagaaccgagccccccctggtgagagtgaacagaaaggagaccttccccggcgtgaccgccctgttctgcaaggcccacggcttctacccccccgagatctacatgacctggatgaagaacggcgaggagatcgtgcaggagatcgactacggcgacatcctgcccagcggcgacggcacctaccaggcctgggccagcatcgagctggacccccagagcagcaacctgtacagctgccacgtggagcactgcggcgtgcacatggtgctgcaggtgccccaggagagcgagaccatccccctggtgatgaaggccgtgagcggcagcatcgtgctggtgatcgtgctggccggcgtgggcgtgctggtgtggagaagaagacccagagagcagaacggcgccatctacctgcccacccccgacagatag

SEQ ID NO: 87849 - DNA, 1026 bp, Artificial Sequence
  Description of Artificial Sequence: Synthetic coding sequence
atgggcgagctgatggccttcctgctgcccctgatcatcgtgctgatggtgaagcacagcgacagcagaacccacagcctgagatacttcagactgggcgtgagcgaccccatccacggcgtgcccgagttcatcagcgtgggctacgtggacagccaccccatcaccacctacgacagcgtgaccagacagaaggagcccagagccccctggatggccgagaacctggcccccgaccactgggagagatacacccagctgctgagaggctggcagcagatgttcaaggtggagctgaagagactgcagagacactacaaccacagcggcagccacacctaccagagaatgatcggctgcgagctgctggaggacggcagcaccaccggcttcctgcagtacgcctacgacggccaggacttcctgatcttcaacaaggacaccctgagctggctggccgtggacaacgtggcccacaccatcaagcaggcctgggaggccaaccagcacgagctgctgtaccagaagaactggctggaggaggagtgcatcgcctggctgaagagattcctggagtacggcaaggacaccctgcagagaaccgagccccccctggtgagagtgaacagaaaggagaccttccccggcgtgaccgccctgttctgcaaggcccacggcttctacccccccgagatctacatgacctggatgaagaacggcgaggagatcgtgcaggagatcgactacggcgacatcctgcccagcggcgacggcacctaccaggcctgggccagcatcgagctggacccccagagcagcaacctgtacagctgccacgtggagcactgcggcgtgcacatggtgctgcaggtgccccaggagagcgagaccatccccctggtgatgaaggccgtgagcggcagcatcgtgctggtgatcgtgctggccggcgtgggcgtgctggtgtggagaagaagacccagagagcagaacggcgccatctacctgcccacccccgacagatag

SEQ ID NO: 87850 - DNA, 645 bp, Artificial Sequence
  Description of Artificial Sequence: Synthetic coding sequence
atgggcgagctgatggccttcctgctgcccctgatcatcgtgctgatggtgaagcacagcgacagcagaacccacagcctgagatacttcagactgggcgtgagcgaccccatccacggcgtgcccgagttcatcagcgtgggctacgtggacagccaccccatcaccacctacgacagcgtgaccagacagaaggagcccagagccccctggatggccgagaacctggcccccgaccactgggagagatacacccagctgctgagaggctggcagcagatgttcaaggtggagctgaagagactgcagagacactacaaccacagcggcagccacacctaccagagaatgatcggctgcgagctgctggaggacggcagcaccaccggcttcctgcagtacgcctacgacggccaggacttcctgatcttcaacaaggacaccctgagctggctggccgtggacaacgtggcccacaccatcaagcaggcctgggaggccaaccagcacgagctgctgtaccagaagaactggctggaggaggagtgcatcgcctggctgaagagattcctggagtacggcaaggacaccctgcagagaaccgagcagaacggcgccatctacctgcccacccccgacagatag

SEQ ID NO: 87851 - DNA, 792 bp, Artificial Sequence
  Description of Artificial Sequence: Synthetic coding sequence
atgtgggagctgagaagcgccagcttctggagagccatcttcgccgagttcttcgccaccctgttctacgtgttcttcggcctgggcagcagcctgagatgggcccccggccccctgcacgtgctgcaggtggccatggccttcggcctggccctggccaccctggtgcagagcgtgggccacatcagcggcgcccacgtgaaccccgccgtgaccttcgccttcctggtgggcagccagatgagcctgctgagagccttctgctacatggccgcccagctgctgggcgccgtggccggcgccgccgtgctgtacagcgtgaccccccccgccgtgagaggcaacctggccctgaacaccctgcaccccgccgtgagcgtgggccaggccaccaccgtggagatcttcctgaccctgcagttcgtgctgtgcatcttcgccacctacgacgagagaagaaacggccagctgggcagcgtggccctggccgtgggcttcagcctggccctgggccacctgttcggcatgtactacaccggcgccggcatgaaccccgccagaagcttcgcccccgccatcctgaccggcaacttcaccaaccactgggtgtactgggtgggccccatcatcggcggcggcctgggcagcctgctgtacgacttcctgctgttccccagactgaagagcatcagcgagagactgagcgtgctgaagggcgccaagcccgacgtgagcaacggccagcccgaggtgaccggcgagcccgtggagctgaacacccaggccctgtag

SEQ ID NO: 87852 - DNA, 2682 bp, Artificial Sequence
  Description of Artificial Sequence: Synthetic coding sequence
atggccaccgaggagttcatcatcagaatccccccctaccactacatccacgtgctggaccagaacagcaacgtgagcagagtggaggtgggccccaagacctacatcagacaggacaacgagagagtgctgttcgcccccatgagaatggtgaccgtgccccccagacactactgcaccgtggccaaccccgtgagcagagacgcccagggcctggtgctgttcgacgtgaccggccaggtgagactgagacacgccgacctggagatcagactggcccaggaccccttccccctgtaccccggcgaggtgctggagaaggacatcacccccctgcaggtggtgctgcccaacaccgccctgcacctgaaggccctgctggacttcgaggacaaggacggcgacaaggtggtggccggcgacgagtggctgttcgagggccccggcacctacatccccagaaaggaggtggaggtggtggagatcatccaggccaccatcatcagacagaaccaggccctgagactgagagccagaaaggagtgctgggacagagacggcaaggagagagtgaccggcgaggagtggctggtgaccaccgtgggcgcctacctgcccgccgtgttcgaggaggtgctggacctggtggacgccgtgatcctgaccgagaagaccgccctgcacctgagagccagaagaaacttcagagacttcagaggcgtgagcagaagaaccggcgaggagtggctggtgaccgtgcaggacaccgaggcccacgtgcccgacgtgcacgaggaggtgctgggcgtggtgcccatcaccaccctgggcccccacaactactgcgtgatcctggaccccgtgggccccgacggcaagaaccagctgggccagaagagagtggtgaagggcgagaagagcttcttcctgcagcccggcgagcagctggagcagggcatccaggacgtgtacgtgctgagcgagcagcagggcctgctgctgagagccctgcagcccctggaggagggcgaggacgaggagaaggtgagccaccaggccggcgaccactggctgatcagaggccccctggagtacgtgcccagcgccaaggtggaggtggtggaggagagacaggccatccccctggacgagaacgagggcatctacgtgcaggacgtgaagaccggcaaggtgagagccgtgatcggcagcacctacatgctgacccaggacgaggtgctgtgggagaaggagctgccccccggcgtggaggagctgctgaacaagggccaggaccccctggccgacagaggcgagaaggacaccgccaagagcctgcagcccctggcccccagaaacaagaccagagtggtgagctacagagtgccccacaacgccgccgtgcaggtgtacgactacagagagaagagagccagagtggtgttcggccccgagctggtgagcctgggccccgaggagcagttcaccgtgctgagcctgagcgccggcagacccaagagaccccacgccagaagagccctgtgcctgctgctgggccccgacttcttcaccgacgtgatcaccatcgagaccgccgaccacgccagactgcagctgcagctggcctacaactggcacttcgaggtgaacgacagaaaggacccccaggagaccgccaagctgttcagcgtgcccgacttcgtgggcgacgcctgcaaggccatcgccagcagagtgagaggcgccgtggccagcgtgaccttcgacgacttccacaagaacagcgccagaatcatcagaaccgccgtgttcggcttcgagaccagcgaggccaagggccccgacggcatggccctgcccagacccagagaccaggccgtgttcccccagaacggcctggtggtgagcagcgtggacgtgcagagcgtggagcccgtggaccagagaaccagagacgccctgcagagaagcgtgcagctggccatcgagatcaccaccaacagccaggaggccgccgccaagcacgaggcccagagactggagcaggaggccagaggcagactggagagacagaagatcctggaccagagcgaggccgagaaggccagaaaggagctgctggagctggaggccctgagcatggccgtggagagcaccggcaccgccaaggccgaggccgagagcagagccgaggccgccagaatcgagggcgagggcagcgtgctgcaggccaagctgaaggcccaggccctggccatcgagaccgaggccgagctgcagagagtgcagaaggtgagagagctggagctggtgtacgccagagcccagctggagctggaggtgagcaaggcccagcagctggccgaggtggaggtgaagaagttcaagcagatgaccgaggccatcggccccagcaccatcagagacctggccgtggccggccccgagatgcaggtgaagctgctgcagagcctgggcctgaagagcaccctgatcaccgacggcagcacccccatcaacctgttcaacaccgccttcggcctgctgggcatgggccccgagggccagcccctgggcagaagagtggccagcggccccagccccggcgagggcatcagcccccagagcgcccaggccccccaggcccccggcgacaaccacgtggtgcccgtgctgagatag

SEQ ID NO: 87853 - DNA, 2682 bp, Artificial Sequence; identical to SEQ ID NO: 87852
  Description of Artificial Sequence: Synthetic coding sequence

SEQ ID NO: 87854 - DNA, 480 bp, Artificial Sequence
  Description of Artificial Sequence: Synthetic coding sequence
atgtgctggaccagaaccgccacctgccccgtgtggagaagcggccagagacccaccagcggcagaaccatgagaggcagcggcttcggcggcagaagacacccctacggcaaggacagccccgccccccccggcagcgccgagctgcccggcctgcagggcagcgtgcccccccactggggcggcgtggccggcaacagcgccggccacagaggccccagagccagatgccccagaggcggcgccggcggctgcgcccaccaccaccccggccccccccagctgctgagagacagcagaccctgcagaaccggctggcaggagagcgccggcgccgaggccagaggccagggcagagaggtgttcttcccccccgccagaagagccgccggcaccagacaccccggctgcgtgtgcgccgtgggcgccgccggcgccgccgccgagggccccgccgcccccggcggcggcggcggctag

SEQ ID NO: 87855 - DNA, 1251 bp, Artificial Sequence
  Description of Artificial Sequence: Synthetic coding sequence
atgagcaccaagcagatcacctgcagatacttcatgcacggcgtgtgcagagagggcagccagtgcctgttcagccacgacctggccaacagcaagcccagcaccatctgcaagtactaccagaagggctactgcgcctacggcaccagatgcagatacgaccacaccagacccagcgccgccgccggcggcgccgtgggcaccatggcccacagcgtgcccagccccgccttccacagcccccacccccccagcgaggtgaccgccagcatcgtgaagaccaacagccacgagcccggcaagagagagaagagaaccctggtgctgagagacagaaacctgagcggcatggccgagagaaagacccagcccagcatggtgagcaaccccggcagctgcagcgacccccagcccagccccgagatgaagccccacagctacctggacgccatcagaagcggcctggacgacgtggaggccagcagcagctacagcaacgagcagcagctgtgcccctacgccgccgccggcgagtgcagattcggcgacgcctgcgtgtacctgcacggcgaggtgtgcgagatctgcagactgcaggtgctgcaccccttcgaccccgagcagagaaaggcccacgagaagatctgcatgctgaccttcgagcacgagatggagaaggccttcgccttccaggccagccaggacaaggtgtgcagcatctgcatggaggtgatcctggagaaggccagcgccagcgagagaagattcggcatcctgagcaactgcaaccacacctactgcctgagctgcatcagacagtggagatgcgccaagcagttcgagaaccccatcatcaagagctgccccgagtgcagagtgatcagcgagttcgtgatccccagcgtgtactgggtggaggaccagaacaagaagaacgagctgatcgaggccttcaagcagggcatgggcaagaaggcctgcaagtacttcgagcagggcaagggcacctgccccttcggcagcaagtgcctgtacagacacgcctaccccgacggcagactggccgagcccgagaagcccagaaagcagctgagcagccagggcaccgtgagattcttcaacagcgtgagactgtgggacttcatcgagaacagagagagcagacacgtgcccaacaacgaggacgtggacatgaccgagctgggcgacctgttcatgcacctgagcggcgtggagagcagcgagccctag

SEQ ID NO: 87856 - DNA, 1524 bp, Artificial Sequence
  Description of Artificial Sequence: Synthetic coding sequence
atggaggagcccgccgcccccagcgaggcccacgaggccgccggcgcccaggccggcgccgaggccgccagagagggcgtgagcggccccgacctgcccgtgtgcgagcccagcggcgagagcgccgcccccgacagcgccctgccccacgccgccagaggctgggcccccttccccgtggcccccgtgcccgcccacctgagaagaggcggcctgagacccgcccccgccagcggcggcggcgcctggcccagccccctgcccagcagaagcagcggcatctggaccaagcagatcatctgcagatactacatccacggccagtgcaaggagggcgagaactgcagatacagccacgacctgagcggcagaaagatggccaccgagggcggcgtgagcccccccggcgccagcgccggcggcggccccagcaccgccgcccacatcgagccccccacccaggaggtggccgaggccccccccgccgccagcagcctgagcctgcccgtgatcggcagcgccgccgagagaggcttcttcgaggccgagagagacaacgccgacagaggcgccgccggcggcgccggcgtggagagctgggccgacgccatcgagttcgtgcccggccagccctacagaggcagatgggtggccagcgcccccgaggcccccctgcagagcagcgagaccgagagaaagcagatggccgtgggcagcggcctgagattctgctactacgccagcagaggcgtgtgcttcagaggcgagagctgcatgtacctgcacggcgacatctgcgacatgtgcggcctgcagaccctgcaccccatggacgccgcccagagagaggagcacatgagagcctgcatcgaggcccacgagaaggacatggagctgagcttcgccgtgcagagaggcatggacaaggtgtgcggcatctgcatggaggtggtgtacgagaaggccaaccccaacgacagaagattcggcatcctgagcaactgcaaccacagcttctgcatcagatgcatcagaagatggagaagcgccagacagttcgagaacagaatcgtgaagagctgcccccagtgcagagtgaccagcgagctggtgatccccagcgagttctgggtggaggaggaggaggagaagcagaagctgatccagcagtacaaggaggccatgagcaacaaggcctgcagatacttcgccgagggcagaggcaactgccccttcggcgacacctgcttctacaagcacgagtaccccgagggctggggcgacgagccccccggccccggcggcggcagcttcagcgcctactggcaccagctggtggagcccgtgagaatgggcgagggcaacatgctgtacaagagcatcaagaaggagctggtggtgctgagactggccagcctgctgttcaagagattcctgagcctgagagacgagctgcccttcagcgaggaccagtgggacctgctgcactacgagctggaggagtacttcaacctgatcctgtag

SEQ ID NO: 87857 - DNA, 462 bp, Artificial Sequence
  Description of Artificial Sequence: Synthetic coding sequence
atggcccccgccgccgccaccggcggcagcaccctgcccagcggcttcagcgtgttcaccaccctgcccgacctgctgttcatcttcgagttcatcttcggcggcctggtgtggatcctggtggccagcagcctggtgccctggcccctggtgcagggctgggtgatgttcgtgagcgtgttctgcttcgtggccaccaccaccctgatcatcctgtacatcatcggcgcccacggcggcgagaccagctgggtgaccctggacgccgcctaccactgcaccgccgccctgttctacctgagcgccagcgtgctggaggccctggccaccatcaccatgcaggacggcttcacctacagacactaccacgagaacatcgccgccgtggtgttcagctacatcgccaccctgctgtacgtggtgcacgccgtgttcagcctgatcagatggaagagcagctag

SEQ ID NO: 87858 - DNA, 168 bp, Artificial Sequence
  Description of Artificial Sequence: Synthetic coding sequence
atggcccccgccgccgccaccggcggcagcaccctgcccagcggcttcagcgtgttcaccaccctgcccgacctgctgttcatcttcgagttcgtgttcagctacatcgccaccctgctgtacgtggtgcacgccgtgttcagcctgatcagatggaagagcagctag

SEQ ID NO: 87859 - DNA, 336 bp, Artificial Sequence
  Description of Artificial Sequence: Synthetic coding sequence
atggcccccgccgccgccaccggcggcagcaccctgcccagcggcttcagcgtgttcaccaccctgcccgacctgctgttcatcttcgagttcatcttcggcggcctggtgtggatcctggtggccagcagcctggtgccctggcccctggtgcagggctgggtgatgttcgtgagcgtgttctgcttcgtggccaccaccaccctgatcatcctgtacatcatcggcgcccacggcggcgagaccagctgggtgaccctggtgttcagctacatcgccaccctgctgtacgtggtgcacgccgtgttcagcctgatcagatggaagagcagctag

SEQ ID NO: 87860 - DNA, 294 bp, Artificial Sequence
  Description of Artificial Sequence: Synthetic coding sequence
atggcccccgccgccgccaccggcggcagcaccctgcccagcggcttcagcgtgttcaccaccctgcccgacctgctgttcatcttcgagttcgacgccgcctaccactgcaccgccgccctgttctacctgagcgccagcgtgctggaggccctggccaccatcaccatgcaggacggcttcacctacagacactaccacgagaacatcgccgccgtggtgttcagctacatcgccaccctgctgtacgtggtgcacgccgtgttcagcctgatcagatggaagagcagctag

SEQ ID NO: 87861 - DNA, 462 bp, Artificial Sequence
  Description of Artificial Sequence: Synthetic coding sequence
atggccagccccgacccccccgccaccagctacgcccccagcgacgtgcccagcggcgtggccctgttcctgaccatccccttcgccttcttcctgcccgagctgatcttcggcttcctggtgtggaccatggtggccgccacccacatcgtgtaccccctgctgcagggctgggtgatgtacgtgagcctgaccagcttcctgatcagcctgatgttcctgctgagctacctgttcggcttctacaagagattcgagagctggagagtgctggacagcctgtaccacggcaccaccggcatcctgtacatgagcgccgccgtgctgcaggtgcacgccaccatcgtgagcgagaagctgctggaccccagaatctactacatcaacagcgccgccagcttcttcgccttcatcgccaccctgctgtacatcctgcacgccttcagcatctactaccactag

SEQ ID NO: 87862 - DNA, 6216 bp, Artificial Sequence
  Description of Artificial Sequence: Synthetic coding sequence
atggagctggcccacagcctgctgctgaacgaggaggccctggcccagatcaccgaggccaagagacccgtgttcatcttcgagtggctgagattcctggacaaggtgctggtggccgccaacaagaccgacgtgaaggagaagcagaagaagctggtggagcagctgaccggcctgatcagcagcagccccggcccccccaccagaaagctgctggccaagaacctggccgccctgtacagcatcggcgacaccttcaccgtgttccagaccctggacaagtgcaacgacatcatcagaaacaaggacgacaccgccgcctacctgcccaccaagctggccgccgtggcctgcgtgggcgccttctacgagaagatgggcagaatgctgggcagcgccttccccgagaccgtgaacaacctgctgaagagcctgaagagcgccgagagccagggcagaagcgagatcctgatgagcctgcagaaggtgctgagcggcctgggcggcgccgccgccagcagccacagagacatctacaagaacgccagaagcctgctgaccgacagaagcatggccgtgagatgcgccgtggccaagtgcctgctggagctgcagaacgaggccgtgttcatgtggaccgccgagctggagaacatcgccaccctgtgcttcaaggccctggagaacagcaactacggcgtgagagtggccgtgagcaagctgctgggcaccgtgatggccaccgccctgatgcccaagcaggccaccgtgatgagacagaacgtgaagagagccaccttcgacgaggtgctggagctgatggccaccggcttcctgagaggcggcagcggcttcctgaagagcggcggcgagatgctgaaggtgggcggcagcgtgaacagagaggtgagagtgggcgtgacccaggcctacgtggtgttcgtgaccaccctgggcggccagtggctggagagaagcttcgccaccttcctgagccacgtgctggacctggtgagccaccccagagccacccagacccacgtggaggccgtgtacagcagaagatgcgtgagcttcatcctgagagccaccgtgggcagcctgctgggcgagaaggcccagatcgccgccgccaaggagatctgccaggccatcggcaagcagatgaaggccgtggaggccgtggtgaacgacaccagcggcgagaacaagagcggcgccgccgacatcgccgccagccagcacgtgatggtgtgcgccctgcaggagctgggcagcctggtgcagagcctgaacgccaccgccagccccctgatccaggaggccagcatcggcctgctggagatcgtgaccagcgtgctgctgcaccccagcatggccgccagactggccgccgcctggtgcctgagatgcgtggccgtggccctgcccttccagctgacccccttcctggacagatgcgccgagagactgaacaacctgaagaccagccccgaggccgtgagcggctacagcttcgccatggccgccctgctgggcggcgtgcaccagtgccccctgggcatcccccacgccaagggcaagatggtggtgagcatcgccgaggacctgctgagaaccgccgcccagaacagcagactgagcctgcagagaacccaggccggctggctgctgctgggcgccctgatgaccctgggccccagcgtggtgagataccacctgcccaagatgctgctgctgtggagaaacgtgttccccagaagcctgaaggagctggaggccgagaaggccagaggcgacagcttcacctggcaggtgaccctggagggcagagccggcgccctgtgcgccatgagaagcttcgtggcccactgccccgagctgctgaccgaggacgtgatcagaaagctgatgacccccatcgagtgcgccatgaccatgatgagccacatccccagcgtgatgaaggcccacggcgcccacctgaaggccagcgccgccatggtgagactgagactgtacgacatcctggccctgctgccccccaagacctacgagggcagcttcaacgccctgctgagagagctggtggccgagttcaccctgaccgacaacagcgccaacaccaccaccagcctgctgagaagcctgtgccactacgacgacagcgtgctgctgggcagctggctgcaggagaccgaccacaagagcatcgaggaccagctgcagcccaacagcgccagcggcagcggcgccctggagcacgaccccagcagcatctacctgagaatccccgccggcgaggccgtgcccggccccctgcccctgggcgtgagcgtgatcgacgccagcgtggccctgttcggcgtggtgttcccccacgtgagctacaagcacagactgcagatgctggaccacttcgccgagtgcgtgaagcaggccaagggcgtgagacagcaggccgtgcagctgaacatcttcaccgccgtgctgagcgccctgaagggcctggccgagaacaagagcaccctgggccccgaggaggtgagaaagagcgccctgaccctggtgatgggccccctggacaaccccaaccccatcctgagatgcgccgccggcgaggccctgggcagaatggcccaggtggtgggcgaggccaccttcatcgccagaatggcccagtacagcttcgacaagctgaagagcgccagagacgtggtgagcagaaccggccacagcctggccctgggctgcctgcacagatacgtgggcggcatcggcagcggccagcacctgaagaccagcgtgagcatcctgctggccctggcccaggacggcaccagccccgaggtgcagacctggagcctgcacagcctggccctgatcgtggacagcagcggccccatgtacagaggctacgtggagcccaccctgagcctggtgctgaccctgctgctgaccgtgccccccagccacaccgaggtgcaccagtgcctgggcagatgcctgggcgccatcatcaccaccgtgggccccgagctgcagggcaacggcgccaccaccagcaccatcagaagcagctgcctggtgggctgcgccatcacccaggaccacagcgacagcctggtgcaggccgccgccatcagctgcctgcagcagctgcacatgttcgcccccagacacgtgaacctgagcagcctggtgcccagcctgtgcgtgcacctgtgcagcagccacctgctgctgagaagagccgccgtggcctgcctgagacagctggcccagagagaggccgccgaggtgtgcgagtacgccatgagcctggccaagaacaccggcgacaaggagagcagcagcgccaacgtgagccccttcgcccccggcgtgagcagcagaaccgacatccactgcagacaccagggcgtgaacatcaccgagaccggcctggagggcctgctgttcggcatgctggacagagagaccgacagaaagctgtgcagcgacatccacgacaccctgggccacatgctgagcagcctggccgtggagaagctgagccactggctgatgctgtgcaaggacgtgctggccgccagcagcgacatgagcaccgccaccctgctgagcagcggcaaggacgaggaggccgagaagaaggacgagatggacgacgacaccatgttcaccaccctgggcgaggaggacaagagcaagcccttcgtggcccccagatgggccaccagagtgttcgccgccgactgcctgtgcagaatcatcaacctgtgcgagaacgccgaccaggcccacttcgacctggccctggccagaagcgccaagctgagaaaccccaccaacgacctgctggtgctgcacctgagcgacctgatcagaatggccttcatggccgccaccgaccacagcaaccagctgagaatggccggcctgcaggccctggaggacatcatcaagaagttcgccagcgtgcccgagcccgagttccccggccacgtgatcctggagcagtaccaggccaacgtgggcgccgccctgagacccgccttcagccaggacacccccagcgacatcatcgccaaggcctgccaggtgtgcagcacctggatcggcagcggcgtggtgagcgacctgaacgacctgagaagagtgcacaacctgctggtgagcagcctggacaaggtgcaggccggcaagggcagcagcagccagctgtacagagagagcgccaccaccatggagaagctggccgtgctgaaggcctgggccgaggtgtacgtggtggccatgaacatcaagaaggaggccgagagcaagcccaagagagccatcaagaacaccgacgacgacgacgacgactgcggcaccatcgacgagctgccccccgacagcctgatcaccctggtgcagcccgagctgcccaccctgagcagactgtggctggccgccctgaaggactacgccctgctgaccctgcccgccgagttcagcagccagctgccccccgacggcggcgccttctacacccccgagaccatcgacaccgccagactgcactacagaaacagctgggcccccatcctgcacgccgtggccctgtggctgaacagcaccggcttcacctgcagcgagagcaccgaggccgccgccatcagcggcctgcagaagagaagcaccagcgtgaacctgaaccaggccagcggcgccgtgggcagcgccaagagcctgcccgagatcaacaaggacagaatgcacctgatcctgggcgtgagcatccagttcctgtgcagccccagacccgaggagcccatcgagcacgtgaccgcctgcctgcaggccctgcacaccctgctggacagcccctacgccagagtgcacatcgccgaggaccagctgatcggcgtggagctgctgagcgtgctgcacagactgctgctgacctggaaccccagcagcgtgcagctgctggtgaccggcgtggtgcagcagatcgtgagagccgcccaggactacctgcaggagaagagaaacaccctgaacgaggacgacatggagaaggaggcctgcaccgtgctgggcgagggcggcgacagcggcggcctgatccccggcaagagcctggtgttcgccaccatggagctgctgatgttcatcctggtgagacacatgccccacctgagcaccaaggtgagcgacagccccagccacatcgccaccaagaccagactgagcgaggagagcgccagactggtggccgccaccgtgaccatcctgagcgacctgcccagcctgtgcagccccgccggctgcatgaccatcctgcccaccatcctgttcctgatcgccagaatcctgaaggacaccgccatcaagagcgccgacaaccaggtgcccccccccgtgagcgccgccctgcagggcatcaagagcatcgtgaccctgagcatggccaagaccgaggccggcgtgcagaagcagtggaccgccctgatcagaagcaccctggcctgcatcctggagtacagccagcccgaggacagcgtgcccacccccgacgaggtgagcatgctgaccgccatcgccctgttcctgtggagcgccagcaacgagatcatcggcgtgcagagcctgcagaacggctgcatgaacagattcaagaacgccctgaacagctgcgacccctgggtgcaggccaagtgctaccagctgctgctgagcgtgttccagcacagcaacagagccctgagcaccccctacatccacagcctggcccccatcgtggtggagaagctgaaggccgtggagagaaacagacccgccagcaacatcgagctgctggccgtgcaggagggcatcaaggtgctggagaccctggtggccctgggcgaggagcagaacagagtgcagctgctggccctgctggtgcccaccctgatcagctacctgctggacgagaacagcttcgccagcgccagcagcgccagcaaggacctgcacgagttcgccctgcagaacctgatgcacatcggccccctgtacccccacgccttcaagaccgtgatgggcgccgcccccgagctgaaggtgagactggagaccgccgtgagagccagccaggccagcaaggccaaggccgccgccagacagcccgcccccgccatccacagcgcccccaccatcaagctgaagaccagcttcttctag

SEQ ID NO: 87863 - DNA, 1005 bp, Artificial Sequence
  Description of Artificial Sequence: Synthetic coding sequence
atgagcgagcccatcagagtgctggtgaccggcgccgccggccagatcgcctacagcctgctgtacagcatcggcaacggcagcgtgttcggcaaggaccagcccatcatcctggtgctgctggacatcacccccatgatgggcgtgctggacggcgtgctgatggagctgcaggactgcgccctgcccctgctgaaggacgtgatcgccaccgacaaggaggacgtggccttcaaggacctggacgtggccatcctggtgggcagcatgcccagaagagagggcatggagagaaaggacctgctgaaggccaacgtgaagatcttcaagagccagggcgccgccctggacaagtacgccaagaagagcgtgaaggtgatcgtggtgggcaaccccgccaacaccaactgcctgaccgccagcaagagcgcccccagcatccccaaggagaacttcagctgcctgaccagactggaccacaacagagccaaggcccagatcgccctgaagctgggcgtgaccgccaacgacgtgaagaacgtgatcatctggggcaaccacagcagcacccagtaccccgacgtgaaccacgccaaggtgaagctgcagggcaaggaggtgggcgtgtacgaggccctgaaggacgacagctggctgaagggcgagttcgtgaccaccgtgcagcagagaggcgccgccgtgatcaaggccagaaagctgagcagcgccatgagcgccgccaaggccatctgcgaccacgtgagagacatctggttcggcacccccgagggcgagttcgtgagcatgggcgtgatcagcgacggcaacagctacggcgtgcccgacgacctgctgtacagcttccccgtggtgatcaagaacaagacctggaagttcgtggagggcctgcccatcaacgacttcagcagagagaagatggacctgaccgccaaggagctgaccgaggagaaggagagcgccttcgagttcctgagcagcgcctag

SEQ ID NO: 87864 - DNA, 1059 bp, Artificial Sequence
  Description of Artificial Sequence: Synthetic coding sequence
atgagaagatgcagctacttccccaaggacgtgaccgtgttcgacaaggacgacaagagcgagcccatcagagtgctggtgaccggcgccgccggccagatcgcctacagcctgctgtacagcatcggcaacggcagcgtgttcggcaaggaccagcccatcatcctggtgctgctggacatcacccccatgatgggcgtgctggacggcgtgctgatggagctgcaggactgcgccctgcccctgctgaaggacgtgatcgccaccgacaaggaggacgtggccttcaaggacctggacgtggccatcctggtgggcagcatgcccagaagagagggcatggagagaaaggacctgctgaaggccaacgtgaagatcttcaagagccagggcgccgccctggacaagtacgccaagaagagcgtgaaggtgatcgtggtgggcaaccccgccaacaccaactgcctgaccgccagcaagagcgcccccagcatccccaaggagaacttcagctgcctgaccagactggaccacaacagagccaaggcccagatcgccctgaagctgggcgtgaccgccaacgacgtgaagaacgtgatcatctggggcaaccacagcagcacccagtaccccgacgtgaaccacgccaaggtgaagctgcagggcaaggaggtgggcgtgtacgaggccctgaaggacgacagctggctgaagggcgagttcgtgaccaccgtgcagcagagaggcgccgccgtgatcaaggccagaaagctgagcagcgccatgagcgccgccaaggccatctgcgaccacgtgagagacatctggttcggcacccccgagggcgagttcgtgagcatgggcgtgatcagcgacggcaacagctacggcgtgcccgacgacctgctgtacagcttccccgtggtgatcaagaacaagacctggaagttcgtggagggcctgcccatcaacgacttcagcagagagaagatggacctgaccgccaaggagctgaccgaggagaaggagagcgccttcgagttcctgagcagcgcctag

SEQ ID NO: 87865 - DNA, 738 bp, Artificial Sequence
  Description of Artificial Sequence: Synthetic coding sequence
atgcccagaagagagggcatggagagaaaggacctgctgaaggccaacgtgaagatcttcaagagccagggcgccgccctggacaagtacgccaagaagagcgtgaaggtgatcgtggtgggcaaccccgccaacaccaactgcctgaccgccagcaagagcgcccccagcatccccaaggagaacttcagctgcctgaccagactggaccacaacagagccaaggcccagatcgccctgaagctgggcgtgaccgccaacgacgtgaagaacgtgatcatctggggcaaccacagcagcacccagtaccccgacgtgaaccacgccaaggtgaagctgcagggcaaggaggtgggcgtgtacgaggccctgaaggacgacagctggctgaagggcgagttcgtgaccaccgtgcagcagagaggcgccgccgtgatcaaggccagaaagctgagcagcgccatgagcgccgccaaggccatctgcgaccacgtgagagacatctggttcggcacccccgagggcgagttcgtgagcatgggcgtgatcagcgacggcaacagctacggcgtgcccgacgacctgctgtacagcttccccgtggtgatcaagaacaagacctggaagttcgtggagggcctgcccatcaacgacttcagcagagagaagatggacctgaccgccaaggagctgaccgaggagaaggagagcgccttcgagttcctgagcagcgcctag

SEQ ID NO: 87866 - DNA, 1017 bp, Artificial Sequence
  Description of Artificial Sequence: Synthetic coding sequence
atgctgagcgccctggccagacccgccagcgccgccctgagaagaagcttcagcaccagcgcccagaacaacgccaaggtggccgtgctgggcgccagcggcggcatcggccagcccctgagcctgctgctgaagaacagccccctggtgagcagactgaccctgtacgacatcgcccacacccccggcgtggccgccgacctgagccacatcgagaccaaggccgccgtgaagggctacctgggccccgagcagctgcccgactgcctgaagggctgcgacgtggtggtgatccccgccggcgtgcccagaaagcccggcatgaccagagacgacctgttcaacaccaacgccaccatcgtggccaccctgaccgccgcctgcgcccagcactgccccgaggccatgatctgcgtgatcgccaaccccgtgaacagcaccatccccatcaccgccgaggtgttcaagaagcacggcgtgtacaaccccaacaagatcttcggcgtgaccaccctggacatcgtgagagccaacaccttcgtggccgagctgaagggcctggaccccgccagagtgaacgtgcccgtgatcggcggccacgccggcaagaccatcatccccctgatcagccagtgcacccccaaggtggacttcccccaggaccagctgaccgccctgaccggcagaatccaggaggccggcaccgaggtggtgaaggccaaggccggcgccggcagcgccaccctgagcatggcctacgccggcgccagattcgtgttcagcctggtggacgccatgaacggcaaggagggcgtggtggagtgcagcttcgtgaagagccaggagaccgagtgcacctacttcagcacccccctgctgctgggcaagaagggcatcgagaagaacctgggcatcggcaaggtgagcagcttcgaggagaagatgatcagcgacgccatccccgagctgaaggccagcatcaagaagggcgaggacttcgtgaagaccctgaagtag

SEQ ID NO: 87867 - DNA, 1872 bp, Artificial Sequence
  Description of Artificial Sequence: Synthetic coding sequence
atgaacagatacaccaccatgagacagctgggcgacggcacctacggcagcgtgctgatgggcaagagcaacgagagcggcgagctggtggccatcaagagaatgaagagaaagttctacagctgggacgagtgcatgaacctgagagaggtgaagagcctgaagaagctgaaccacgccaacgtgatcaagctgaaggaggtgatcagagagaacgaccacctgtacttcatcttcgagtacatgaaggagaacctgtaccagctgatgaaggacagaaacaagctgttccccgagagcgtgatcagaaacatcatgtaccagatcctgcagggcctggccttcatccacaagcacggcttcttccacagagacatgaagcccgagaacctgctgtgcatgggccccgagctggtgaagatcgccgacttcggcctggccagagagctgagaagccagcccccctacaccgactacgtgagcaccagatggtacagagcccccgaggtgctgctgagaagcagcgtgtacagcagccccatcgacgtgtgggccgtgggcagcatcatggccgagctgtacatgctgagacccctgttccccggcaccagcgaggtggacgagatcttcaagatctgccaggtgctgggcacccccaagaagagcgactggcccgagggctaccagctggccagcagcatgaacttcagattcccccagtgcgtgcccatcaacctgaagaccctgatccccaacgccagcaacgaggccatccagctgatgaccgagatgctgaactgggaccccaagaagagacccaccgccagccaggccctgaagcacccctacttccaggtgggccaggtgctgggccccagcagcaaccacctggagagcaagcagagcctgaacaagcagctgcagcccctggagagcaagcccagcctggtggaggtggagcccaagcccctgcccgacatcatcgaccaggtggtgggccagccccagcccaagaccagccagcagcccctgcagcccatccagcccccccagaacctgagcgtgcagcagccccccaagcagcagagccaggagaagcccccccagaccctgttccccagcatcgtgaagaacatgcccaccaagcccaacggcaccctgagccacaagagcggcagaagaagatggggccagaccatcttcaagagcggcgacagctgggaggagctggaggactacgacttcggcgccagccacagcaagaagcccagcatgggcgtgttcaaggagaagagaaagaaggacagccccttcagactgcccgagcccgtgcccagcggcagcaaccacagcaccggcgagaacaagagcctgcccgccgtgaccagcctgaagagcgacagcgagctgagcaccgcccccaccagcaagcagtactacctgaagcagagcagatacctgcccggcgtgaaccccaagaaggtgagcctgatcgccagcggcaaggagatcaacccccacacctggagcaaccagctgttccccaagagcctgggccccgtgggcgccgagctggccttcaagagaagcaacgccggcaacctgggcagctacgccacctacaaccagagcggctacatccccagcttcctgaagaaggaggtgcagagcgccggccagagaatccacctggcccccctgaacgccaccgccagcgagtacacctggaacaccaagaccggcagaggccagttcagcggcagaacctacaaccccaccgccaagaacctgaacatcgtgaacagagcccagcccatccccagcgtgcacggcagaaccgactgggtggccaagtacggcggccacagatag

SEQ ID NO: 87868 - DNA, 1872 bp, Artificial Sequence; identical to SEQ ID NO: 87867
  Description of Artificial Sequence: Synthetic coding sequence

SEQ ID NO: 87869 - DNA, 867 bp, Artificial Sequence
  Description of Artificial Sequence: Synthetic coding sequence
atgaacagatacaccaccatgagacagctgggcgacggcacctacggcagcgtgctgatgggcaagagcaacgagagcggcgagctggtggccatcaagagaatgaagagaaagttctacagctgggacgagtgcatgaacctgagagaggtgaagagcctgaagaagctgaaccacgccaacgtgatcaagctgaaggaggtgatcagagagaacgaccacctgtacttcatcttcgagtacatgaaggagaacctgtaccagctgatgaaggacagaaacaagctgttccccgagagcgtgatcagaaacatcatgtaccagatcctgcagggcctggccttcatccacaagcacggcttcttccacagagacatgaagcccgagaacctgctgtgcatgggccccgagctggtgaagatcgccgacttcggcctggccagagagctgagaagccagcccccctacaccgactacgtgagcaccagatggtacagagcccccgaggtgctgctgagaagcagcgtgtacagcagccccatcgacgtgtgggccgtgggcagcatcatggccgagctgtacatgctgagacccctgttccccggcaccagcgaggtggacgagatcttcaagatctgccaggtgctgggcacccccaagaagagcgactggcccgagggctaccagctggccagcagcatgaacttcagattcccccagtgcgtgcccatcaacctgaagaccctgatccccaacgccagcaacgaggccatccagctgatgaccgagatgctgaactgggaccccaagaagagacccaccgccagccagccctgcttcctggtggaggtggagagacccaactag

SEQ ID NO: 87870 - DNA, 1374 bp, Artificial Sequence
  Description of Artificial Sequence: Synthetic coding sequence
atgaacagatacaccaccatgagacagctgggcgacggcacctacggcagcgtgctgatgggcaagagcaacgagagcggcgagctggtggccatcaagagaatgaagagaaagttctacagctgggacgagtgcatgaacctgagagaggtgaagagcctgaagaagctgaaccacgccaacgtgatcaagctgaaggaggtgatcagagagaacgaccacctgtacttcatcttcgagtacatgaaggagaacctgtaccagctgatgaaggacagaaacaagctgttccccgagagcgtgatcagaaacatcatgtaccagatcctgcagggcctggccttcatccacaagcacggcttcttccacagagacatgaagcccgagaacctgctgtgcatgggccccgagctggtgaagatcgccgacttcggcctggccagagagctgagaagccagcccccctacaccgactacgtgagcaccagatggtacagagcccccgaggtgctgctgagaagcagcgtgtacagcagccccatcgacgtgtgggccgtgggcagcatcatggccgagctgtacatgctgagacccctgttccccggcaccagcgaggtggacgagatcttcaagatctgccaggtgctgggcacccccaagaagagcgactggcccgagggctaccagctggccagcagcatgaacttcagattcccccagtgcgtgcccatcaacctgaagaccctgatccccaacgccagcaacgaggccatccagctgatgaccgagatgctgaactgggaccccaagaagagacccaccgccagccaggccctgaagcacccctacttccaggtgggccaggtgctgggccccagcagcaaccacctggagagcaagcagagcctgaacaagcagctgcagcccctggagagcaagcccagcctggtggaggtggagcccaagcccctgcccgacatcatcgaccaggtggtgggccagccccagcccaagaccagccagcagcccctgcagcccatccagcccccccagaacctgagcgtgcagcagccccccaagcagcagagccaggagaagcccccccagaccctgttccccagcatcgtgaagaacatgcccaccaagcccaacggcaccctgagccacaagagcggcagaagaagatggggccagaccatcttcaagagcggcgacagctgggaggagctggaggactacgacttcggcgccagccacagcaagaagcccagcatgggcgtgttcaaggagaagagaaagaaggacagccccttcagacagcaggtgaagatggccgtgatcagcctgagcgcccaccagttccccaccctgtag

SEQ ID NO: 87871 - DNA, 942 bp, Artificial Sequence
  Description of Artificial Sequence: Synthetic coding sequence
atggaggagatgagcggcgagagcgtggtgagcagcgccgtgcccgccgccgccaccagaaccaccagcttcaagggcaccagccccagcagcaagtacgtgaagctgaacgtgggcggcgccctgtactacaccaccatgcagaccctgaccaagcaggacaccatgctgaaggccatgttcagcggcagaatggaggtgctgaccgacagcgagggctggatcctgatcgacagatgcggcaagcacttcggcaccatcctgaactacctgagagacggcgccgtgcccctgcccgagagcagaagagagatcgaggagctgctggccgaggccaagtactacctggtgcagggcctggtggaggagtgccaggccgccctgcagaacaaggacacctacgagcccttctgcaaggtgcccgtgatcaccagcagcaaggaggagcagaagctgatcgccaccagcaacaagcccgccgtgaagctgctgtacaacagaagcaacaacaagtacagctacaccagcaacagcgacgacaacatgctgaagaacatcgagctgttcgacaagctgagcctgagattcaacggcagagtgctgttcatcaaggacgtgatcggcgacgagatctgctgctggagcttctacggccagggcagaaagatcgccgaggtgtgctgcaccagcatcgtgtacgccaccgagaagaagcagaccaaggtggagttccccgaggccagaatctacgaggagaccctgaacatcctgctgtacgaggcccaggacggcagaggccccgacaacgccctgctggaggccaccggcggcgccgccggcagaagccaccacctggacgaggacgaggagagagagagaatcgagagagtgagaagaatccacatcaagagacccgacgacagagcccacctgcaccagtag

SEQ ID NO: 87872 - DNA, 558 bp, Artificial Sequence
  Description of Artificial Sequence: Synthetic coding sequence
atgggccccgagagacacctgagcggcgcccccgccagaatggccaccgtggtgctgggcggcgacaccatgggccccgagagaatcttccccaaccagaccgaggagctgggccaccagggccccagcgagggcaccggcgactggagcagcgaggagcccgaggaggagcaggaggagaccggcagcggccccgccggctacagctaccagcccctgaaccaggaccccgagcaggaggaggtggagctggcccccgtgggcgacggcgacgtggtggccgacatccaggacagaatccaggccctgggcctgcacctgcccgacccccccctggagagcgaggacgaggacgaggagggcgccaccgccctgaacaaccacagcagcatccccatggaccccgagcacgtggagctggtgaagagaaccatggccggcgtgagcctgcccgcccccggcgtgcccgcctgggccagagagatcagcgacgcccagtgggaggacgtggtgcagaaggccctgcaggccagacaggccagccccgcctggaagtag

SEQ ID NO: 87873 - DNA, 1719 bp, Artificial Sequence
  Description of Artificial Sequence: Synthetic coding sequence
atggagcccgaggcccccagaagaagacacacccaccagagaggctacctgctgaccagaaacccccacctgaacaaggacctggccttcaccctggaggagagacagcagctgaacatccacggcctgctgccccccagcttcaacagccaggagatccaggtgctgagagtggtgaagaacttcgagcacctgaacagcgacttcgacagatacctgctgctgatggacctgcaggacagaaacgagaagctgttctacagagtgctgaccagcgacatcgagaagttcatgcccatcgtgtacacccccaccgtgggcctggcctgccagcagtacagcctggtgttcagaaagcccagaggcctgttcatcaccatccacgacagaggccacatcgccagcgtgctgaacgcctggcccgaggacgtgatcaaggccatcgtggtgaccgacggcgagagaatcctgggcctgggcgacctgggctgcaacggcatgggcatccccgtgggcaagctggccctgtacaccgcctgcggcggcatgaacccccaggagtgcctgcccgtgatcctggacgtgggcaccgagaacgaggagctgctgaaggaccccctgtacatcggcctgagacagagaagagtgagaggcagcgagtacgacgacttcctggacgagttcatggaggccgtgagcagcaagtacggcatgaactgcctgatccagttcgaggacttcgccaacgtgaacgccttcagactgctgaacaagtacagaaaccagtactgcaccttcaacgacgacatccagggcaccgccagcgtggccgtggccggcctgctggccgccctgagaatcaccaagaacaagctgagcgaccagaccatcctgttccagggcgccggcgaggccgccctgggcatcgcccacctgatcgtgatggccctggagaaggagggcctgcccaaggagaaggccatcaagaagatctggctggtggacagcaagggcctgatcgtgaagggcagagccagcctgacccaggagaaggagaagttcgcccacgagcacgaggagatgaagaacctggaggccatcgtgcaggagatcaagcccaccgccctgatcggcgtggccgccatcggcggcgccttcagcgagcagatcctgaaggacatggccgccttcaacgagagacccatcatcttcgccctgagcaaccccaccagcaaggccgagtgcagcgccgagcagtgctacaagatcaccaagggcagagccatcttcgccagcggcagccccttcgaccccgtgaccctgcccaacggccagaccctgtaccccggccagggcaacaacagctacgtgttccccggcgtggccctgggcgtggtggcctgcggcctgagacagatcaccgacaacatcttcctgaccaccgccgaggtgatcgcccagcaggtgagcgacaagcacctggaggagggcagactgtacccccccctgaacaccatcagagacgtgagcctgaagatcgccgagaagatcgtgaaggacgcctaccaggagaagaccgccaccgtgtaccccgagccccagaacaaggaggccttcgtgagaagccagatgtacagcaccgactacgaccagatcctgcccgactgctacagctggcccgaggaggtgcagaagatccagaccaaggtggaccagtag

SEQ ID NO: 87874 - DNA, 699 bp, Artificial Sequence
  Description of Artificial Sequence: Synthetic coding sequence
gtgaagggcagagccagcctgacccaggagaaggagaagttcgcccacgagcacgaggagatgaagaacctggaggccatcgtgcaggagatcaagcccaccgccctgatcggcgtggccgccatcggcggcgccttcagcgagcagatcctgaaggacatggccgccttcaacgagagacccatcatcttcgccctgagcaaccccaccagcaaggccgagtgcagcgccgagcagtgctacaagatcaccaagggcagagccatcttcgccagcggcagccccttcgaccccgtgaccctgcccaacggccagaccctgtaccccggccagggcaacaacagctacgtgttccccggcgtggccctgggcgtggtggcctgcggcctgagacagatcaccgacaacatcttcctgaccaccgccgaggtgatcgcccagcaggtgagcgacaagcacctggaggagggcagactgtacccccccctgaacaccatcagagacgtgagcctgaagatcgccgagaagatcgtgaaggacgcctaccaggagaagaccgccaccgtgtaccccgagccccagaacaaggaggccttcgtgagaagccagatgtacagcaccgactacgaccagatcctgcccgactgctacagctggcccgaggaggtgcagaagatccagaccaaggtggaccagtag

SEQ ID NO: 87875 - DNA, 1221 bp, Artificial Sequence
  Description of Artificial Sequence: Synthetic coding sequence
atgggcatccccgtgggcaagctggccctgtacaccgcctgcggcggcatgaacccccaggagtgcctgcccgtgatcctggacgtgggcaccgagaacgaggagctgctgaaggaccccctgtacatcggcctgagacagagaagagtgagaggcagcgagtacgacgacttcctggacgagttcatggaggccgtgagcagcaagtacggcatgaactgcctgatccagttcgaggacttcgccaacgtgaacgccttcagactgctgaacaagtacagaaaccagtactgcaccttcaacgacgacatccagggcaccgccagcgtggccgtggccggcctgctggccgccctgagaatcaccaagaacaagctgagcgaccagaccatcctgttccagggcgccggcgaggccgccctgggcatcgcccacctgatcgtgatggccctggagaaggagggcctgcccaaggagaaggccatcaagaagatctggctggtggacagcaagggcctgatcgtgaagggcagagccagcctgacccaggagaaggagaagttcgcccacgagcacgaggagatgaagaacctggaggccatcgtgcaggagatcaagcccaccgccctgatcggcgtggccgccatcggcggcgccttcagcgagcagatcctgaaggacatggccgccttcaacgagagacccatcatcttcgccctgagcaaccccaccagcaaggccgagtgcagcgccgagcagtgctacaagatcaccaagggcagagccatcttcgccagcggcagccccttcgaccccgtgaccctgcccaacggccagaccctgtaccccggccagggcaacaacagctacgtgttccccggcgtggccctgggcgtggtggcctgcggcctgagacagatcaccgacaacatcttcctgaccaccgccgaggtgatcgcccagcaggtgagcgacaagcacctggaggagggcagactgtacccccccctgaacaccatcagagacgtgagcctgaagatcgccgagaagatcgtgaaggacgcctaccaggagaagaccgccaccgtgtaccccgagccccagaacaaggaggccttcgtgagaagccagatgtacagcaccgactacgaccagatcctgcccgactgctacagctggcccgaggaggtgcagaagatccagaccaaggtggaccagtag

SEQ ID NO: 87876 - DNA, 1494 bp, Artificial Sequence
  Description of Artificial Sequence: Synthetic coding sequence
atggacctgcaggacagaaacgagaagctgttctacagagtgctgaccagcgacatcgagaagttcatgcccatcgtgtacacccccaccgtgggcctggcctgccagcagtacagcctggtgttcagaaagcccagaggcctgttcatcaccatccacgacagaggccacatcgccagcgtgctgaacgcctggcccgaggacgtgatcaaggccatcgtggtgaccgacggcgagagaatcctgggcctgggcgacctgggctgcaacggcatgggcatccccgtgggcaagctggccctgtacaccgcctgcggcggcatgaacccccaggagtgcctgcccgtgatcctggacgtgggcaccgagaacgaggagctgctgaaggaccccctgtacatcggcctgagacagagaagagtgagaggcagcgagtacgacgacttcctggacgagttcatggaggccgtgagcagcaagtacggcatgaactgcctgatccagttcgaggacttcgccaacgtgaacgccttcagactgctgaacaagtacagaaaccagtactgcaccttcaacgacgacatccagggcaccgccagcgtggccgtggccggcctgctggccgccctgagaatcaccaagaacaagctgagcgaccagaccatcctgttccagggcgccggcgaggccgccctgggcatcgcccacctgatcgtgatggccctggagaaggagggcctgcccaaggagaaggccatcaagaagatctggctggtggacagcaagggcctgatcgtgaagggcagagccagcctgacccaggagaaggagaagttcgcccacgagcacgaggagatgaagaacctggaggccatcgtgcaggagatcaagcccaccgccctgatcggcgtggccgccatcggcggcgccttcagcgagcagatcctgaaggacatggccgccttcaacgagagacccatcatcttcgccctgagcaaccccaccagcaaggccgagtgcagcgccgagcagtgctacaagatcaccaagggcagagccatcttcgccagcggcagccccttcgaccccgtgaccctgcccaacggccagaccctgtaccccggccagggcaacaacagctacgtgttccccggcgtggccctgggcgtggtggcctgcggcctgagacagatcaccgacaacatcttcctgaccaccgccgaggtgatcgcccagcaggtgagcgacaagcacctggaggagggcagactgtacccccccctgaacaccatcagagacgtgagcctgaagatcgccgagaagatcgtgaaggacgcctaccaggagaagaccgccaccgtgtaccccgagccccagaacaaggaggccttcgtgagaagccagatgtacagcaccgactacgaccagatcctgcccgactgctacagctggcccgaggaggtgcagaagatccagaccaaggtggaccagtag

SEQ ID NO: 87877 - DNA, 1755 bp, Artificial Sequence
  Description of Artificial Sequence: Synthetic coding sequence
atgctgagcagactgagagtggtgagcaccacctgcaccctggcctgcagacacctgcacatcaaggagaagggcaagcccctgatgctgaaccccagaaccaacaagggcatggccttcaccctgcaggagagacagatgctgggcctgcagggcctgctgccccccaagatcgagacccaggacatccaggccctgagattccacagaaacctgaagaagatgaccagccccctggagaagtacatctacatcatgggcatccaggagagaaacgagaagctgttctacagaatcctgcaggacgacatcgagagcctgatgcccatcgtgtacacccccaccgtgggcctggcctgcagccagtacggccacatcttcagaagacccaagggcctgttcatcagcatcagcgacagaggccacgtgagaagcatcgtggacaactggcccgagaaccacgtgaaggccgtggtggtgaccgacggcgagagaatcctgggcctgggcgacctgggcgtgtacggcatgggcatccccgtgggcaagctgtgcctgtacaccgcctgcgccggcatcagacccgacagatgcctgcccgtgtgcatcgacgtgggcaccgacaacatcgccctgctgaaggaccccttctacatgggcctgtaccagaagagagacagaacccagcagtacgacgacctgatcgacgagttcatgaaggccatcaccgacagatacggcagaaacaccctgatccagttcgaggacttcggcaaccacaacgccttcagattcctgagaaagtacagagagaagtactgcaccttcaacgacgacatccagggcaccgccgccgtggccctggccggcctgctggccgcccagaaggtgatcagcaagcccatcagcgagcacaagatcctgttcctgggcgccggcgaggccgccctgggcatcgccaacctgatcgtgatgagcatggtggagaacggcctgagcgagcaggaggcccagaagaagatctggatgttcgacaagtacggcctgctggtgaagggcagaaaggccaagatcgacagctaccaggagcccttcacccacagcgcccccgagagcatccccgacaccttcgaggacgccgtgaacatcctgaagcccagcaccatcatcggcgtggccggcgccggcagactgttcacccccgacgtgatcagagccatggccagcatcaacgagagacccgtgatcttcgccctgagcaaccccaccgcccaggccgagtgcaccgccgaggaggcctacaccctgaccgagggcagatgcctgttcgccagcggcagccccttcggccccgtgaagctgaccgacggcagagtgttcacccccggccagggcaacaacgtgtacatcttccccggcgtggccctggccgtgatcctgtgcaacaccagacacatcagcgacagcgtgttcctggaggccgccaaggccctgaccagccagctgaccgacgaggagctggcccagggcagactgtacccccccctggccaacatccaggaggtgagcatcaacatcgccatcaaggtgaccgagtacctgtacgccaacaagatggccttcagataccccgagcccgaggacaaggccaagtacgtgaaggagagaacctggagaagcgagtacgacagcctgctgcccgacgtgtacgagtggcccgagagcgccagcagcccccccgtgatcaccgagtag

SEQ ID NO: 87878 - DNA, 1440 bp, Artificial Sequence
  Description of Artificial Sequence: Synthetic coding sequence
atgctgagcagactgagagtggtgagcaccacctgcaccctggcctgcagacacctgcacatcaaggagaagggcaagcccctgatgctgaaccccagaaccaacaagggcatggccttcaccctgcaggagagacagatgctgggcctgcagggcctgctgccccccaagatcgagacccaggacatccaggccctgagattccacagaaacctgaagaagatgaccagccccctggagaagtacatctacatcatgggcatccaggagagaaacgagaagctgttctacagaatcctgcaggacgacatcgagagcctgatgcccatcgtgtacacccccaccgtgggcctggcctgcagccagtacggccacatcttcagaagacccaagggcctgttcatcagcatcagcgacagaggccacgtgagaagcatcgtggacaactggcccgagaaccacgtgaaggccgtggtggtgaccgacggcgagagaatcctgggcctgggcgacctgggcgtgtacggcatgggcatccccgtgggcaagctgtgcctgtacaccgcctgcgccggcatcagacccgacagatgcctgcccgtgtgcatcgacgtgggcaccgacaacatcgccctgctgaaggaccccttctacatgggcctgtaccagaagagagacagaacccagcagtacgacgacctgatcgacgagttcatgaaggccatcaccgacagatacggcagaaacaccctgatccagttcgaggacttcggcaaccacaacgccttcagattcctgagaaagtacagagagaagtactgcaccttcaacgacgacatccagggcaccgccgccgtggccctggccggcctgctggccgcccagaaggtgatcagcaagcccatcagcgagcacaagatcctgttcctgggcgccggcgaggccgccctgggcatcgccaacctgatcgtgatgagcatggtggagaacggcctgagcgagcaggaggcccagaagaagatctggatgttcgacaagtacggcctgctggtgaagggcagaaaggccaagatcgacagctaccaggagcccttcacccacagcgcccccgagagcatccccgacaccttcgaggacgccgtgaacatcctgaagcccagcaccatcatcggcgtggccggcgccggcagactgttcacccccgacgtgatcagagccatggccagcatcaacgagagacccgtgatcttcgccctgagcaaccccaccgcccaggccgagtgcaccgccgaggaggcctacaccctgaccgagggcagatgcctgttcgccagcggcagccccttcggccccgtgaagctgaccgacggcagagtgttcacccccggccagggcaacaacgtgtacatcttccccggctacagaatccccatctgctag

SEQ ID NO: 87879 - DNA, 780 bp, Artificial Sequence
  Description of Artificial Sequence: Synthetic coding sequence
atggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgaccttcagaagacccagaggcctgttcatcaccatccacgacaagggccacctggccaccatgctgaacagctggcccgaggacaacatcaaggccgtggtggtgaccgacggcgagagaatcctgggcctgggcgacctgggctgctacggcatgggcatccccgtgggcaagctggccctgtacaccgcctgcggcggcgtgaacccccagcagtgcctgcccgtgctgctggacgtgggcaccaacaacgaggagctgctgagagaccccctgtacatcggcctgaagcaccagagagtgcacggcaaggcctacgacgacctgctggacgagttcatgcaggccgtgaccgacaagttcggcatcaactgcctgatccagttcgaggacttcgccaacgccaacgccttcagactgctgaacaagtacagaaacaagtactgcatgttcaacgacgacatccaggacgacttcagcagaggccccaagagaagccagctgttcttcaagtag

SEQ ID NO: 87880 - DNA, 1815 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaagggcatggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgaccttcagaagacccagaggcctgttcatcaccatccacgacaagggccacctggccaccatgctgaacagctggcccgaggacaacatcaaggccgtggtggtgaccgacggcgagagaatcctgggcctgggcgacctgggctgctacggcatgggcatccccgtgggcaagctggccctgtacaccgcctgcggcggcgtgaacccccagcagtgcctgcccgtgctgctggacgtgggcaccaacaacgaggagctgctgagagaccccctgtacatcggcctgaagcaccagagagtgcacggcaaggcctacgacgacctgctggacgagttcatgcaggccgtgaccgacaagttcggcatcaactgcctgatccagttcgaggacttcgccaacgccaacgccttcagactgctgaacaagtacagaaacaagtactgcatgttcaacgacgacatccagggcaccgccagcgtggccgtggccggcatcctggccgccctgagaatcaccaagaacaagctgagcaaccacgtgttcgtgttccagggcgccggcgaggccgccatgggcatcgcccacctgctggtgatggccctggagaaggagggcgtgcccaaggccgaggccaccagaaagatctggatggtggacagcaagggcctgatcgtgaagggcagaagccacctgaaccacgagaaggagatgttcgcccaggaccaccccgaggtgaacagcctggaggaggtggtgagactggtgaagcccaccgccatcatcggcgtggccgccatcgccggcgccttcaccgagcagatcctgagagacatggccagcttccacgagagacccatcatcttcgccctgagcaaccccaccagcaaggccgagtgcaccgccgagaagtgctacagagtgaccgagggcagaggcatcttcgccagcggcagccccttcaagagcgtgaccctggaggacggcaagaccttcatccccggccagggcaacaacgcctacgtgttccccggcgtggccctgggcgtgatcgccggcggcatcagacacatccccgacgagatcttcctgctgaccgccgagcagatcgcccaggaggtgagcgagcagcacctgagccagggcagactgtacccccccctgagcaccatcagagacgtgagcctgagaatcgccatcaaggtgctggactacgcctacaagcacaacctggccagctactaccccgagcccaaggacaaggaggccttcgtgagaagcctggtgtacacccccgactacgacagcttcaccctggacagctacacctggcccaaggaggccatgaacgtgcagaccgtgtag

SEQ ID NO: 87881 - DNA, 1815 bp, Artificial Sequence; identical to SEQ ID NO: 87880
  Description of Artificial Sequence: Synthetic coding sequence

SEQ ID NO: 87882 - DNA, 1746 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaagggcatggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgaccttcagaagacccagaggcctgttcatcaccatccacgacaagggccacctggccaccatgctgaacagctggcccgaggacaacatcaaggccgtggtggtgaccgacggcgagagaatcctgggcctgggcgacctgggctgctacggcatgggcatccccgtgggcaagctggccctgtacaccgcctgcggcggcgtgaacccccagcagtgcctgcccgtgctgctggacgtgggcaccaacaacgaggagctgctgagagaccccctgtacatcggcctgaagcaccagagagtgcacggcaaggcctacgacgacctgctggacgagttcatgcaggccgtgaccgacaagttcggcatcaactgcctgatccagttcgaggacttcgccaacgccaacgccttcagactgctgaacaagtacagaaacaagtactgcatgttcaacgacgacatccagggcaccgccagcgtggccgtggccggcatcctggccgccctgagaatcaccaagaacaagctgagcaaccacgtgttcgtgttccagggcgccggcgaggccgccatgggcatcgcccacctgctggtgatggccctggagaaggagggcgtgcccaaggccgaggccaccagaaagatctggatggtggacagcaagggcctgatcgtgaagggcagaagccacctgaaccacgagaaggagatgttcgcccaggaccaccccgaggtgaacagcctggaggaggtggtgagactggtgaagcccaccgccatcatcggcgtggccgccatcgccggcgccttcaccgagcagatcctgagagacatggccagcttccacgagagacccatcatcttcgccctgagcaaccccaccagcaaggccgagtgcaccgccgagaagtgctacagagtgaccgagggcagaggcatcttcgccagcggcagccccttcaagagcgtgaccctggaggacggcaagaccttcatccccggccagggcaacaacgcctacgtgttccccggcgtggccctgggcgtgatcgccggcggcatcagacacatccccgacgagatcttcctgctgaccgccgagcagatcgcccaggaggtgagcgagcagcacctgagccagggcagactgtacccccccctgagcaccatcagagacgtgagcctgagaatcgccatcaaggtgctggactacgcctacaagcacaacctggccagctactaccccgagcccaaggacaaggaggccttcgtgagaagcctggtgtacacctag

SEQ ID NO: 87883 - DNA, 1029 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaagggcatggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgaccttcagaagacccagaggcctgttcatcaccatccacgacaagggccacctggccaccatgctgaacagctggcccgaggacaacatcaaggccgtggtggtgaccgacggcgagagaatcctgggcctgggcgacctgggctgctacggcatgggcatccccgtgggcaagctggccctgtacaccgcctgcggcggcgtgaacccccagcagtgcctgcccgtgctgctggacgtgggcaccaacaacgaggagctgctgagagaccccctgtacatcggcctgaagcaccagagagtgcacggcaaggcctacgacgacctgctggacgagttcatgcaggccgtgaccgacaagttcggcatcaactgcctgatccagttcgaggacttcgccaacgccaacgccttcagactgctgaacaagtacagaaacaagtactgcatgttcaacgacgacatccagggcaccacctgccacaccttcagctgcccctggcacctgtgggcccaggtgatgttccagcacatccccggccccatgggcttcagcgagtggctgcccagaaacagctag

SEQ ID NO: 87884 - DNA, 189 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaaggtgtag

SEQ ID NO: 87885 - DNA, 186 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaagtag

SEQ ID NO: 87886 - DNA, 456 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaagggcatggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgacctag

SEQ ID NO: 87887 - DNA, 240 bp, Artificial Sequence
  Description of Artificial Sequence: Synthetic coding sequence
atgggcgccgccctgggcaccggcaccagactggccccctggcccggcagagcctgcggcgccctgcccagatggacccccaccgcccccgcccagggctgccacagcaagcccggccccgccagacccgtgcccctgaagaagagaggctacgacgtgaccagaaacccccacctgaacaaggtgatgggccagagagccggcagacccgccctgagaagcagaggctgcagaaagtag

SEQ ID NO: 87888 - DNA, 1815 bp, Artificial Sequence; identical to SEQ ID NO: 87880
  Description of Artificial Sequence: Synthetic coding sequence

SEQ ID NO: 87889 - DNA, 759 bp, Artificial Sequence
  Description of Artificial Sequence: Synthetic coding sequence
atggccttcaccctggaggagagactgcagctgggcatccacggcctgatccccccctgcttcctgagccaggacgtgcagctgctgagaatcatgagatactacgagagacagcagagcgacctggacaagtacatcatcctgatgaccctgcaggacagaaacgagaagctgttctacagagtgctgaccagcgacgtggagaagttcatgcccatcgtgtacacccccaccgtgggcctggcctgccagcactacggcctgaccttcagaagacccagaggcctgttcatcaccatccacgacaagggccacctggccaccatgctgaacagctggcccgaggacaacatcaaggccgtggtggtgaccgacggcgagagaatcctgggcctgggcgacctgggctgctacggcatgggcatccccgtgggcaagctggccctgtacaccgcctgcggcggcgtgaacccccagcagtgcctgcccgtgctgctggacgtgggcaccaacaacgaggagctgctgagagaccccctgtacatcggcctgaagcaccagagagtgcacggcaaggcctacgacgacctgctggacgagttcatgcaggccgtgaccgacaagttcggcatcaactgcctgatccagttcgaggacttcgccaacgccaacgccttcagactgctgaacaagtacagaaacaagtactgcatgttcaacgacgacatccaggcccccagcaccgcccccgccacctag

SEQ ID NO: 87890 - DNA, 1482 bp, Artificial Sequence
  Description of Artificial Sequence: Synthetic coding sequence
atgagaggcttcggccccggcctgaccgccagaagactgctgcccctgagactgccccccagaccccccggccccagactggccagcggccaggccgccggcgccctggagagagccatggacgagctgctgagaagagccgtgccccccacccccgcctacgagctgagagagaagacccccgcccccgccgagggccagtgcgccgacttcgtgagcttctacggcggcctggccgagaccgcccagagagccgagctgctgggcagactggccagaggcttcggcgtggaccacggccaggtggccgagcagagcgccggcgtgctgcacctgagacagcagcagagagaggccgccgtgctgctgcaggccgaggacagactgagatacgccctggtgcccagatacagaggcctgttccaccacatcagcaagctggacggcggcgtgagattcctggtgcagctgagagccgacctgctggaggcccaggccctgaagctggtggagggccccgacgtgagagagatgaacggcgtgctgaagggcatgctgagcgagtggttcagcagcggcttcctgaacctggagagagtgacctggcacagcccctgcgaggtgctgcagaagatcagcgaggccgaggccgtgcaccccgtgaagaactggatggacatgaagagaagagtgggcccctacagaagatgctacttcttcagccactgcagcacccccggcgagcccctggtggtgctgcacgtggccctgaccggcgacatcagcagcaacatccaggccatcgtgaaggagcacccccccagcgagaccgaggagaagaacaagatcaccgccgccatcttctacagcatcagcctgacccagcagggcctgcagggcgtggagctgggcaccttcctgatcaagagagtggtgaaggagctgcagagagagttcccccacctgggcgtgttcagcagcctgagccccatccccggcttcaccaagtggctgctgggcctgctgaacagccagaccaaggagcacggcagaaacgagctgttcaccgacagcgagtgcaaggagatcagcgagatcaccggcggccccatcaacgagaccctgaagctgctgctgagcagcagcgagtgggtgcagagcgagaagctggtgagagccctgcagacccccctgatgagactgtgcgcctggtacctgtacggcgagaagcacagaggctacgccctgaaccccgtggccaacttccacctgcagaacggcgccgtgctgtggagaatcaactggatggccgacgtgagcctgagaggcatcaccggcagctgcggcctgatggccaactacagatacttcctggaggagaccggccccaacagcaccagctacctgggcagcaagatcatcaaggccagcgagcaggtgctgagcctggtggcccagttccagaagaacagcaagctgtag

SEQ ID NO: 87891 - DNA, 558 bp, Artificial Sequence
  Description of Artificial Sequence: Synthetic coding sequence
atggccagaaagaagctgaagaagttcaccaccctggagatcgtgctgagcgtgctgctgctggtgctgttcatcatcagcatcgtgctgatcgtgctgctggccaaggagagcctgaagagcaccgcccccgaccccggcaccaccggcacccccgaccccggcaccaccggcacccccgaccccggcaccaccggcaccacccacgccagaaccaccggcccccccgaccccggcaccaccggcaccacccccgtgagcgccgagtgccccgtggtgaacgagctggagagaatcaactgcatccccgaccagccccccaccaaggccacctgcgaccagagaggctgctgctggaacccccagggcgccgtgagcgtgccctggtgctactacagcaagaaccacagctaccacgtggagggcaacctggtgaacaccaacgccggcttcaccgccagactgaagaacctgcccagcagccccgtgttcggcagcaacgtggacaacgtgctgctgaccgccgagtaccagaccagcaacagattccacttctag

SEQ ID NO: 87892 - DNA, 4989 bp, Artificial Sequence
  Description of Artificial Sequence: Synthetic coding sequence
gccgtgagcgtgccctggtgctactacagcaagaaccacagctaccacgtggagggcaacctggtgaacaccaacgccggcttcaccgccagactgaagaacctgcccagcagccccgtgttcggcagcaacgtggacaacgtgctgctgaccgccgagtaccagaccagcaacagattccacttcaagctgaccgaccagaccaacaacagattcgaggtgccccacgagcacgtgcagagcttcagcggcaacgccgccgccagcctgacctaccaggtggagatcagcagacagcccttcagcatcaaggtgaccagaagaagcaacaacagagtgctgttcgacagcagcatcggccccctgctgttcgccgaccagttcctgcagctgagcaccagactgcccagcaccaacgtgtacggcctgggcgagcacgtgcaccagcagtacagacacgacatgaactggaagacctggcccatcttcaacagagacaccacccccaacggcaacggcaccaacctgtacggcgcccagaccttcttcctgtgcctggaggacgccagcggcctgagcttcggcgtgttcctgatgaacagcaacgccatggaggtggtgctgcagcccgcccccgccatcacctacagaaccatcggcggcatcctggacttctacgtgttcctgggcaacacccccgagcaggtggtgcaggagtacctggagctgatcggcagacccgccctgcccagctactgggccctgggcttccacctgagcagatacgagtacggcaccctggacaacatgagagaggtggtggagagaaacagagccgcccagctgccctacgacgtgcagcacgccgacatcgactacatggacgagagaagagacttcacctacgacagcgtggacttcaagggcttccccgagttcgtgaacgagctgcacaacaacggccagaagctggtgatcatcgtggaccccgccatcagcaacaacagcagcagcagcaagccctacggcccctacgacagaggcagcgacatgaagatctgggtgaacagcagcgacggcgtgacccccctgatcggcgaggtgtggcccggccagaccgtgttccccgactacaccaaccccaactgcgccgtgtggtggaccaaggagttcgagctgttccacaaccaggtggagttcgacggcatctggatcgacatgaacgaggtgagcaacttcgtggacggcagcgtgagcggctgcagcaccaacaacctgaacaacccccccttcacccccagaatcctggacggctacctgttctgcaagaccctgtgcatggacgccgtgcagcactggggcaagcagtacgacatccacaacctgtacggctacagcatggccgtggccaccgccgaggccgccaagaccgtgttccccaacaagagaagcttcatcctgaccagaagcaccttcgccggcagcggcaagttcgccgcccactggctgggcgacaacaccgccacctgggacgacctgagatggagcatccccggcgtgctggagttcaacctgttcggcatccccatggtgggccccgacatctgcggcttcgccctggacacccccgaggagctgtgcagaagatggatgcagctgggcgccttctaccccttcagcagaaaccacaacggccagggctacaaggaccaggaccccgccagcttcggcgccgacagcctgctgctgaacagcagcagacactacctgaacatcagatacaccctgctgccctacctgtacaccctgttcttcagagcccacagcagaggcgacaccgtggccagacccctgctgcacgagttctacgaggacaacagcacctgggacgtgcaccagcagttcctgtggggccccggcctgctgatcacccccgtgctggacgagggcgccgagaaggtgatggcctacgtgcccgacgccgtgtggtacgactacgagaccggcagccaggtgagatggagaaagcagaaggtggagatggagctgcccggcgacaagatcggcctgcacctgagaggcggctacatcttccccacccagcagcccaacaccaccaccctggccagcagaaagaaccccctgggcctgatcatcgccctggacgagaacaaggaggccaagggcgagctgttctgggacaacggcgagaccaaggacaccgtggccaacaaggtgtacctgctgtgcgagttcagcgtgacccagaacagactggaggtgaacatcagccagagcacctacaaggaccccaacaacctggccttcaacgagatcaagatcctgggcaccgaggagcccagcaacgtgaccgtgaagcacaacggcgtgcccagccagaccagccccaccgtgacctacgacagcaacctgaaggtggccatcatcaccgacatcgacctgctgctgggcgaggcctacaccgtggagtggagcatcaagatcagagacgaggagaagatcgactgctaccccgacgagaacggcgccagcgccgagaactgcaccgccagaggctgcatctgggaggccagcaacagcagcggcgtgcccttctgctacttcgtgaacgacctgtacagcgtgagcgacgtgcagtacaacagccacggcgccaccgccgacatcagcctgaagagcagcgtgtacgccaacgccttccccagcacccccgtgaaccccctgagactggacgtgacctaccacaagaacgagatgctgcagttcaagatctacgaccccaacaagaacagatacgaggtgcccgtgcccctgaacatccccagcatgcccagcagcacccccgagggccagctgtacgacgtgctgatcaagaagaaccccttcggcatcgagatcagaagaaagagcaccggcaccatcatctgggacagccagctgctgggcttcaccttcagcgacatgttcatcagaatcagcaccagactgcccagcaagtacctgtacggcttcggcgagaccgagcacagaagctacagaagagacctggagtggcacacctggggcatgttcagcagagaccagccccccggctacaagaagaacagctacggcgtgcacccctactacatgggcctggaggaggacggcagcgcccacggcgtgctgctgctgaacagcaacgccatggacgtgaccttccagcccctgcccgccctgacctacagaaccaccggcggcgtgctggacttctacgtgttcctgggccccacccccgagctggtgacccagcagtacaccgagctgatcggcagacccgtgatggtgccctactggagcctgggcttccagctgtgcagatacggctaccagaacgacagcgagatcgccagcctgtacgacgagatggtggccgcccagatcccctacgacgtgcagtacagcgacatcgactacatggagagacagctggacttcaccctgagccccaagttcgccggcttccccgccctgatcaacagaatgaaggccgacggcatgagagtgatcctgatcctggaccccgccatcagcggcaacgagacccagccctaccccgccttcaccagaggcgtggaggacgacgtgttcatcaagtaccccaacgacggcgacatcgtgtggggcaaggtgtggcccgacttccccgacgtggtggtgaacggcagcctggactgggacagccaggtggagctgtacagagcctacgtggccttccccgacttcttcagaaacagcaccgccaagtggtggaagagagagatcgaggagctgtacaacaacccccagaaccccgagagaagcctgaagttcgacggcatgtggatcgacatgaacgagcccagcagcttcgtgaacggcgccgtgagccccggctgcagagacgccagcctgaaccaccccccctacatgccccacctggagagcagagacagaggcctgagcagcaagaccctgtgcatggagagccagcagatcctgcccgacggcagcctggtgcagcactacaacgtgcacaacctgtacggctggagccagaccagacccacctacgaggccgtgcaggaggtgaccggccagagaggcgtggtgatcaccagaagcaccttccccagcagcggcagatgggccggccactggctgggcgacaacaccgccgcctgggaccagctgaagaagagcatcatcggcatgatggagttcagcctgttcggcatcagctacaccggcgccgacatctgcggcttcttccaggacgccgagtacgagatgtgcgtgagatggatgcagctgggcgccttctaccccttcagcagaaaccacaacaccatcggcaccagaagacaggaccccgtgagctgggacgccgccttcgtgaacatcagcagaaacgtgctgcagaccagatacaccctgctgccctacctgtacaccctgatgcagaaggcccacaccgagggcgtgaccgtggtgagacccctgctgcacgagttcgtgagcgaccaggtgacctgggacatcgacagccagttcctgctgggccccgccttcctggtgagccccgtgctggagagaaacgccagaaacgtgaccgcctacttccccagagccagatggtacgactactacaccggcgtggacatcaacgccagaggcgagtggaagaccctgcccgcccccctggaccacatcaacctgcacgtgagaggcggctacatcctgccctggcaggagcccgccctgaacacccacctgagcagaaagaaccccctgggcctgatcatcgccctggacgagaacaaggaggccaagggcgagctgttctgggacgacggccagaccaaggacaccgtggccaagaaggtgtacctgctgtgcgagttcagcgtgacccagcaggtggtgttcctgaacatcgtgttcaactag

SEQ ID NO: 87893 - DNA, 5574 bp, Artificial Sequence
  Description of Artificial Sequence: Synthetic coding sequence
atggccagaaagaagctgaagaagttcaccaccctggagatcgtgctgagcgtgctgctgctggtgctgttcatcatcagcatcgtgctgatcgtgctgctggccaaggagagcctgaagagcaccgcccccgaccccggcaccaccggcacccccgaccccggcaccaccggcacccccgaccccggcaccaccggcaccacccacgccagaaccaccggcccccccgaccccggcaccaccggcaccacccccgtgagcgccgagtgccccgtggtgaacgagctggagagaatcaactgcatccccgaccagccccccaccaaggccacctgcgaccagagaggctgctgctggaacccccagggcgccgtgagcgtgccctggtgctactacagcaagaaccacagctaccacgtggagggcaacctggtgaacaccaacgccggcttcaccgccagactgaagaacctgcccagcagccccgtgttcggcagcaacgtggacaacgtgctgctgaccgccgagtaccagaccagcaacagattccacttcaagctgaccgaccagaccaacaacagattcgaggtgccccacgagcacgtgcagagcttcagcggcaacgccgccgccagcctgacctaccaggtggagatcagcagacagcccttcagcatcaaggtgaccagaagaagcaacaacagagtgctgttcgacagcagcatcggccccctgctgttcgccgaccagttcctgcagctgagcaccagactgcccagcaccaacgtgtacggcctgggcgagcacgtgcaccagcagtacagacacgacatgaactggaagacctggcccatcttcaacagagacaccacccccaacggcaacggcaccaacctgtacggcgcccagaccttcttcctgtgcctggaggacgccagcggcctgagcttcggcgtgttcctgatgaacagcaacgccatggaggtggtgctgcagcccgcccccgccatcacctacagaaccatcggcggcatcctggacttctacgtgttcctgggcaacacccccgagcaggtggtgcaggagtacctggagctgatcggcagacccgccctgcccagctactgggccctgggcttccacctgagcagatacgagtacggcaccctggacaacatgagagaggtggtggagagaaacagagccgcccagctgccctacgacgtgcagcacgccgacatcgactacatggacgagagaagagacttcacctacgacagcgtggacttcaagggcttccccgagttcgtgaacgagctgcacaacaacggccagaagctggtgatcatcgtggaccccgccatcagcaacaacagcagcagcagcaagccctacggcccctacgacagaggcagcgacatgaagatctgggtgaacagcagcgacggcgtgacccccctgatcggcgaggtgtggcccggccagaccgtgttccccgactacaccaaccccaactgcgccgtgtggtggaccaaggagttcgagctgttccacaaccaggtggagttcgacggcatctggatcgacatgaacgaggtgagcaacttcgtggacggcagcgtgagcggctgcagcaccaacaacctgaacaacccccccttcacccccagaatcctggacggctacctgttctgcaagaccctgtgcatggacgccgtgcagcactggggcaagcagtacgacatccacaacctgtacggctacagcatggccgtggccaccgccgaggccgccaagaccgtgttccccaacaagagaagcttcatcctgaccagaagcaccttcgccggcagcggcaagttcgccgcccactggctgggcgacaacaccgccacctgggacgacctgagatggagcatccccggcgtgctggagttcaacctgttcggcatccccatggtgggccccgacatctgcggcttcgccctggacacccccgaggagctgtgcagaagatggatgcagctgggcgccttctaccccttcagcagaaaccacaacggccagggctacaaggaccaggaccccgccagcttcggcgccgacagcctgctgctgaacagcagcagacactacctgaacatcagatacaccctgctgccctacctgtacaccctgttcttcagagcccacagcagaggcgacaccgtggccagacccctgctgcacgagttctacgaggacaacagcacctgggacgtgcaccagcagttcctgtggggccccggcctgctgatcacccccgtgctggacgagggcgccgagaaggtgatggcctacgtgcccgacgccgtgtggtacgactacgagaccggcagccaggtgagatggagaaagcagaaggtggagatggagctgcccggcgacaagatcggcctgcacctgagaggcggctacatcttccccacccagcagcccaacaccaccaccctggccagcagaaagaaccccctgggcctgatcatcgccctggacgagaacaaggaggccaagggcgagctgttctgggacaacggcgagaccaaggacaccgtggccaacaaggtgtacctgctgtgcgagttcagcgtgacccagaacagactggaggtgaacatcagccagagcacctacaaggaccccaacaacctggccttcaacgagatcaagatcctgggcaccgaggagcccagcaacgtgaccgtgaagcacaacggcgtgcccagccagaccagccccaccgtgacctacgacagcaacctgaaggtggccatcatcaccgacatcgacctgctgctgggcgaggcctacaccgtggagtggagcatcaagatcagagacgaggagaagatcgactgctaccccgacgagaacggcgccagcgccgagaactgcaccgccagaggctgcatctgggaggccagcaacagcagcggcgtgcccttctgctacttcgtgaacgacctgtacagcgtgagcgacgtgcagtacaacagccacggcgccaccgccgacatcagcctgaagagcagcgtgtacgccaacgccttccccagcacccccgtgaaccccctgagactggacgtgacctaccacaagaacgagatgctgcagttcaagatctacgaccccaacaagaacagatacgaggtgcccgtgcccctgaacatccccagcatgcccagcagcacccccgagggccagctgtacgacgtgctgatcaagaagaaccccttcggcatcgagatcagaagaaagagcaccggcaccatcatctgggacagccagctgctgggcttcaccttcagcgacatgttcatcagaatcagcaccagactgcccagcaagtacctgtacggcttcggcgagaccgagcacagaagctacagaagagacctggagtggcacacctggggcatgttcagcagagaccagccccccggctacaagaagaacagctacggcgtgcacccctactacatgggcctggaggaggacggcagcgcccacggcgtgctgctgctgaacagcaacgccatggacgtgaccttccagcccctgcccgccctgacctacagaaccaccggcggcgtgctggacttctacgtgttcctgggccccacccccgagctggtgacccagcagtacaccgagctgatcggcagacccgtgatggtgccctactggagcctgggcttccagctgtgcagatacggctaccagaacgacagcgagatcgccagcctgtacgacgagatggtggccgcccagatcccctacgacgtgcagtacagcgacatcgactacatggagagacagctggacttcaccctgagccccaagttcgccggcttccccgccctgatcaacagaatgaaggccgacggcatgagagtgatcctgatcctggaccccgccatcagcggcaacgagacccagccctaccccgccttcaccagaggcgtggaggacgacgtgttcatcaagtaccccaacgacggcgacatcgtgtggggcaaggtgtggcccgacttccccgacgtggtggtgaacggcagcctggactgggacagccaggtggagctgtacagagcctacgtggccttccccgacttcttcagaaacagcaccgccaagtggtggaagagagagatcgaggagctgtacaacaacccccagaaccccgagagaagcctgaagttcgacggcatgtggatcgacatgaacgagcccagcagcttcgtgaacggcgccgtgagccccggctgcagagacgccagcctgaaccaccccccctacatgccccacctggagagcagagacagaggcctgagcagcaagaccctgtgcatggagagccagcagatcctgcccgacggcagcctggtgcagcactacaacgtgcacaacctgtacggctggagccagaccagacccacctacgaggccgtgcaggaggtgaccggccagagaggcgtggtgatcaccagaagcaccttccccagcagcggcagatgggccggccactggctgggcgacaacaccgccgcctgggaccagctgaagaagagcatcatcggcatgatggagttcagcctgttcggcatcagctacaccggcgccgacatctgcggcttcttccaggacgccgagtacgagatgtgcgtgagatggatgcagctgggcgccttctaccccttcagcagaaaccacaacaccatcggcaccagaagacaggaccccgtgagctgggacgtggccttcgtgaacatcagcagaaccgtgctgcagaccagatacaccctgctgccctacctgtacaccctgatgcacaaggcccacaccgagggcgtgaccgtggtgagacccctgctgcacgagttcgtgagcgaccaggtgacctgggacatcgacagccagttcctgctgggccccgccttcctggtgagccccgtgctggagagaaacgccagaaacgtgaccgcctacttccccagagccagatggtacgactactacaccggcgtggacatcaacgccagaggcgagtggaagaccctgcccgcccccctggaccacatcaacctgcacgtgagaggcggctacatcctgccctggcaggagcccgccctgaacacccacctgagcagacagaagttcatgggcttcaagatcgccctggacgacgagggcaccgccggcggctggctgttctgggacgacggccagagcatcgacacctacggcaagggcctgtactacctggccagcttcagcgccagccagaacaccatgcagagccacatcatcttcaacaactacatcaccggcaccaaccccctgaagctgggctacatcgagatctggggcgtgggcagcgtgcccgtgaccagcgtgagcatcagcgtgagcggcatggtgatcacccccagcttcaacaacgaccccaccacccaggtgctgagcatcgacgtgaccgacagaaacatcagcctgcacaacttcaccagcctgacctggatcagcaccctgtag

SEQ ID NO: 87894 - DNA, 2061 bp, Artificial Sequence
  Description of Artificial Sequence: Synthetic coding sequence
atgctgctgagaggcgtgctgctggccctgcaggccctgcagctggccggcgccctggacctgcccgccggcagctgcgccttcgaggagagcacctgcggcttcgacagcgtgctggccagcctgccctggatcctgaacgaggagggccactacatctacgtggacaccagcttcggcaagcagggcgagaaggccgtgctgctgagccccgacctgcaggccgaggagtggagctgcctgagactggtgtaccagatcaccaccagcagcgagagcctgagcgaccccagccagctgaacctgtacatgagattcgaggacgagagcttcgacagactgctgtggagcgccaaggagcccagcgacagctggctgatcgccagcctggacctgcagaacagcagcaagaagttcaagatcctgatcgagggcgtgctgggccagggcaacaccgccagcatcgccctgttcgagatcaagatgaccaccggctactgcatcgagtgcgacttcgaggagaaccacctgtgcggcttcgtgaacagatggaaccccaacgtgaactggttcgtgggcggcggcagcatcagaaacgtgcacagcatcctgccccaggaccacaccttcaagagcgagctgggccactacatgtacgtggacagcgtgtacgtgaagcacttccaggaggtggcccagctgatcagccccctgaccaccgcccccatggccggctgcctgagcttctactaccagatccagcagggcaacgacaacgtgttcagcctgtacaccagagacgtggccggcctgtacgaggagatctggaaggccgacagacccggcaacgccgcctggaacctggccgaggtggagttcagcgccccctaccccatggaggtgatcttcgaggtggccttcaacggccccaagggcggctacgtggccctggacgacatcagcttcagccccgtgcactgccagaaccagaccgagctgctgttcagcgccgtggaggccagctgcaacttcgagcaggacctgtgcaacttctaccaggacaaggagggccccggctggaccagagtgaaggtgaagcccaacatgtacagagccggcgaccacaccaccggcctgggctactacctgctggccaacaccaagttcaccagccagcccggctacatcggcagactgtacggccccagcctgcccggcaacctgcagtactgcctgagattccactacgccatctacggcttcctgaagatgagcgacaccctggccgtgtacatcttcgaggagaaccacgtggtgcaggagaagatctggagcgtgctggagagccccagaggcgtgtggatgcaggccgagatcaccttcaagaagcccatgcccaccaaggtggtgttcatgagcctgtgcaagagcttctgggactgcggcctggtggccctggacgacatcaccatccagctgggcagctgcagcagcagcgagaagctgccccccccccccggcgagtgcaccttcgagcaggacgagtgcaccttcacccaggagaagagaaacagaagcagctggcacagaagaagaggcgagacccccaccagctacaccggccccaagggcgaccacaccaccggcgtgggctactacatgtacatcgaggccagccacatggtgtacggccagaaggccagactgctgagcagacccctgagaggcgtgagcggcaagcactgcctgaccttcttctaccacatgtacggcggcggcaccggcctgctgagcgtgtacctgaagaaggaggaggacagcgaggagagcctgctgtggagaagaagaggcgagcagagcatcagctggctgagagccctgatcgagtacagctgcgagagacagcaccagatcatcttcgaggccatcagaggcgtgagcatcagaagcgacatcgccatcgacgacgtgaagttccaggccggcccctgcggcgagatggaggacaccacccagcagagcagcggctacagcgaggacctgaacgagatcgagtactag

SEQ ID NO: 87895 - DNA, 2880 bp, Artificial Sequence
  Description of Artificial Sequence: Synthetic coding sequence
atggaggtgacctgcctgctgctgctggccctgatccccttccactgcagaggccagggcgtgtacgcccccgcccaggcccagatcgtgcacgccggccaggcctgcgtggtgaaggaggacaacatcagcgagagagtgtacaccatcagagagggcgacaccctgatgctgcagtgcctggtgaccggccaccccagaccccaggtgagatggaccaagaccgccggcagcgccagcgacaagttccaggagaccagcgtgttcaacgagaccctgagaatcgagagaatcgccagaacccagggcggcagatactactgcaaggccgagaacggcgtgggcgtgcccgccatcaagagcatcagagtggacgtgcagtacctggacgagcccatgctgaccgtgcaccagaccgtgagcgacgtgagaggcaacttctaccaggagaagaccgtgttcctgagatgcaccgtgaacagcaacccccccgccagattcatctggaagagaggcagcgacaccctgagccacagccaggacaacggcgtggacatctacgagcccctgtacacccagggcgagaccaaggtgctgaagctgaagaacctgagaccccaggactacgccagctacacctgccaggtgagcgtgagaaacgtgtgcggcatccccgacaaggccatcaccttcagactgaccaacaccaccgccccccccgccctgaagctgagcgtgaacgagaccctggtggtgaaccccggcgagaacgtgaccgtgcagtgcctgctgaccggcggcgaccccctgccccagctgcagtggagccacggccccggccccctgcccctgggcgccctggcccagggcggcaccctgagcatccccagcgtgcaggccagagacagcggctactacaactgcaccgccaccaacaacgtgggcaaccccgccaagaagaccgtgaacctgctggtgagaagcatgaagaacgccaccttccagatcacccccgacgtgatcaaggagagcgagaacatccagctgggccaggacctgaagctgagctgccacgtggacgccgtgccccaggagaaggtgacctaccagtggttcaagaacggcaagcccgccagaatgagcaagagactgctggtgaccagaaacgaccccgagctgcccgccgtgaccagcagcctggagctgatcgacctgcacttcagcgactacggcacctacctgtgcatggccagcttccccggcgcccccgtgcccgacctgagcgtggaggtgaacatcagcagcgagaccgtgccccccaccatcagcgtgcccaagggcagagccgtggtgaccgtgagagagggcagccccgccgagctgcagtgcgaggtgagaggcaagcccagaccccccgtgctgtggagcagagtggacaaggaggccgccctgctgcccagcggcctgcccctggaggagacccccgacggcaagctgagactggagagagtgagcagagacatgagcggcacctacagatgccagaccgccagatacaacggcttcaacgtgagacccagagaggcccaggtgcagctgaacgtgcagagcccctgcttcccccccgaggtggagcccagcagccaggacgtgagacaggccctgggcagacccgtgctgctgagatgcagcctgctgagaggcagcccccagagaatcgccagcgccgtgtggagattcaagggccagctgctgccccccccccccgtggtgcccgccgccgccgaggcccccgaccacgccgagctgagactggacgccgtgaccagagacagcagcggcagctacgagtgcagcgtgagcaacgacgtgggcagcgccgcctgcctgttccaggtgagcgccaaggcctacagccccgagttctacttcgacacccccaaccccaccagaagccacaagctgagcaagaactacagctacgtgctgcagtggacccagagagagcccgacgccgtggaccccgtgctgaactacagactgagcatcagacagctgaaccagcacaacgccgtggtgaaggccatccccgtgagaagagtggagaagggccagctgctggagtacatcctgaccgacctgagagtgccccacagctacgaggtgagactgaccccctacaccaccttcggcgccggcgacatggccagcagaatcatccactacaccgagctgctggccctgagaaccctgagcagcgacaacacctgccacttcgaggacgagaagatctgcggctacacccaggacctgaccgacaacttcgactggaccagacagaacgccctgacccagaaccccaagagaagccccaacaccggcccccccaccgacatcagcggcacccccgagggctactacatgttcatcgagaccagcagacccagagagctgggcgacagagccagactggtgagccccctgtacaacgccagcgccaagttctactgcgtgagcttcttctaccacatgtacggcaagcacatcggcagcctgaacctgctggtgagaagcagaaacaagggcgccctggacacccacgcctggagcctgagcggcaacaagggcaacgtgtggcagcaggcccacgtgcccatcagccccagcggccccttccagatcatcttcgagggcgtgagaggccccggctacctgggcgacatcgccatcgacgacgtgaccctgaagaagggcgagtgccccagaaagcagaccgaccccaacaaggtggtggtgatgcccggcagcggcgccccctgccagagcagcccccagctgtggggccccatggccatcttcctgctggccctgcagagatag

SEQ ID NO: 87896 - DNA, 2868 bp, Artificial Sequence
  Description of Artificial Sequence: Synthetic coding sequence
atggaggtgacctgcctgctgctgctggccctgatccccttccactgcagaggccagggcgtgtacgcccccgcccaggcccagatcgtgcacgccggccaggcctgcgtggtgaaggaggacaacatcagcgagagagtgtacaccatcagagagggcgacaccctgatgctgcagtgcctggtgaccggccaccccagaccccaggtgagatggaccaagaccgccggcagcgccagcgacaagttccaggagaccagcgtgttcaacgagaccctgagaatcgagagaatcgccagaacccagggcggcagatactactgcaaggccgagaacggcgtgggcgtgcccgccatcaagagcatcagagtggacgtgcagtacctggacgagcccatgctgaccgtgcaccagaccgtgagcgacgtgagaggcaacttctaccaggagaagaccgtgttcctgagatgcaccgtgaacagcaacccccccgccagattcatctggaagagaggcagcgacaccctgagccacagccaggacaacggcgtggacatctacgagcccctgtacacccagggcgagaccaaggtgctgaagctgaagaacctgagaccccaggactacgccagctacacctgccaggtgagcgtgagaaacgtgtgcggcatccccgacaaggccatcaccttcagactgaccaacaccaccgccccccccgccctgaagctgagcgtgaacgagaccctggtggtgaaccccggcgagaacgtgaccgtgcagtgcctgctgaccggcggcgaccccctgccccagctgcagtggagccacggccccggccccctgcccctgggcgccctggcccagggcggcaccctgagcatccccagcgtgcaggccagagacagcggctactacaactgcaccgccaccaacaacgtgggcaaccccgccaagaagaccgtgaacctgctggtgagaagcatgaagaacgccaccttccagatcacccccgacgtgatcaaggagagcgagaacatccagctgggccaggacctgaagctgagctgccacgtggacgccgtgccccaggagaaggtgacctaccagtggttcaagaacggcaagcccgccagaatgagcaagagactgctggtgaccagaaacgaccccgagctgcccgccgtgaccagcagcctggagctgatcgacctgcacttcagcgactacggcacctacctgtgcatggccagcttccccggcgcccccgtgcccgacctgagcgtggaggtgaacatcagcagcgagaccgtgccccccaccatcagcgtgcccaagggcagagccgtggtgaccgtgagagagggcagccccgccgagctgcagtgcgaggtgagaggcaagcccagaccccccgtgctgtggagcagagtggacaaggaggccgccctgctgcccagcggcctgcccctggaggagacccccgacggcaagctgagactggagagagtgagcagagacatgagcggcacctacagatgccagaccgccagatacaacggcttcaacgtgagacccagagaggcccaggtgcagctgaacgtgcagttcccccccgaggtggagcccagcagccaggacgtgagacaggccctgggcagacccgtgctgctgagatgcagcctgctgagaggcagcccccagagaatcgccagcgccgtgtggagattcaagggccagctgctgccccccccccccgtggtgcccgccgccgccgaggcccccgaccacgccgagctgagactggacgccgtgaccagagacagcagcggcagctacgagtgcagcgtgagcaacgacgtgggcagcgccgcctgcctgttccaggtgagcgccaaggcctacagccccgagttctacttcgacacccccaaccccaccagaagccacaagctgagcaagaactacagctacgtgctgcagtggacccagagagagcccgacgccgtggaccccgtgctgaactacagactgagcatcagacagctgaaccagcacaacgccgtggtgaaggccatccccgtgagaagagtggagaagggccagctgctggagtacatcctgaccgacctgagagtgccccacagctacgaggtgagactgaccccctacaccaccttcggcgccggcgacatggccagcagaatcatccactacaccgagcccatcaacagccccaacctgagcgacaacacctgccacttcgaggacgagaagatctgcggctacacccaggacctgaccgacaacttcgactggaccagacagaacgccctgacccagaaccccaagagaagccccaacaccggcccccccaccgacatcagcggcacccccgagggctactacatgttcatcgagaccagcagacccagagagctgggcgacagagccagactggtgagccccctgtacaacgccagcgccaagttctactgcgtgagcttcttctaccacatgtacggcaagcacatcggcagcctgaacctgctggtgagaagcagaaacaagggcgccctggacacccacgcctggagcctgagcggcaacaagggcaacgtgtggcagcaggcccacgtgcccatcagccccagcggccccttccagatcatcttcgagggcgtgagaggccccggctacctgggcgacatcgccatcgacgacgtgaccctgaagaagggcgagtgccccagaaagcagaccgaccccaacaaggtggtggtgatgcccggcagcggcgccccctgccagagcagcccccagctgtggggccccatggccatcttcctgctggccctgcagagatag

SEQ ID NO: 87897 - DNA, 2922 bp, Artificial Sequence
  Description of Artificial Sequence: Synthetic coding sequence
atggaggtgacctgcctgctgctgctggccctgatccccttccactgcagaggccagggcgtgtacgcccccgcccaggcccagatcgtgcacgccggccaggcctgcgtggtgaaggaggacaacatcagcgagagagtgtacaccatcagagagggcgacaccctgatgctgcagtgcctggtgaccggccaccccagaccccaggtgagatggaccaagaccgccggcagcgccagcgacaagttccaggagaccagcgtgttcaacgagaccctgagaatcgagagaatcgccagaacccagggcggcagatactactgcaaggccgagaacggcgtgggcgtgcccgccatcaagagcatcagagtggacgtgcagtacctggacgagcccatgctgaccgtgcaccagaccgtgagcgacgtgagaggcaacttctaccaggagaagaccgtgttcctgagatgcaccgtgaacagcaacccccccgccagattcatctggaagagaggcagcgacaccctgagccacagccaggacaacggcgtggacatctacgagcccctgtacacccagggcgagaccaaggtgctgaagctgaagaacctgagaccccaggactacgccagctacacctgccaggtgagcgtgagaaacgtgtgcggcatccccgacaaggccatcaccttcagactgaccaacaccaccgccccccccgccctgaagctgagcgtgaacgagaccctggtggtgaaccccggcgagaacgtgaccgtgcagtgcctgctgaccggcggcgaccccctgccccagctgcagtggagccacggccccggccccctgcccctgggcgccctggcccagggcggcaccctgagcatccccagcgtgcaggccagagacagcggctactacaactgcaccgccaccaacaacgtgggcaaccccgccaagaagaccgtgaacctgctggtgagaagcatgaagaacgccaccttccagatcacccccgacgtgatcaaggagagcgagaacatccagctgggccaggacctgaagctgagctgccacgtggacgccgtgccccaggagaaggtgacctaccagtggttcaagaacggcaagcccgccagaatgagcaagagactgctggtgaccagaaacgaccccgagctgcccgccgtgaccagcagcctggagctgatcgacctgcacttcagcgactacggcacctacctgtgcatggccagcttccccggcgcccccgtgcccgacctgagcgtggaggtgaacatcagcagcgagaccgtgccccccaccatcagcgtgcccaagggcagagccgtggtgaccgtgagagagggcagccccgccgagctgcagtgcgaggtgagaggcaagcccagaccccccgtgctgtggagcagagtggacaaggaggccgccctgctgcccagcggcctgcccctggaggagacccccgacggcaagctgagactggagagagtgagcagagacatgagcggcacctacagatgccagaccgccagatacaacggcttcaacgtgagacccagagaggcccaggtgcagctgaacgtgcagttcccccccgaggtggagcccagcagccaggacgtgagacaggccctgggcagacccgtgctgctgagatgcagcctgctgagaggcagcccccagagaatcgccagcgccgtgtggagattcaagggccagctgctgccccccccccccgtggtgcccgccgccgccgaggcccccgaccacgccgagctgagactggacgccgtgaccagagacagcagcggcagctacgagtgcagcgtgagcaacgacgtgggcagcgccgcctgcctgttccaggtgagcgccaaggcctacagccccgagttctacttcgacacccccaaccccaccagaagccacaagctgagcaagaactacagctacgtgctgcagtggacccagagagagcccgacgccgtggaccccgtgctgaactacagactgagcatcagacagctgaaccagcacaacgccgtggtgaaggccatccccgtgagaagagtggagaagggccagctgctggagtacatcctgaccgacctgagagtgccccacagctacgaggtgagactgaccccctacaccaccttcggcgccggcgacatggccagcagaatcatccactacaccgagcccatcaacagccccaacctgagcgacaacacctgccacttcgaggacgagaagatctgcggctacacccaggacctgaccgacaacttcgactggaccagacagaacgccctgacccagaaccccaagagaagccccaacaccggcccccccaccgacatcagcggcacccccgagggctactacatgttcatcgagaccagcagacccagagagctgggcgacagagccagactggtgagccccctgtacaacgccagcgccaagttctactgcgtgagcttcttctaccacatgtacggcaagcacatcggcagcctgaacctgctggtgagaagcagaaacaagggcgccctggacacccacgcctggagcctgagcggcaacaagggcaacgtgtggcagcaggcccacgtgcccatcagccccagcggccccttccagatcatcttcgagggcgtgagaggccccggctacctgggcgacatcgccatcgacgacgtgaccctgaagaagggcgagtgccccagaaagcagaccgaccccaacaagggcgccagaagagagggcggcggcggcgccgagagcggcggcagctgcgcctggagaggcttcctgagcgtggagggcggctgcctgggcctgaacagaggcagcgagtgcctgagcgacggcaaccacgtggccctgaccgtgtag

SEQ ID NO: 87898 - DNA, 2184 bp, Artificial Sequence
  Description of Artificial Sequence: Synthetic coding sequence
atggtgagcttcagactgagcaacaagaccgccagccccagcatcaagctgctggtggacgaccccatcgtggtgaaccccggcgaggccatcaccctggtgtgcgtgaccaccggcggcgagcccgcccccagcctgacctgggtgagaagcttcggcaccctgcccgagaagaccgtgctgaacggcggcaccctgaccatccccgccatcaccagcgacgacgccggcacctacagctgcatcgccaacaacaacgtgggcaaccccgccaagaagagcaccaacatcatcgtgagagccctgaagaagggcagattctggatcacccccgacccctaccacaaggacgacaacatccagatcggcagagaggtgaagatcagctgccaggtggaggccgtgcccagcgaggagctgaccttcagctggttcaagaacggcagacccctgagaagcagcgagagaatggtgatcacccagaccgaccccgacgtgagccccggcaccaccaacctggacatcatcgacctgaagttcaccgacttcggcacctacacctgcgtggccagcctgaagggcggcggcatcagcgacatcagcatcgacgtgaacatcagcagcagcaccgtgccccccaacctgaccgtgccccaggagaagagccccctggtgaccagagagggcgacaccatcgagctgcagtgccaggtgaccggcaagcccaagcccatcatcctgtggagcagagccgacaaggaggtggccatgcccgacggcagcatgcagatggagagctacgacggcaccctgagaatcgtgaacgtgagcagagagatgagcggcatgtacagatgccagaccagccagtacaacggcttcaacgtgaagcccagagaggccctggtgcagctgatcgtgcagtacccccccgccgtggagcccgccttcctggagatcagacagggccaggacagaagcgtgaccatgagctgcagagtgctgagagcctaccccatcagagtgctgacctacgagtggagactgggcaacaagctgctgagaaccggccagttcgacagccaggagtacaccgagtacgccgtgaagagcctgagcaacgagaactacggcgtgtacaactgcagcatcatcaacgaggccggcgccggcagatgcagcttcctggtgaccggcaaggcctacgcccccgagttctactacgacacctacaaccccgtgtggcagaacagacacagagtgtacagctacagcctgcagtggacccagatgaaccccgacgccgtggacagaatcgtggcctacagactgggcatcagacaggccggccagcagagatggtgggagcaggagatcaagatcaacggcaacatccagaagggcgagctgatcacctacaacctgaccgagctgatcaagcccgaggcctacgaggtgagactgacccccctgaccaagttcggcgagggcgacagcaccatcagagtgatcaagtacagcgcccccgtgaacccccacctgagagagttccactgcggcttcgaggacggcaacatctgcctgttcacccaggacgacaccgacaacttcgactggaccaagcagagcaccgccaccagaaacaccaagtacacccccaacaccggccccaacgccgacagaagcggcagcaaggagggcttctacatgtacatcgagaccagcagacccagactggagggcgagaaggccagactgctgagccccgtgttcagcatcgcccccaagaacccctacggccccaccaacaccgcctactgcttcagcttcttctaccacatgtacggccagcacatcggcgtgctgaacgtgtacctgagactgaagggccagaccaccatcgagaaccccctgtggagcagcagcggcaacaagggccagagatggaacgaggcccacgtgaacatctaccccatcaccagcttccagctgatcttcgagggcatcagaggccccggcatcgagggcgacatcgccatcgacgacgtgagcatcgccgagggcgagtgcgccaagcaggacctggccaccaagaacagcgtggacggcgccgtgggcatcctggtgcacatctggctgttccccatcatcgtgctgatcagcatcctgagccccagaagatag

SEQ ID NO: 87899 - DNA, 477 bp, Artificial Sequence
  Description of Artificial Sequence: Synthetic coding sequence
atgtacatcgagaccagcagacccagactggagggcgagaaggccagactgctgagccccgtgttcagcatcgcccccaagaacccctacggccccaccaacaccgcctactgcttcagcttcttctaccacatgtacggccagcacatcggcgtgctgaacgtgtacctgagactgaagggccagaccaccatcgagaaccccctgtggagcagcagcggcaacaagggccagagatggaacgaggcccacgtgaacatctaccccatcaccagcttccagctgatcttcgagggcatcagaggccccggcatcgagggcgacatcgccatcgacgacgtgagcatcgccgagggcgagtgcgccaagcaggacctggccaccaagaacagcgtggacggcgccgtgggcatcctggtgcacatctggctgttccccatcatcgtgctgatcagcatcctgagccccagaagatag

SEQ ID NO: 87900 - DNA, 3078 bp, Artificial Sequence
  Description of Artificial Sequence: Synthetic coding sequence
atgagcgtgtggagcgccggcctgctgagaagcgccagaagaagaagaagaggcagaaccgacggcagaagattcctgctgagaagagccgtgcccggccacctgggcctggccagagccagagtggagagagcctggctggccgccggcctgctgaaggtgcccctgagaaccccctgggccggctacgtgcacgtgcacgtgaagatggacctgctgtacggcctggtgtggctgctgaccgtgctgctggagggcatcagcggccagggcgtgtacgccccccccaccgtgagaatcgtgcacagcggcctggcctgcaacatcgaggaggagagatacagcgagagagtgtacaccatcagagagggcgagaccctggagctgacctgcctggtgaccggccaccccagaccccagatcagatggaccaagaccgccggcagcgccagcgacagattccaggacagcagcgtgttcaacgagaccctgagaatcaccaacatccagagacaccagggcggcagatactactgcaaggccgagaacggcctgggcagccccgccatcaagagcatcagagtggacgtgtactacctggacgaccccgtggtgaccgtgcaccagagcatcggcgaggccaaggagcagttctactacgagagaaccgtgttcctgagatgcgtggccaacagcaacccccccgtgagatacagctggagaagaggccaggaggtgctgctgcagggcagcgacaagggcgtggagatctacgagcccttcttcacccagggcgagaccaagatcctgaagctgaagaacctgagaccccaggactacgccaactacagctgcatcgccagcgtgagaaacgtgtgcaacatccccgacaagatggtgagcttcagactgagcaacaagaccgccagccccagcatcaagctgctggtggacgaccccatcgtggtgaaccccggcgaggccatcaccctggtgtgcgtgaccaccggcggcgagcccgcccccagcctgacctgggtgagaagcttcggcaccctgcccgagaagaccgtgctgaacggcggcaccctgaccatccccgccatcaccagcgacgacgccggcacctacagctgcatcgccaacaacaacgtgggcaaccccgccaagaagagcaccaacatcatcgtgagagccctgaagaagggcagattctggatcacccccgacccctaccacaaggacgacaacatccagatcggcagagaggtgaagatcagctgccaggtggaggccgtgcccagcgaggagctgaccttcagctggttcaagaacggcagacccctgagaagcagcgagagaatggtgatcacccagaccgaccccgacgtgagccccggcaccaccaacctggacatcatcgacctgaagttcaccgacttcggcacctacacctgcgtggccagcctgaagggcggcggcatcagcgacatcagcatcgacgtgaacatcagcagcagcaccgtgccccccaacctgaccgtgccccaggagaagagccccctggtgaccagagagggcgacaccatcgagctgcagtgccaggtgaccggcaagcccaagcccatcatcctgtggagcagagccgacaaggaggtggccatgcccgacggcagcatgcagatggagagctacgacggcaccctgagaatcgtgaacgtgagcagagagatgagcggcatgtacagatgccagaccagccagtacaacggcttcaacgtgaagcccagagaggccctggtgcagctgatcgtgcagtacccccccgccgtggagcccgccttcctggagatcagacagggccaggacagaagcgtgaccatgagctgcagagtgctgagagcctaccccatcagagtgctgacctacgagtggagactgggcaacaagctgctgagaaccggccagttcgacagccaggagtacaccgagtacgccgtgaagagcctgagcaacgagaactacggcgtgtacaactgcagcatcatcaacgaggccggcgccggcagatgcagcttcctggtgaccggcaaggcctacgcccccgagttctactacgacacctacaaccccgtgtggcagaacagacacagagtgtacagctacagcctgcagtggacccagatgaaccccgacgccgtggacagaatcgtggcctacagactgggcatcagacaggccggccagcagagatggtgggagcaggagatcaagatcaacggcaacatccagaagggcgagctgatcacctacaacctgaccgagctgatcaagcccgaggcctacgaggtgagactgacccccctgaccaagttcggcgagggcgacagcaccatcagagtgatcaagtacagcgcccccgtgaacccccacctgagagagttccactgcggcttcgaggacggcaacatctgcctgttcacccaggacgacaccgacaacttcgactggaccaagcagagcaccgccaccagaaacaccaagtacacccccaacaccggccccaacgccgacagaagcggcagcaaggagggcttctacatgtacatcgagaccagcagacccagactggagggcgagaaggccagactgctgagccccgtgttcagcatcgcccccaagaacccctacggccccaccaacaccgcctactgcttcagcttcttctaccacatgtacggccagcacatcggcgtgctgaacgtgtacctgagactgaagggccagaccaccatcgagaaccccctgtggagcagcagcggcaacaagggccagagatggaacgaggcccacgtgaacatctaccccatcaccagcttccagctgatcttcgagggcatcagaggccccggcatcgagggcgacatcgccatcgacgacgtgagcatcgccgagggcgagtgcgccaagcaggacctggccaccaagaacagcgtggacggcgccgtgggcatcctggtgcacatctggctgttccccatcatcgtgctgatcagcatcctgagccccagaagatag

SEQ ID NO: 87901 - DNA, 2184 bp, Artificial Sequence; identical to SEQ ID NO: 87898
  Description of Artificial Sequence: Synthetic coding sequence

SEQ ID NO: 87902 - DNA, 2871 bp, Artificial Sequence
  Description of Artificial Sequence: Synthetic coding sequence
atggacctgctgtacggcctggtgtggctgctgaccgtgctgctggagggcatcagcggccagggcgtgtacgccccccccaccgtgagaatcgtgcacagcggcctggcctgcaacatcgaggaggagagatacagcgagagagtgtacaccatcagagagggcgagaccctggagctgacctgcctggtgaccggccaccccagaccccagatcagatggaccaagaccgccggcagcgccagcgacagattccaggacagcagcgtgttcaacgagaccctgagaatcaccaacatccagagacaccagggcggcagatactactgcaaggccgagaacggcctgggcagccccgccatcaagagcatcagagtggacgtgtactacctggacgaccccgtggtgaccgtgcaccagagcatcggcgaggccaaggagcagttctactacgagagaaccgtgttcctgagatgcgtggccaacagcaacccccccgtgagatacagctggagaagaggccaggaggtgctgctgcagggcagcgacaagggcgtggagatctacgagcccttcttcacccagggcgagaccaagatcctgaagctgaagaacctgagaccccaggactacgccaactacagctgcatcgccagcgtgagaaacgtgtgcaacatccccgacaagatggtgagcttcagactgagcaacaagaccgccagccccagcatcaagctgctggtggacgaccccatcgtggtgaaccccggcgaggccatcaccctggtgtgcgtgaccaccggcggcgagcccgcccccagcctgacctgggtgagaagcttcggcaccctgcccgagaagaccgtgctgaacggcggcaccctgaccatccccgccatcaccagcgacgacgccggcacctacagctgcatcgccaacaacaacgtgggcaaccccgccaagaagagcaccaacatcatcgtgagagccctgaagaagggcagattctggatcacccccgacccctaccacaaggacgacaacatccagatcggcagagaggtgaagatcagctgccaggtggaggccgtgcccagcgaggagctgaccttcagctggttcaagaacggcagacccctgagaagcagcgagagaatggtgatcacccagaccgaccccgacgtgagccccggcaccaccaacctggacatcatcgacctgaagttcaccgacttcggcacctacacctgcgtggccagcctgaagggcggcggcatcagcgacatcagcatcgacgtgaacatcagcagcagcaccgtgccccccaacctgaccgtgccccaggagaagagccccctggtgaccagagagggcgacaccatcgagctgcagtgccaggtgaccggcaagcccaagcccatcatcctgtggagcagagccgacaaggaggtggccatgcccgacggcagcatgcagatggagagctacgacggcaccctgagaatcgtgaacgtgagcagagagatgagcggcatgtacagatgccagaccagccagtacaacggcttcaacgtgaagcccagagaggccctggtgcagctgatcgtgcagtacccccccgccgtggagcccgccttcctggagatcagacagggccaggacagaagcgtgaccatgagctgcagagtgctgagagcctaccccatcagagtgctgacctacgagtggagactgggcaacaagctgctgagaaccggccagttcgacagccaggagtacaccgagtacgccgtgaagagcctgagcaacgagaactacggcgtgtacaactgcagcatcatcaacgaggccggcgccggcagatgcagcttcctggtgaccggcaaggcctacgcccccgagttctactacgacacctacaaccccgtgtggcagaacagacacagagtgtacagctacagcctgcagtggacccagatgaaccccgacgccgtggacagaatcgtggcctacagactgggcatcagacaggccggccagcagagatggtgggagcaggagatcaagatcaacggcaacatccagaagggcgagctgatcacctacaacctgaccgagctgatcaagcccgaggcctacgaggtgagactgacccccctgaccaagttcggcgagggcgacagcaccatcagagtgatcaagtacagcgcccccgtgaacccccacctgagagagttccactgcggcttcgaggacggcaacatctgcctgttcacccaggacgacaccgacaacttcgactggaccaagcagagcaccgccaccagaaacaccaagtacacccccaacaccggccccaacgccgacagaagcggcagcaaggagggcttctacatgtacatcgagaccagcagacccagactggagggcgagaaggccagactgctgagccccgtgttcagcatcgcccccaagaacccctacggccccaccaacaccgcctactgcttcagcttcttctaccacatgtacggccagcacatcggcgtgctgaacgtgtacctgagactgaagggccagaccaccatcgagaaccccctgtggagcagcagcggcaacaagggccagagatggaacgaggcccacgtgaacatctaccccatcaccagcttccagctgatcttcgagggcatcagaggccccggcatcgagggcgacatcgccatcgacgacgtgagcatcgccgagggcgagtgcgccaagcaggacctggccaccaagaacagcgtggacggcgccgtgggcatcctggtgcacatctggctgttccccatcatcgtgctgatcagcatcctgagccccagaagatag

SEQ ID NO: 87903 - DNA, 1143 bp, Artificial Sequence
  Description of Artificial Sequence: Synthetic coding sequence
atgagatggctgctgctgtactacgccctgtgcttcagcctgagcaaggccagcgcccacaccgtggagctgaacaacatgttcggccagatccagagccccggctaccccgacagctaccccagcgacagcgaggtgacctggaacatcaccgtgcccgacggcttcagaatcaagctgtacttcatgcacttcaacctggagagcagctacctgtgcgagtacgactacgtgaaggtggagaccgaggaccaggtgctggccaccttctgcggcagagagaccaccgacaccgagcagacccccggccaggaggtggtgctgagccccggcagcttcatgagcatcaccttcagaagcgacttcagcaacgaggagagattcaccggcttcgacgcccactacatggccgtggacgtggacgagtgcaaggagagagaggacgaggagctgagctgcgaccactactgccacaactacatcggcggctactactgcagctgcagattcggctacatcctgcacaccgacaacagaacctgcagagtggagtgcagcgacaacctgttcacccagagaaccggcgtgatcaccagccccgacttccccaacccctaccccaagagcagcgagtgcctgtacaccatcgagctggaggagggcttcatggtgaacctgcagttcgaggacatcttcgacatcgaggaccaccccgaggtgccctgcccctacgactacatcaagatcaaggtgggccccaaggtgctgggccccttctgcggcgagaaggcccccgagcccatcagcacccagagccacagcgtgctgatcctgttccacagcgacaacagcggcgagaacagaggctggagactgagctacagagccgccggcaacgagtgccccgagctgcagccccccgtgcacggcaagatcgagcccagccaggccaagtacttcttcaaggaccaggtgctggtgagctgcgacaccggctacaaggtgctgaaggacaacgtggagatggacaccttccagatcgagtgcctgaaggacggcacctggagcaacaagatccccacctgcaagaagaacgagatcgacctggagagcgagctgaagagcgagcaggtgaccgagtag

SEQ ID NO: 87904 - DNA, 2187 bp, Artificial Sequence
  Description of Artificial Sequence: Synthetic coding sequence
atgagatggctgctgctgtactacgccctgtgcttcagcctgagcaaggccagcgcccacaccgtggagctgaacaacatgttcggccagatccagagccccggctaccccgacagctaccccagcgacagcgaggtgacctggaacatcaccgtgcccgacggcttcagaatcaagctgtacttcatgcacttcaacctggagagcagctacctgtgcgagtacgactacgtgaaggtggagaccgaggaccaggtgctggccaccttctgcggcagagagaccaccgacaccgagcagacccccggccaggaggtggtgctgagccccggcagcttcatgagcatcaccttcagaagcgacttcagcaacgaggagagattcaccggcttcgacgcccactacatggccgtggacgtggacgagtgcaaggagagagaggacgaggagctgagctgcgaccactactgccacaactacatcggcggctactactgcagctgcagattcggctacatcctgcacaccgacaacagaacctgcagagtggagtgcagcgacaacctgttcacccagagaaccggcgtgatcaccagccccgacttccccaacccctaccccaagagcagcgagtgcctgtacaccatcgagctggaggagggcttcatggtgaacctgcagttcgaggacatcttcgacatcgaggaccaccccgaggtgccctgcccctacgactacatcaagatcaaggtgggccccaaggtgctgggccccttctgcggcgagaaggcccccgagcccatcagcacccagagccacagcgtgctgatcctgttccacagcgacaacagcggcgagaacagaggctggagactgagctacagagccgccggcaacgagtgccccgagctgcagccccccgtgcacggcaagatcgagcccagccaggccaagtacttcttcaaggaccaggtgctggtgagctgcgacaccggctacaaggtgctgaaggacaacgtggagatggacaccttccagatcgagtgcctgaaggacggcacctggagcaacaagatccccacctgcaagatcgtggactgcagagcccccggcgagctggagcacggcctgatcaccttcagcaccagaaacaacctgaccacctacaagagcgagatcaagtacagctgccaggagccctactacaagatgctgaacaacaacaccggcatctacacctgcagcgcccagggcgtgtggatgaacaaggtgctgggcagaagcctgcccacctgcctgcccgagtgcggccagcccagcagaagcctgcccagcctggtgaagagaatcatcggcggcagaaacgccgagcccggcctgttcccctggcaggccctgatcgtggtggaggacaccagcagagtgcccaacgacaagtggttcggcagcggcgccctgctgagcgccagctggatcctgaccgccgcccacgtgctgagaagccagagaagagacaccaccgtgatccccgtgagcaaggagcacgtgaccgtgtacctgggcctgcacgacgtgagagacaagagcggcgccgtgaacagcagcgccgccagagtggtgctgcaccccgacttcaacatccagaactacaaccacgacatcgccctggtgcagctgcaggagcccgtgcccctgggcccccacgtgatgcccgtgtgcctgcccagactggagcccgagggccccgccccccacatgctgggcctggtggccggctggggcatcagcaaccccaacgtgaccgtggacgagatcatcagcagcggcaccagaaccctgagcgacgtgctgcagtacgtgaagctgcccgtggtgccccacgccgagtgcaagaccagctacgagagcagaagcggcaactacagcgtgaccgagaacatgttctgcgccggctactacgagggcggcaaggacacctgcctgggcgacagcggcggcgccttcgtgatcttcgacgacctgagccagagatgggtggtgcagggcctggtgagctggggcggccccgaggagtgcggcagcaagcaggtgtacggcgtgtacaccaaggtgagcaactacgtggactgggtgtgggagcagatgggcctgccccagagcgtggtggagccccaggtggagagatag

SEQ ID NO: 87905 - DNA, 2100 bp, Artificial Sequence
  Description of Artificial Sequence: Synthetic coding sequence
atgagatggctgctgctgtactacgccctgtgcttcagcctgagcaaggccagcgcccacaccgtggagctgaacaacatgttcggccagatccagagccccggctaccccgacagctaccccagcgacagcgaggtgacctggaacatcaccgtgcccgacggcttcagaatcaagctgtacttcatgcacttcaacctggagagcagctacctgtgcgagtacgactacgtgaaggtggagaccgaggaccaggtgctggccaccttctgcggcagagagaccaccgacaccgagcagacccccggccaggaggtggtgctgagccccggcagcttcatgagcatcaccttcagaagcgacttcagcaacgaggagagattcaccggcttcgacgcccactacatggccgtggacgtggacgagtgcaaggagagagaggacgaggagctgagctgcgaccactactgccacaactacatcggcggctactactgcagctgcagattcggctacatcctgcacaccgacaacagaacctgcagagtggagtgcagcgacaacctgttcacccagagaaccggcgtgatcaccagccccgacttccccaacccctaccccaagagcagcgagtgcctgtacaccatcgagctggaggagggcttcatggtgaacctgcagttcgaggacatcttcgacatcgaggaccaccccgaggtgccctgcccctacgactacatcaagatcaaggtgggccccaaggtgctgggccccttctgcggcgagaaggcccccgagcccatcagcacccagagccacagcgtgctgatcctgttccacagcgacaacagcggcgagaacagaggctggagactgagctacagagccgccggcaacgagtgccccgagctgcagccccccgtgcacggcaagatcgagcccagccaggccaagtacttcttcaaggaccaggtgctggtgagctgcgacaccggctacaaggtgctgaaggacaacgtggagatggacaccttccagatcgagtgcctgaaggacggcacctggagcaacaagatccccacctgcaagatcgtggactgcagagcccccggcgagctggagcacggcctgatcaccttcagcaccagaaacaacctgaccacctacaagagcgagatcaagtacagctgccaggagccctactacaagatgctgaacaacaacaccggcatctacacctgcagcgcccagggcgtgtggatgaacaaggtgctgggcagaagcctgcccacctgcctgcccgtgtgcggcctgcccaagttcagcagaaagctgatggccagaatcttcaacggcagacccgcccagaagggcaccaccccctggatcgccatgctgagccacctgaacggccagcccttctgcggcggcagcctgctgggcagcagctggatcgtgaccgccgcccactgcctgcaccagagcctggaccccgaggaccccaccctgagagacagcgacctgctgagccccagcgacttcaagatcatcctgggcaagcactggagactgagaagcgacgagaacgagcagcacctgggcgtgaagcacaccaccctgcacccccagtacgaccccaacaccttcgagaacgacgtggccctggtggagctgctggagagccccgtgctgaacgccttcgtgatgcccatctgcctgcccgagggcccccagcaggagggcgccatggtgatcgtgagcggctggggcaagcagttcctgcagagattccccgagaccctgatggagatcgagatccccatcgtggaccacagcacctgccagaaggcctacgcccccctgaagaagaaggtgaccagagacatgatctgcgccggcgagaaggagggcggcaaggacgcctgcgccggcgacagcggcggccccatggtgaccctgaacagagagagaggccagtggtacctggtgggcaccgtgagctggggcgacgactgcggcaagaaggacagatacggcgtgtacagctacatccaccacaacaaggactggatccagagagtgaccggcgtgagaaactag

SEQ ID NO: 87906 - DNA, 1848 bp, Artificial Sequence
  Description of Artificial Sequence: Synthetic coding sequence
atgagcatcaccttcagaagcgacttcagcaacgaggagagattcaccggcttcgacgcccactacatggccgtggacgtggacgagtgcaaggagagagaggacgaggagctgagctgcgaccactactgccacaactacatcggcggctactactgcagctgcagattcggctacatcctgcacaccgacaacagaacctgcagagtggagtgcagcgacaacctgttcacccagagaaccggcgtgatcaccagccccgacttccccaacccctaccccaagagcagcgagtgcctgtacaccatcgagctggaggagggcttcatggtgaacctgcagttcgaggacatcttcgacatcgaggaccaccccgaggtgccctgcccctacgactacatcaagatcaaggtgggccccaaggtgctgggccccttctgcggcgagaaggcccccgagcccatcagcacccagagccacagcgtgctgatcctgttccacagcgacaacagcggcgagaacagaggctggagactgagctacagagccgccggcaacgagtgccccgagctgcagccccccgtgcacggcaagatcgagcccagccaggccaagtacttcttcaaggaccaggtgctggtgagctgcgacaccggctacaaggtgctgaaggacaacgtggagatggacaccttccagatcgagtgcctgaaggacggcacctggagcaacaagatccccacctgcaagatcgtggactgcagagcccccggcgagctggagcacggcctgatcaccttcagcaccagaaacaacctgaccacctacaagagcgagatcaagtacagctgccaggagccctactacaagatgctgaacaacaacaccggcatctacacctgcagcgcccagggcgtgtggatgaacaaggtgctgggcagaagcctgcccacctgcctgcccgagtgcggccagcccagcagaagcctgcccagcctggtgaagagaatcatcggcggcagaaacgccgagcccggcctgttcccctggcaggccctgatcgtggtggaggacaccagcagagtgcccaacgacaagtggttcggcagcggcgccctgctgagcgccagctggatcctgaccgccgcccacgtgctgagaagccagagaagagacaccaccgtgatccccgtgagcaaggagcacgtgaccgtgtacctgggcctgcacgacgtgagagacaagagcggcgccgtgaacagcagcgccgccagagtggtgctgcaccccgacttcaacatccagaactacaaccacgacatcgccctggtgcagctgcaggagcccgtgcccctgggcccccacgtgatgcccgtgtgcctgcccagactggagcccgagggccccgccccccacatgctgggcctggtggccggctggggcatcagcaaccccaacgtgaccgtggacgagatcatcagcagcggcaccagaaccctgagcgacgtgctgcagtacgtgaagctgcccgtggtgccccacgccgagtgcaagaccagctacgagagcagaagcggcaactacagcgtgaccgagaacatgttctgcgccggctactacgagggcggcaaggacacctgcctgggcgacagcggcggcgccttcgtgatcttcgacgacctgagccagagatgggtggtgcagggcctggtgagctggggcggccccgaggagtgcggcagcaagcaggtgtacggcgtgtacaccaaggtgagcaactacgtggactgggtgtgggagcagatgggcctgccccagagcgtggtggagccccaggtggagagatag

SEQ ID NO: 87907 - DNA, 249 bp, Artificial Sequence
  Description of Artificial Sequence: Synthetic coding sequence
atgttctgcgccggctactacgagggcggcaaggacacctgcctgggcgacagcggcggcgccttcgtgatcttcgacgacctgagccagagatgggtggtgcagggcctggtgagctggggcggccccgaggagtgcggcagcaagcaggtgtacggcgtgtacaccaaggtgagcaactacgtggactgggtgtgggagcagatgggcctgccccagagcgtggtggagccccaggtggagagatag

SEQ ID NO: 87908 - DNA, 1443 bp, Artificial Sequence
  Description of Artificial Sequence: Synthetic coding sequence
atgagcatcaccttcagaagcgacttcagcaacgaggagagattcaccggcttcgacgcccactacatggccgtggacgtggacgagtgcaaggagagagaggacgaggagctgagctgcgaccactactgccacaactacatcggcggctactactgcagctgcagattcggctacatcctgcacaccgacaacagaacctgcagagtggagtgcagcgacaacctgttcacccagagaaccggcgtgatcaccagccccgacttccccaacccctaccccaagagcagcgagtgcctgtacaccatcgagctggaggagggcttcatggtgaacctgcagttcgaggacatcttcgacatcgaggaccaccccgaggtgccctgcccctacgactacatcaagatcaaggtgggccccaaggtgctgggccccttctgcggcgagaaggcccccgagcccatcagcacccagagccacagcgtgctgatcctgttccacagcgacaacagcggcgagaacagaggctggagactgagctacagagccgccggcaacgagtgccccgagctgcagccccccgtgcacggcaagatcgagcccagccaggccaagtacttcttcaaggaccaggtgctggtgagctgcgacaccggctacaaggtgctgaaggacaacgtggagatggacaccttccagatcgagtgcctgaaggacggcacctggagcaacaagatccccacctgcaagatcgtggactgcagagcccccggcgagctggagcacggcctgatcaccttcagcaccagaaacaacctgaccacctacaagagcgagatcaagtacagctgccaggagccctactacaagatgctgaacaacaacaccggcatctacacctgcagcgcccagggcgtgtggatgaacaaggtgctgggcagaagcctgcccacctgcctgcccgagtgcggccagcccagcagaagcctgcccagcctggtgaagagaatcatcggcggcagaaacgccgagcccggcctgttcccctggcaggccctgatcgtggtggaggacaccagcagagtgcccaacgacaagtggttcggcagcggcgccctgctgagcgccagctggatcctgaccgccgcccacgtgctgagaagccagagaagagacaccaccgtgatccccgtgagcaaggagcacgtgaccgtgtacctgggcctgcacgacgtgagagacaagagcggcgccgtgaacagcagcgccgccagagtggtgctgcaccccgacttcaacatccagaactacaaccacgacatcgccctggtgcagctgcaggagcccgtgcccctgggcccccacgtgatgcccgtgtgcctgcccagactggagccccccggcggcagactgggccacctgcagagccagtgcgacagctag

SEQ ID NO: 87909 - DNA, 2061 bp, Artificial Sequence
  Description of Artificial Sequence: Synthetic coding sequence
atgagactgctgaccctgctgggcctgctgtgcggcagcgtggccacccccctgggccccaagtggcccgagcccgtgttcggcagactggccagccccggcttccccggcgagtacgccaacgaccaggagagaagatggaccctgaccgccccccccggctacagactgagactgtacttcacccacttcgacctggagctgagccacctgtgcgagtacgacttcgtgaagctgagcagcggcgccaaggtgctggccaccctgtgcggccaggagagcaccgacaccgagagagcccccggcaaggacaccttctacagcctgggcagcagcctggacatcaccttcagaagcgactacagcaacgagaagcccttcaccggcttcgaggccttctacgccgccgaggacatcgacgagtgccaggtggcccccggcgaggcccccacctgcgaccaccactgccacaaccacctgggcggcttctactgcagctgcagagccggctacgtgctgcacagaaacaagagaacctgcagcgccctgtgcagcggccaggtgttcacccagagaagcggcgagctgagcagccccgagtaccccagaccctaccccaagctgagcagctgcacctacagcatcagcctggaggagggcttcagcgtgatcctggacttcgtggagagcttcgacgtggagacccaccccgagaccctgtgcccctacgacttcctgaagatccagaccgacagagaggagcacggccccttctgcggcaagaccctgccccacagaatcgagaccaagagcaacaccgtgaccatcaccttcgtgaccgacgagagcggcgaccacaccggctggaagatccactacaccagcaccgcccagccctgcccctaccccatggccccccccaacggccacgtgagccccgtgcaggccaagtacatcctgaaggacagcttcagcatcttctgcgagaccggctacgagctgctgcagggccacctgcccctgaagagcttcaccgccgtgtgccagaaggacggcagctgggacagacccatgcccgcctgcagcatcgtggactgcggcccccccgacgacctgcccagcggcagagtggagtacatcaccggccccggcgtgaccacctacaaggccgtgatccagtacagctgcgaggagaccttctacaccatgaaggtgaacgacggcaagtacgtgtgcgaggccgacggcttctggaccagcagcaagggcgagaagagcctgcccgtgtgcgagcccgtgtgcggcctgagcgccagaaccaccggcggcagaatctacggcggccagaaggccaagcccggcgacttcccctggcaggtgctgatcctgggcggcaccaccgccgccggcgccctgctgtacgacaactgggtgctgaccgccgcccacgccgtgtacgagcagaagcacgacgccagcgccctggacatcagaatgggcaccctgaagagactgagcccccactacacccaggcctggagcgaggccgtgttcatccacgagggctacacccacgacgccggcttcgacaacgacatcgccctgatcaagctgaacaacaaggtggtgatcaacagcaacatcacccccatctgcctgcccagaaaggaggccgagagcttcatgagaaccgacgacatcggcaccgccagcggctggggcctgacccagagaggcttcctggccagaaacctgatgtacgtggacatccccatcgtggaccaccagaagtgcaccgccgcctacgagaagcccccctaccccagaggcagcgtgaccgccaacatgctgtgcgccggcctggagagcggcggcaaggacagctgcagaggcgacagcggcggcgccctggtgttcctggacagcgagaccgagagatggttcgtgggcggcatcgtgagctggggcagcatgaactgcggcgaggccggccagtacggcgtgtacaccaaggtgatcaactacatcccctggatcgagaacatcatcagcgacttctag

SEQ ID NO: 87910 - DNA, 558 bp, Artificial Sequence
  Description of Artificial Sequence: Synthetic coding sequence
atgagactgctgaccctgctgggcctgctgtgcggcagcgtggccacccccctgggccccaagtggcccgagcccgtgttcggcagactggccagccccggcttccccggcgagtacgccaacgaccaggagagaagatggaccctgaccgccccccccggctacagactgagactgtacttcacccacttcgacctggagctgagccacctgtgcgagtacgacttcgtgaagctgagcagcggcgccaaggtgctggccaccctgtgcggccaggagagcaccgacaccgagagagcccccggcaaggacaccttctacagcctgggcagcagcctggacatcaccttcagaagcgactacagcaacgagaagcccttcaccggcttcgaggccttctacgccgccgaggacatcgacgagtgccaggtggcccccggcgaggcccccacctgcgaccaccactgccacaaccacctgggcggcttctactgcagctgcagagccggctacgtgctgcacagaaacaagagaacctgcagcgagcagagcctgtag

SEQ ID NO: 87911 - DNA, 1089 bp, Artificial Sequence
  Description of Artificial Sequence: Synthetic coding sequence
atggccgcccccagagtgttccccctgagctgcgccgtgcagcagtacgcctggggcaagatgggcagcaacagcgaggtggccagactgctggccagcagcgaccccctggcccagatcgccgaggacaagccctacgccgagctgtggatgggcacccaccccagaggcgacgccaagatcctggacaacagaatcagccagaagaccctgagccagtggatcgccgagaaccaggacagcctgggcagcaaggtgaaggacaccttcaacggcaacctgcccttcctgttcaaggtgctgagcgtggagacccccctgagcatccaggcccaccccaacaaggagctggccgagaagctgcacctgcaggccccccagcactaccccgacgccaaccacaagcccgagatggccatcgccctgacccccttccagggcctgtgcggcttcagacccgtggaggagatcgtgaccttcctgaagaccgccgccggcaacaacatggaggacatcttcggcgagctgctgctgcagctgcaccagcagtaccccggcgacatcggctgcttcgccatctacttcctgaacctgctgaccctgaagcccggcgaggccatgttcctggaggccaacgtgccccacgcctacctgaagggcgactgcgtggagtgcatggcctgcagcgacaacaccgtgagagccggcctgacccccaagttcatcgacgtgcccaccctgtgcgagatgctgagctacacccccagcagcagcaaggacagactgttcctgcccaccagaagccaggaggacccctacctgagcatctacgacccccccgtgcccgacttcaccatcatgaagaccgaggtgcccggcagcgtgaccgagtacaaggtgctggccctggacagcgccagcatcctgctgatggtgcagggcaccgtgatcgccagcacccccaccacccagacccccatccccctgcagagaggcggcgtgctgttcatcggcgccaacgagagcgtgagcctgaagctgaccgagcccaaggacctgctgatcttcagagcctgctgcctgctgtag

SEQ ID NO: 87912 - DNA, 1272 bp, Artificial Sequence
  Description of Artificial Sequence: Synthetic coding sequence
atggccgcccccagagtgttccccctgagctgcgccgtgcagcagtacgcctggggcaagatgggcagcaacagcgaggtggccagactgctggccagcagcgaccccctggcccagatcgccgaggacaagccctacgccgagctgtggatgggcacccaccccagaggcgacgccaagatcctggacaacagaatcagccagaagaccctgagccagtggatcgccgagaaccaggacagcctgggcagcaaggtgaaggacaccttcaacggcaacctgcccttcctgttcaaggtgctgagcgtggagacccccctgagcatccaggcccaccccaacaaggagctggccgagaagctgcacctgcaggccccccagcactaccccgacgccaaccacaagcccgagatggccatcgccctgacccccttccagggcctgtgcggcttcagacccgtggaggagatcgtgaccttcctgaagaaggtgcccgagttccagttcctgatcggcgacgaggccgccacccacctgaagcagaccatgagccacgacagccaggccgtggccagcagcctgcagagctgcttcagccacctgatgaagagcgagaagaaggtggtggtggagcagctgaacctgctggtgaagagaatcagccagcaggccgccgccggcaacaacatggaggacatcttcggcgagctgctgctgcagctgcaccagcagtaccccggcgacatcggctgcttcgccatctacttcctgaacctgctgaccctgaagcccggcgaggccatgttcctggaggccaacgtgccccacgcctacctgaagggcgactgcgtggagtgcatggcctgcagcgacaacaccgtgagagccggcctgacccccaagttcatcgacgtgcccaccctgtgcgagatgctgagctacacccccagcagcagcaaggacagactgttcctgcccaccagaagccaggaggacccctacctgagcatctacgacccccccgtgcccgacttcaccatcatgaagaccgaggtgcccggcagcgtgaccgagtacaaggtgctggccctggacagcgccagcatcctgctgatggtgcagggcaccgtgatcgccagcacccccaccacccagacccccatccccctgcagagaggcggcgtgctgttcatcggcgccaacgagagcgtgagcctgaagctgaccgagcccaaggacctgctgatcttcagagcctgctgcctgctgtag

SEQ ID NO: 87913 - DNA, 804 bp, Artificial Sequence
  Description of Artificial Sequence: Synthetic coding sequence
atgggcagcaacagcgaggtggccagactgctggccagcagcgaccccctggcccagatcgccgaggacaagccctacgccgagctgtggatgggcacccaccccagaggcgacgccaagatcctggacaacagaatcagccagaagaccctgagccagtggatcgccgagaaccaggacagcctgggcagcaaggtgaaggacaccttcaacggcaacctgcccttcctgttcaaggtgctgagcgtggagacccccctgagcatccaggcccaccccaacaaggagctggccgagaagctgcacctgcaggccccccagcactaccccgacgccaaccacaagcccgagatggccatcgccctgacccccttccagggcctgtgcggcttcagacccgtggaggagatcgtgaccttcctgaagaaggtgcccgagttccagttcctgatcggcgacgaggccgccacccacctgaagcagaccatgagccacgacagccaggccgtggccagcagcctgcagagctgcttcagccacctgatgaagagcgagaagaaggtggtggtggagcagctgaacctgctggtgaagagaatcagccagcaggccgccgccggcaacaacatggaggacatcttcggcgagctgctgctgcagctgcaccagcagtaccccggcgacatcggctgcttcgccatctacttcctgaacctgctgaccctgaagcccggcgaggccatgttcctggaggccaacgtgccccacgcctacctgaagggcggcccctggctgtgccactag

SEQ ID NO: 87914 - DNA, 1122 bp, Artificial Sequence
  Description of Artificial Sequence: Synthetic coding sequence
atgggcacccaccccagaggcgacgccaagatcctggacaacagaatcagccagaagaccctgagccagtggatcgccgagaaccaggacagcctgggcagcaaggtgaaggacaccttcaacggcaacctgcccttcctgttcaaggtgctgagcgtggagacccccctgagcatccaggcccaccccaacaaggagctggccgagaagctgcacctgcaggccccccagcactaccccgacgccaaccacaagcccgagatggccatcgccctgacccccttccagggcctgtgcggcttcagacccgtggaggagatcgtgaccttcctgaagaaggtgcccgagttccagttcctgatcggcgacgaggccgccacccacctgaagcagaccatgagccacgacagccaggccgtggccagcagcctgcagagctgcttcagccacctgatgaagagcgagaagaaggtggtggtggagcagctgaacctgctggtgaagagaatcagccagcaggccgccgccggcaacaacatggaggacatcttcggcgagctgctgctgcagctgcaccagcagtaccccggcgacatcggctgcttcgccatctacttcctgaacctgctgaccctgaagcccggcgaggccatgttcctggaggccaacgtgccccacgcctacctgaagggcgactgcgtggagtgcatggcctgcagcgacaacaccgtgagagccggcctgacccccaagttcatcgacgtgcccaccctgtgcgagatgctgagctacacccccagcagcagcaaggacagactgttcctgcccaccagaagccaggaggacccctacctgagcatctacgacccccccgtgcccgacttcaccatcatgaagaccgaggtgcccggcagcgtgaccgagtacaaggtgctggccctggacagcgccagcatcctgctgatggtgcagggcaccgtgatcgccagcacccccaccacccagacccccatccccctgcagagaggcggcgtgctgttcatcggcgccaacgagagcgtgagcctgaagctgaccgagcccaaggacctgctgatcttcagagcctgctgcctgctgtag

SEQ ID NO: 87915 - DNA, 4371 bp, Artificial Sequence
  Description of Artificial Sequence: Synthetic coding sequence
atgagactgcccctgctgctggtgttcgccagcgtgatccccggcgccgtgctgctgctggacaccagacagttcctgatctacaacgaggaccacaagagatgcgtggacgccgtgagccccagcgccgtgcagaccgccgcctgcaaccaggacgccgagagccagaagttcagatgggtgagcgagagccagatcatgagcgtggccttcaagctgtgcctgggcgtgcccagcaagaccgactgggtggccatcaccctgtacgcctgcgacagcaagagcgagttccagaagtgggagtgcaagaacgacaccctgctgggcatcaagggcgaggacctgttcttcaactacggcaacagacaggagaagaacatcatgctgtacaagggcagcggcctgtggagcagatggaagatctacggcaccaccgacaacctgtgcagcagaggctacgaggccatgtacaccctgctgggcaacgccaacggcgccacctgcgccttccccttcaagttcgagaacaagtggtacgccgactgcaccagcgccggcagaagcgacggctggctgtggtgcggcaccaccaccgactacgacaccgacaagctgttcggctactgccccctgaagttcgagggcagcgagagcctgtggaacaaggaccccctgaccagcgtgagctaccagatcaacagcaagagcgccctgacctggcaccaggccagaaagagctgccagcagcagaacgccgagctgctgagcatcaccgagatccacgagcagacctacctgaccggcctgaccagcagcctgaccagcggcctgtggatcggcctgaacagcctgagcttcaacagcggctggcagtggagcgacagaagccccttcagatacctgaactggctgcccggcagccccagcgccgagcccggcaagagctgcgtgagcctgaaccccggcaagaacgccaagtgggagaacctggagtgcgtgcagaagctgggctacatctgcaagaagggcaacaccaccctgaacagcttcgtgatccccagcgagagcgacgtgcccacccactgccccagccagtggtggccctacgccggccactgctacaagatccacagagacgagaagaagatccagagagacgccctgaccacctgcagaaaggagggcggcgacctgaccagcatccacaccatcgaggagctggacttcatcatcagccagctgggctacgagcccaacgacgagctgtggatcggcctgaacgacatcaagatccagatgtacttcgagtggagcgacggcacccccgtgaccttcaccaagtggctgagaggcgagcccagccacgagaacaacagacaggaggactgcgtggtgatgaagggcaaggacggctactgggccgacagaggctgcgagtggcccctgggctacatctgcaagatgaagagcagaagccagggccccgagatcgtggaggtggagaagggctgcagaaagggctggaagaagcaccacttctactgctacatgatcggccacaccctgagcaccttcgccgaggccaaccagacctgcaacaacgagaacgcctacctgaccaccatcgaggacagatacgagcaggccttcctgaccagcttcgtgggcctgagacccgagaagtacttctggaccggcctgagcgacatccagaccaagggcaccttccagtggaccatcgaggaggaggtgagattcacccactggaacagcgacatgcccggcagaaagcccggctgcgtggccatgagaaccggcatcgccggcggcctgtgggacgtgctgaagtgcgacgagaaggccaagttcgtgtgcaagcactgggccgagggcgtgacccacccccccaagcccaccaccacccccgagcccaagtgccccgaggactggggcgccagcagcagaaccagcctgtgcttcaagctgtacgccaagggcaagcacgagaagaagacctggttcgagagcagagacttctgcagagccctgggcggcgacctggccagcatcaacaacaaggaggagcagcagaccatctggagactgatcaccgccagcggcagctaccacaagctgttctggctgggcctgacctacggcagccccagcgagggcttcacctggagcgacggcagccccgtgagctacgagaactgggcctacggcgagcccaacaactaccagaacgtggagtactgcggcgagctgaagggcgaccccaccatgagctggaacgacatcaactgcgagcacctgaacaactggatctgccagatccagaagggccagacccccaagcccgagcccacccccgccccccaggacaacccccccgtgaccgaggacggctgggtgatctacaaggactaccagtactacttcagcaaggagaaggagaccatggacaacgccagagccttctgcaagagaaacttcggcgacctggtgagcatccagagcgagagcgagaagaagttcctgtggaagtacgtgaacagaaacgacgcccagagcgcctacttcatcggcctgctgatcagcctggacaagaagttcgcctggatggacggcagcaaggtggactacgtgagctgggccaccggcgagcccaacttcgccaacgaggacgagaactgcgtgaccatgtacagcaacagcggcttctggaacgacatcaactgcggctaccccaacgccttcatctgccagagacacaacagcagcatcaacgccaccaccgtgatgcccaccatgcccagcgtgcccagcggctgcaaggagggctggaacttctacagcaacaagtgcttcaagatcttcggcttcatggaggaggagagaaagaactggcaggaggccagaaaggcctgcatcggcttcggcggcaacctggtgagcatccagaacgagaaggagcaggccttcctgacctaccacatgaaggacagcaccttcagcgcctggaccggcctgaacgacgtgaacagcgagcacaccttcctgtggaccgacggcagaggcgtgcactacaccaactggggcaagggctaccccggcggcagaagaagcagcctgagctacgaggacgccgactgcgtggtgatcatcggcggcgccagcaacgaggccggcaagtggatggacgacacctgcgacagcaagagaggctacatctgccagaccagaagcgaccccagcctgaccaacccccccgccaccatccagaccgacggcttcgtgaagtacggcaagagcagctacagcctgatgagacagaagttccagtggcacgaggccgagacctactgcaagctgcacaacagcctgatcgccagcatcctggacccctacagcaacgccttcgcctggctgcagatggagaccagcaacgagagagtgtggatcgccctgaacagcaacctgaccgacaaccagtacacctggaccgacaagtggagagtgagatacaccaactgggccgccgacgagcccaagctgaagagcgcctgcgtgtacctggacctggacggctactggaagaccgcccactgcaacgagagcttctacttcctgtgcaagagaagcgacgagatccccgccaccgagcccccccagctgcccggcagatgccccgagagcgaccacaccgcctggatccccttccacggccactgctactacatcgagagcagctacaccagaaactggggccaggccagcctggagtgcctgagaatgggcagcagcctggtgagcatcgagagcgccgccgagagcagcttcctgagctacagagtggagcccctgaagagcaagaccaacttctggatcggcctgttcagaaacgtggagggcacctggctgtggatcaacaacagccccgtgagcttcgtgaactggaacaccggcgaccccagcggcgagagaaacgactgcgtggccctgcacgccagcagcggcttctggagcaacatccactgcagcagctacaagggctacatctgcaagagacccaagatcatcgacgccaagcccacccacgagctgctgaccaccaaggccgacaccagaaagatggaccccagcaagcccagcagcaacgtggccggcgtggtgatcatcgtgatcctgctgatcctgaccggcgccggcctggccgcctacttcttctacaagaagagaagagtgcacctgccccaggagggcgccttcgagaacaccctgtacttcaacagccagagcagccccggcaccagcgacatgaaggacctggtgggcaacatcgagcagaacgagcacagcgtgatctag

SEQ ID NO: 87916 - DNA, 4440 bp, Artificial Sequence
  Description of Artificial Sequence: Synthetic coding sequence
atgggccccggcagacccgcccccgccccctggcccagacacctgctgagatgcgtgctgctgctgggctgcctgcacctgggcagacccggcgcccccggcgacgccgccctgcccgagcccaacgtgttcctgatcttcagccacggcctgcagggctgcctggaggcccagggcggccaggtgagagtgacccccgcctgcaacaccagcctgcccgcccagagatggaagtgggtgagcagaaacagactgttcaacctgggcaccatgcagtgcctgggcaccggctggcccggcaccaacaccaccgccagcctgggcatgtacgagtgcgacagagaggccctgaacctgagatggcactgcagaaccctgggcgaccagctgagcctgctgctgggcgccagaaccagcaacatcagcaagcccggcaccctggagagaggcgaccagaccagaagcggccagtggagaatctacggcagcgaggaggacctgtgcgccctgccctaccacgaggtgtacaccatccagggcaacagccacggcaagccctgcaccatccccttcaagtacgacaaccagtggttccacggctgcaccagcaccggcagagaggacggccacctgtggtgcgccaccacccaggactacggcaaggacgagagatggggcttctgccccatcaagagcaacgactgcgagaccttctgggacaaggaccagctgaccgacagctgctaccagttcaacttccagagcaccctgagctggagagaggcctgggccagctgcgagcagcagggcgccgacctgctgagcatcaccgagatccacgagcagacctacatcaacggcctgctgaccggctacagcagcaccctgtggatcggcctgaacgacctggacaccagcggcggctggcagtggagcgacaacagccccctgaagtacctgaactgggagagcgaccagcccgacaaccccagcgaggagaactgcggcgtgatcagaaccgagagcagcggcggctggcagaacagagactgcagcatcgccctgccctacgtgtgcaagaagaagcccaacgccaccgccgagcccaccccccccgacagatgggccaacgtgaaggtggagtgcgagcccagctggcagcccttccagggccactgctacagactgcaggccgagaagagaagctggcaggagagcaagaaggcctgcctgagaggcggcggcgacctggtgagcatccacagcatggccgagctggagttcatcaccaagcagatcaagcaggaggtggaggagctgtggatcggcctgaacgacctgaagctgcagatgaacttcgagtggagcgacggcagcctggtgagcttcacccactggcaccccttcgagcccaacaacttcagagacagcctggaggactgcgtgaccatctggggccccgagggcagatggaacgacagcccctgcaaccagagcctgcccagcatctgcaagaaggccggccagctgagccagggcgccgccgaggaggaccacggctgcagaaagggctggacctggcacagccccagctgctactggctgggcgaggaccaggtgacctacagcgaggccagaagactgtgcaccgaccacggcagccagctggtgaccatcaccaacagattcgagcaggccttcgtgagcagcctgatctacaactgggagggcgagtacttctggaccgccctgcaggacctgaacagcaccggcagcttcttctggctgagcggcgacgaggtgatgtacacccactggaacagagaccagcccggctacagcagaggcggctgcgtggccctggccaccggcagcgccatgggcctgtgggaggtgaagaactgcaccagcttcagagccagatacatctgcagacagagcctgggcacccccgtgacccccgagctgcccggccccgaccccacccccagcctgaccggcagctgcccccagggctgggccagcgacaccaagctgagatactgctacaaggtgttcagcagcgagagactgcaggacaagaagagctgggtgcaggcccagggcgcctgccaggagctgggcgcccagctgctgagcctggccagctacgaggaggagcacttcgtggccaacatgctgaacaagatcttcggcgagagcgagcccgagatccacgagcagcactggttctggatcggcctgaacagaagagaccccagaggcggccagagctggagatggagcgacggcgtgggcttcagctaccacaacttcgacagaagcagacacgacgacgacgacatcagaggctgcgccgtgctggacctggccagcctgcagtgggtggccatgcagtgcgacacccagctggactggatctgcaagatccccagaggcaccgacgtgagagagcccgacgacagcccccagggcagaagagagtggctgagattccaggaggccgagtacaagttcttcgagcaccacagcacctgggcccaggcccagagaatctgcacctggttccaggccgagctgaccagcgtgcacagccaggccgagctggacttcctgagccacaacctgcagaagttcagcagagcccaggagcagcactggtggatcggcctgcacaccagcgagagcgacggcagattcagatggaccgacggcagcatcatcaacttcatcagctgggcccccggcaagcccagacccgtgggcaaggacaagaagtgcgtgtacatgaccgccagcagagaggactggggcgaccagagatgcctgaccgccctgccctacatctgcaagagaagcaacgtgaccaaggagacccagccccccgacctgcccaccaccgccctgggcggctgccccagcgactggatccagttcctgaacaagtgcttccaggtgcagggccaggagccccagagcagagtgaagtggagcgaggcccagttcagctgcgagcagcaggaggcccagctggtgaccatcaccaaccccctggagcaggccttcatcaccgccagcctgcccaacgtgaccttcgacctgtggatcggcctgcacgccagccagagagacttccagtgggtggagcaggagcccctgatgtacgccaactgggcccccggcgagcccagcggccccagccccgcccccagcggcaacaagcccaccagctgcgccgtggtgctgcacagccccagcgcccacttcaccggcagatgggacgacagaagctgcaccgaggagacccacggcttcatctgccagaagggcaccgaccccagcctgagccccagccccgccgccctgccccccgcccccggcaccgagctgagctacctgaacggcaccttcagactgctgcagaagcccctgagatggcacgacgccctgctgctgtgcgagagcagaaacgccagcctggcctacgtgcccgacccctacacccaggccttcctgacccaggccgccagaggcctgagaacccccctgtggatcggcctggccggcgaggagggcagcagaagatacagctgggtgagcgaggagcccctgaactacgtgggctggcaggacggcgagccccagcagcccggcggctgcacctacgtggacgtggacggcgcctggagaaccaccagctgcgacaccaagctgcagggcgccgtgtgcggcgtgagcagcggcccccccccccccagaagaatcagctaccacggcagctgcccccagggcctggccgacagcgcctggatccccttcagagagcactgctacagcttccacatggagctgctgctgggccacaaggaggccagacagagatgccagagagccggcggcgccgtgctgagcatcctggacgagatggagaacgtgttcgtgtgggagcacctgcagagctacgagggccagagcagaggcgcctggctgggcatgaacttcaaccccaagggcggcaccctggtgtggcaggacaacaccgccgtgaactacagcaactggggcccccccggcctgggccccagcatgctgagccacaacagctgctactggatccagagcaacagcggcctgtggagacccggcgcctgcaccaacatcaccatgggcgtggtgtgcaagctgcccagagccgagcagagcagcttcagccccagcgccctgcccgagaaccccgccgccctggtggtggtgctgatggccgtgctgctgctgctggccctgctgaccgccgccctgatcctgtacagaagaagacagagcatcgagagaggcgccttcgagggcgccagatacagcagaagcagcagcagccccaccgaggccaccgagaagaacatcctggtgagcgacatggagatgaacgagcagcaggagtag

SEQ ID NO: 87917 - DNA, 1038 bp, Artificial Sequence
  Description of Artificial Sequence: Synthetic coding sequence
atgcccaccggccacctgggcagccccctggccctggccctgctgcccgtggccaccaacagacccgccgtgcagtggagctgcaccgccccccagcccaccagcctggccgccggcaccatcggcgccgccagaagaagacccatggccagcagcgccagaagagccagaggcagcagaagatacagctgggtgagcgaggagcccctgaactacgtgggctggcaggacggcgagccccagcagcccggcggctgcacctacgtggacgtggacggcgcctggagaaccaccagctgcgacaccaagctgcagggcgccgtgtgcggcgtgagcagcggcccccccccccccagaagaatcagctaccacggcagctgcccccagggcctggccgacagcgcctggatccccttcagagagcactgctacagcttccacatggagctgctgctgggccacaaggaggccagacagagatgccagagagccggcggcgccgtgctgagcatcctggacgagatggagaacgtgttcgtgtgggagcacctgcagagctacgagggccagagcagaggcgcctggctgggcatgaacttcaaccccaagggcggcaccctggtgtggcaggacaacaccgccgtgaactacagcaactggggcccccccggcctgggccccagcatgctgagccacaacagctgctactggatccagagcaacagcggcctgtggagacccggcgcctgcaccaacatcaccatgggcgtggtgtgcaagctgcccagagccgagcagagcagcttcagccccagcgccctgcccgagaaccccgccgccctggtggtggtgctgatggccgtgctgctgctgctggccctgctgaccgccgccctgatcctgtacagaagaagacagagcatcgagagaggcgccttcgagggcgccagatacagcagaagcagcagcagccccaccgaggccaccgagaagaacatcctggtgagcgacatggagatgaacgagcagcaggagtag

SEQ ID NO: 87918 - DNA, 834 bp, Artificial Sequence
  Description of Artificial Sequence: Synthetic coding sequence
atgttccccttctacagctgctggagaaccggcctgctgctgctgctgctggccgtggccgtgagagagagctggcagaccgaggagaagacctgcgacctggtgggcgagaagggcaaggagagcgagaaggagctggccctggtgaagagactgaagcccctgttcaacaagagcttcgagagcaccgtgggccagggcagcgacacctacatctacatcttcagagtgtgcagagaggccggcaaccacaccagcggcgccggcctggtgcagatcaacaagagcaacggcaaggagaccgtggtgggcagactgaacgagacccacatcttcaacggcagcaactggatcatgctgatctacaagggcggcgacgagtacgacaaccactgcggcaaggagcagagaagagccgtggtgatgatcagctgcaacagacacaccctggccgacaacttcaaccccgtgagcgaggagagaggcaaggtgcaggactgcttctacctgttcgagatggacagcagcctggcctgcagccccgagatcagccacctgagcgtgggcagcatcctgctggtgaccttcgccagcctggtggccgtgtacgtggtgggcggcttcctgtaccagagactggtggtgggcgccaagggcatggagcagttcccccacctggccttctggcaggacctgggcaacctggtggccgacggctgcgacttcgtgtgcagaagcaagcccagaaacgtgcccgccgcctacagaggcgtgggcgacgaccagctgggcgaggagagcgaggagagagacgaccacctgctgcccatgtag

SEQ ID NO: 87919 - DNA, 279 bp, Artificial Sequence
  Description of Artificial Sequence: Synthetic coding sequence
atgttccccttctacagctgctggagaaccggcctgctgctgctgctgctggccgtggccgtgagagagagctggcagaccgaggagaagacctgcgacctggtgggcgagaagggcaaggagagcgagaaggagctggccctggtgaagagactgaagcccctgttcaacaagagcttcgagagcaccgtgggccagggcagcgacacctacatctacatcttcagagtgtgcagagaggccggcaaccacaccagcggcgccggcctggtgcagtag

SEQ ID NO: 87920 - DNA, 330 bp, Artificial Sequence
  Description of Artificial Sequence: Synthetic coding sequence
atgttccccttctacagctgctggagaaccggcctgctgctgctgctgctggccgtggccgtgagagagagctggcagaccgaggagaagacctgcgacctggtgggcgagaagggcaaggagagcgagaaggagctggccctggtgaagagactgaagcccctgttcaacaagagcttcgagagcaccgtgggccagggcagcgacacctacatctacatcttcagagtgtgcagagaggccggcaaccacaccagcggcgccggcctggtgcagatcaacaagagcaacggcaaggagaccgtggtgggcagactgaacgagacctag

SEQ ID NO: 87921 - DNA, 747 bp, Artificial Sequence
  Description of Artificial Sequence: Synthetic coding sequence
atgagcctgttccccagcctgcccctgctgctgctgagcatggtggccgccagctacagcgagaccgtgacctgcgaggacgcccagaagacctgccccgccgtgatcgcctgcagcagccccggcatcaacggcttccccggcaaggacggcagagacggcaccaagggcgagaagggcgagcccggccagggcctgagaggcctgcagggcccccccggcaagctgggcccccccggcaaccccggccccagcggcagccccggccccaagggccagaagggcgaccccggcaagagccccgacggcgacagcagcctggccgccagcgagagaaaggccctgcagaccgagatggccagaatcaagaagtggctgaccttcagcctgggcaagcaggtgggcaacaagttcttcctgaccaacggcgagatcatgaccttcgagaaggtgaaggccctgtgcgtgaagttccaggccagcgtggccacccccagaaacgccgccgagaacggcgccatccagaacctgatcaaggaggaggccttcctgggcatcaccgacgagaagaccgagggccagttcgtggacctgaccggcaacagactgacctacaccaactggaacgagggcgagcccaacaacgccggcagcgacgaggactgcgtgctgctgctgaagaacggccagtggaacgacgtgccctgcagcaccagccacctggccgtgtgcgagttccccatctag

SEQ ID NO: 87922 - DNA, 744 bp, Artificial Sequence
  Description of Artificial Sequence: Synthetic coding sequence
atggccgccgaggccgacggccccctgaagagactgctggtgcccatcctgctgcccgagaagtgctacgaccagctgttcgtgcagtgggacctgctgcacgtgccctgcctgaagatcctgctgagcaagggcctgggcctgggcatcgtggccggcagcctgctggtgaagctgccccaggtgttcaagatcctgggcgccaagagcgccgagggcctgagcctgcagagcgtgatgctggagctggtggccctgaccggcaccatggtgtacagcatcaccaacaacttccccttcagcagctggggcgaggccctgttcctgatgctgcagaccatcaccatctgcttcctggtgatgcactacagaggccagaccgtgaagggcgtggccttcctggcctgctacggcctggtgctgctggtgctgctgagccccctgacccccctgaccgtggtgaccctgctgcaggccagcaacgtgcccgccgtggtggtgggcagactgctgcaggccgccaccaactaccacaacggccacaccggccagctgagcgccatcaccgtgttcctgctgttcggcggcagcctggccagaatcttcaccagcatccaggagaccggcgaccccctgatggccggcaccttcgtggtgagcagcctgtgcaacggcctgatcgccgcccagctgctgttctactggaacgccaagcccccccacaagcagaagaaggcccagtag

SEQ ID NO: 87923 - DNA, 381 bp, Artificial Sequence
  Description of Artificial Sequence: Synthetic coding sequence
atggccgccgaggccgacggccccctgaagagactgctggtgcccatcctgctgcccgagaagtgctacgaccagctgttcgtgcagtgggacctgctgcacgtgccctgcctgaagatcctgctgagcaagggcctgggcctgggcatcgtggccggcagcctgctggtgaagctgccccaggtgttcaagatcctgggcgccaagagcgccgccggcctgaagaaggaggacgaggccagacccgtgagaagcgccagcatgagagtgagaggcggcctgggcgcctggggccaccagcagggcgagggctgcatggagtgggagagccagggcgccggcagcggctacagatgggccgccgtgccccccggcgcctag

SEQ ID NO: 87924 - DNA, 900 bp, Artificial Sequence
  Description of Artificial Sequence: Synthetic coding sequence
atggccgccgaggccgacggccccctgaagagactgctggtgcccatcctgctgcccgagaagtgctacgaccagctgttcgtgcagtgggacctgctgcacgtgccctgcctgaagatcctgctgagcaagggcctgggcctgggcatcgtggccggcagcctgctggtgaagctgccccaggtgttcaagatcctgggcgccaagagcgccgagggcctgagcctgcagagcgtgatgctggagctggtggccctgaccggcaccatggtgtacagcatcaccaacaacttccccttcagcagctggggcgaggccctgttcctgatgctgcagaccatcaccatctgcttcctggtgatgcactacagaggccagaccgtgaagggcgtggccttcctggcctgctacggcctggtgctgctggtgctgctgagccccctgacccccctgaccgtggtgccctgcagcggcctgcagtgcgcctgctgcggcggcggcgaggccagccccggcagccaccagctgccccagagagcccacagacccgccctgagccaccacagcctgcccgccgtgtggggcctgcccggccccaacctgcacttccacagcggcaacagaagaagccccgacggctgggacctgtgcggcctgctgagcctgcagagaccccacagaagacccgccgccctgctgctggagtgcaaggccagcccccaggccgagaagggcgccgtggagcccgccaccggcgtgatccccttccccctgatccaccccaccagcggcttcagccccagcgagcccgcctgctggtgcgacctgctgatcctgcacagcagcgccctggccgacttcctgagccagggcttcctgctggtggagaccaacggctag

SEQ ID NO: 87925 - DNA, 636 bp, Artificial Sequence
  Description of Artificial Sequence: Synthetic coding sequence
atggccgccgaggccgacggccccctgaagagactgctggtgcccatcctgctgcccgagaagtgctacgaccagctgttcgtgcagtgggacctgctgcacgtgccctgcctgaagatcctgctgagcaagggcctgggcctgggcatcgtggccggcagcctgctggtgaagctgccccaggtgttcaagatcctgggcgccaagagcgccgagggcctgagcctgcagagcgtgatgctggagctggtggccctgaccggcaccatggtgtacagcatcaccaacaacttccccttcagcagctggggcgaggccctgttcctgatgctgcagaccatcaccatctgcttcctggtgatgcactacagaggccagaccgtgaagggcgtggccttcctggcctgctacggcctggtgctgctggtgctgctgagccccctgacccccctgaccgtggtgaccctgctgcaggccagcaacgtgcccgccgtggtggtgggcagactgctgcaggccgccaccaacaccaccaccggcacccaggccagcagccagcccagccagagcagctgctgcctgggcgccccctggcccgagagcagcctgcccttcagaaagcccgagatcccctag

SEQ ID NO: 87926 - DNA, 561 bp, Artificial Sequence
  Description of Artificial Sequence: Synthetic coding sequence
atggccgccgaggccgacggccccctgaagagactgctggtgcccatcctgctgcccgagaagtgctacgaccagctgttcgtgcagtgggacctgctgcacgtgccctgcctgaagatcctgctgagcaagggcctgggcctgggcatcgtggccggcagcctgctggtgaagctgccccaggtgttcaagatcctgggcgccaagagcgccgagggcctgagcctgcagagcgtgatgctggagctggtggccctgaccggcaccatggtgtacagcatcaccaacaacttccccttcagatgcagattccccagactgctgagacccggccccgccggcgccagcctgaccagcgacgccctggactgcagccaccccgcccccggcctgcagtgcgcctgctgcggcggcggcgaggccagccccggcagccaccagctgccccagagagcccacagacccgccctgagccaccacagcctgcccgccgtgtggggcctgcccggccccaacctgcacttccacagcggcgtgagcatccccttcagccagctgtag

SEQ ID NO: 87927 - DNA, 2826 bp, Artificial Sequence
  Description of Artificial Sequence: Synthetic coding sequence
atggccgccgcccccgccctgaagcactggagaaccaccctggagagagtggagaagttcgtgagccccctgtacttcaccgactgcaacctgagaggcagactgttcggcgccagctgccccgtggccgtgctgagcagcttcctgacccccgagagactgccctaccaggaggccgtgcagagagacttcagacccgcccaggtgggcgacagcttcggccccacctggtggacctgctggttcagagtggagctgaccatccccgaggcctgggtgggccaggaggtgcacctgtgctgggagagcgacggcgagggcctggtgtggagagacggcgagcccgtgcagggcctgaccaaggagggcgagaagaccagctacgtgctgaccgacagactgggcgagagagaccccagaagcctgaccctgtacgtggaggtggcctgcaacggcctgctgggcgccggcaagggcagcatgatcgccgcccccgaccccgagaagatgttccagctgagcagagccgagctggccgtgttccacagagacgtgcacatgctgctggtggacctggagctgctgctgggcatcgccaaggcccagcagctggagtgggtgaagagcagataccccggcctgtacagcagaatccaggagttcgcctgcagaggccagttcgtgcccgtgggcggcacctgggtggagatggacggcaacctgcccagcggcgaggccatggtgagacagttcctgcagggccagaacttcttcctgcaggagttcggcaagatgtgcagcgagttctggctgcccgacaccttcggctacagcgcccagctgccccagatcatgcacggctgcggcatcagaagattcctgacccagaagctgagctggaacctggtgaacagcttcccccaccacaccttcttctgggagggcctggacggcagcagagtgctggtgcacttcccccccggcgacagctacggcatgcagggcagcgtggaggaggtgctgaagaccgtggccaacaacagagacaagggcagagccaaccacagcgccttcctgttcggcttcggcgacggcggcggcggccccacccagaccatgctggacagactgaagagactgagcaacaccgacggcctgcccagagtgcagctgagcagccccagacagctgttcagcgccctggagagcgacagcgagcagctgtgcacctgggtgggcgagctgttcctggagctgcacaacggcacctacaccacccacgcccagatcaagaagggcaacagagagtgcgagagaatcctgcacgacgtggagctgctgagcagcctggccctggccagaagcgcccagttcctgtaccccgccgcccagctgcagcacctgtggagactgctgctgctgaaccagttccacgacgtggtgaccggcagctgcatccagatggtggccgaggaggccatgtgccactacgaggacatcagaagccacggcaacaccctgctgagcgccgccgccgccgccctgtgcgccggcgagcccggccccgagggcctgctgatcgtgaacaccctgccctggaagagaatcgaggtgatggccctgcccaagcccggcggcgcccacagcctggccctggtgaccgtgcccagcatgggctacgcccccgtgcccccccccaccagcctgcagcccctgctgccccagcagcccgtgttcgtggtgcaggagaccgacggcagcgtgaccctggacaacggcatcatcagagtgaagctggaccccaccggcagactgaccagcctggtgctggtggccagcggcagagaggccatcgccgagggcgccgtgggcaaccagttcgtgctgttcgacgacgtgcccctgtactgggacgcctgggacgtgatggactaccacctggagaccagaaagcccgtgctgggccaggccggcaccctggccgtgggcaccgagggcggcctgagaggcagcgcctggttcctgctgcagatcagccccaacagcagactgagccaggaggtggtgctggacgtgggctgcccctacgtgagattccacaccgaggtgcactggcacgaggcccacaagttcctgaaggtggagttccccgccagagtgagaagcagccaggccacctacgagatccagttcggccacctgcagagacccacccactacaacaccagctgggactgggccagattcgaggtgtgggcccacagatggatggacctgagcgagcacggcttcggcctggccctgctgaacgactgcaagtacggcgccagcgtgagaggcagcatcctgagcctgagcctgctgagagcccccaaggcccccgacgccaccgccgacaccggcagacacgagttcacctacgccctgatgccccacaagggcagcttccaggacgccggcgtgatccaggccgcctacagcctgaacttccccctgctggccctgcccgcccccagccccgcccccgccaccagctggagcgccttcagcgtgagcagccccgccgtggtgctggagaccgtgaagcaggccgagagcagcccccagagaagaagcctggtgctgagactgtacgaggcccacggcagccacgtggactgctggctgcacctgagcctgcccgtgcaggaggccatcctgtgcgacctgctggagagacccgaccccgccggccacctgaccctgagagacaacagactgaagctgaccttcagccccttccaggtgctgagcctgctgctggtgctgcagccccccccccactag

SEQ ID NO: 87928 - DNA, 3174 bp, Artificial Sequence
  Description of Artificial Sequence: Synthetic coding sequence
atggccgccgcccccgccctgaagcactggagaaccaccctggagagagtggagaagttcgtgagccccctgtacttcaccgactgcaacctgagaggcagactgttcggcgccagctgccccgtggccgtgctgagcagcttcctgacccccgagagactgccctaccaggaggccgtgcagagagacttcagacccgcccaggtgggcgacagcttcggccccacctggtggacctgctggttcagagtggagctgaccatccccgaggcctgggtgggccaggaggtgcacctgtgctgggagagcgacggcgagggcctggtgtggagagacggcgagcccgtgcagggcctgaccaaggagggcgagaagaccagctacgtgctgaccgacagactgggcgagagagaccccagaagcctgaccctgtacgtggaggtggcctgcaacggcctgctgggcgccggcaagggcagcatgatcgccgcccccgaccccgagaagatgttccagctgagcagagccgagctggccgtgttccacagagacgtgcacatgctgctggtggacctggagctgctgctgggcatcgccaagggcctgggcaaggacaaccagagaagcttccaggccctgtacaccgccaaccagatggtgaacgtgtgcgaccccgcccagcccgagaccttccccgtggcccaggccctggccagcagattcttcggccagcacggcggcgagagccagcacaccatccacgccaccggccactgccacatcgacaccgcctggctgtggcccttcaaggagaccgtgagaaagtgcgccagaagctgggtgaccgccctgcagctgatggagagaaaccccgagttcatcttcgcctgcagccaggcccagcagctggagtgggtgaagagcagataccccggcctgtacagcagaatccaggagttcgcctgcagaggccagttcgtgcccgtgggcggcacctgggtggagatggacggcaacctgcccagcggcgaggccatggtgagacagttcctgcagggccagaacttcttcctgcaggagttcggcaagatgtgcagcgagttctggctgcccgacaccttcggctacagcgcccagctgccccagatcatgcacggctgcggcatcagaagattcctgacccagaagctgagctggaacctggtgaacagcttcccccaccacaccttcttctgggagggcctggacggcagcagagtgctggtgcacttcccccccggcgacagctacggcatgcagggcagcgtggaggaggtgctgaagaccgtggccaacaacagagacaagggcagagccaaccacagcgccttcctgttcggcttcggcgacggcggcggcggccccacccagaccatgctggacagactgaagagactgagcaacaccgacggcctgcccagagtgcagctgagcagccccagacagctgttcagcgccctggagagcgacagcgagcagctgtgcacctgggtgggcgagctgttcctggagctgcacaacggcacctacaccacccacgcccagatcaagaagggcaacagagagtgcgagagaatcctgcacgacgtggagctgctgagcagcctggccctggccagaagcgcccagttcctgtaccccgccgcccagctgcagcacctgtggagactgctgctgctgaaccagttccacgacgtggtgaccggcagctgcatccagatggtggccgaggaggccatgtgccactacgaggacatcagaagccacggcaacaccctgctgagcgccgccgccgccgccctgtgcgccggcgagcccggccccgagggcctgctgatcgtgaacaccctgccctggaagagaatcgaggtgatggccctgcccaagcccggcggcgcccacagcctgggcctgacccccagccccggcgacagcgcccagcacggcctgtgcagctgcagcagcccccacctgaccgccgcccccgccgcccccgccgcctgcgtgagaagcgccagagcccccaccgacagcgccagcagacccccccccaccaagaccgacggcagcgtgaccctggacaacggcatcatcagagtgaagctggaccccaccggcagactgaccagcctggtgctggtggccagcggcagagaggccatcgccgagggcgccgtgggcaaccagttcgtgctgttcgacgacgtgcccctgtactgggacgcctgggacgtgatggactaccacctggagaccagaaagcccgtgctgggccaggccggcaccctggccgtgggcaccgagggcggcctgagaggcagcgcctggttcctgctgcagatcagccccaacagcagactgagccaggaggtggtgctggacgtgggctgcccctacgtgagattccacaccgaggtgcactggcacgaggcccacaagttcctgaaggtggagttccccgccagagtgagaagcagccaggccacctacgagatccagttcggccacctgcagagacccacccactacaacaccagctgggactgggccagattcgaggtgtgggcccacagatggatggacctgagcgagcacggcttcggcctggccctgctgaacgactgcaagtacggcgccagcgtgagaggcagcatcctgagcctgagcctgctgagagcccccaaggcccccgacgccaccgccgacaccggcagacacgagttcacctacgccctgatgccccacaagggcagcttccaggacgccggcgtgatccaggccgcctacagcctgaacttccccctgctggccctgcccgcccccagccccgcccccgccaccagctggagcgccttcagcgtgagcagccccgccgtggtgctggagaccgtgaagcaggccgagagcagcccccagagaagaagcctggtgctgagactgtacgaggcccacggcagccacgtggactgctggctgcacctgagcctgcccgtgcaggaggccatcctgtgcgacctgctggagagacccgaccccgccggccacctgaccctgagagacaacagactgaagctgaccttcagccccttccaggtgctgagcctgctgctggtgctgcagccccccccccactag

SEQ ID NO: 87929 - DNA, 3054 bp, Artificial Sequence
  Description of Artificial Sequence: Synthetic coding sequence
atggccgccgcccccgccctgaagcactggagaaccaccctggagagagtggagaagttcgtgagccccctgtacttcaccgactgcaacctgagaggcagactgttcggcgccagctgccccgtggccgtgctgagcagcttcctgacccccgagagactgccctaccaggaggccgtgcagagagacttcagacccgcccaggtgggcgacagcttcggccccacctggtggacctgctggttcagagtggagctgaccatccccgaggcctgggtgggccaggaggtgcacctgtgctgggagagcgacggcgagggcctggtgtggagagacggcgagcccgtgcagggcctgaccaaggagggcgagaagaccagctacgtgctgaccgacagactgggcgagagagaccccagaagcctgaccctgtacgtggaggtggcctgcaacggcctgctgggcgccggcaagggcagcatgatcgccgcccccgaccccgagaagatgttccagctgagcagagccgagctggccgtgttccacagagacgtgcacatgctgctggtggacctggagctgctgctgggcatcgccaagggcctgggcaaggacaaccagagaagcttccaggccctgtacaccgccaaccagatggtgaacgtgtgcgaccccgcccagcccgagaccttccccgtggcccaggccctggccagcagattcttcggccagcacggcggcgagagccagcacaccatccacgccaccggccactgccacatcgacaccgcctggctgtggcccttcaaggagaccgtgagaaagtgcgccagaagctgggtgaccgccctgcagctgatggagagaaaccccgagttcatcttcgcctgcagccaggcccagcagctggagtgggtgaagagcagataccccggcctgtacagcagaatccaggagttcgcctgcagaggccagttcgtgcccgtgggcggcacctgggtggagatggacggcaacctgcccagcggcgaggccatggtgagacagttcctgcagggccagaacttcttcctgcaggagttcggcaagatgtgcagcgagttctggctgcccgacaccttcggctacagcgcccagctgccccagatcatgcacggctgcggcatcagaagattcctgacccagaagctgagctggaacctggtgaacagcttcccccaccacaccttcttctgggagggcctggacggcagcagagtgctggtgcacttcccccccggcgacagctacggcatgcagggcagcgtggaggaggtgctgaagaccgtggccaacaacagagacaagggcagagccaaccacagcgccttcctgttcggcttcggcgacggcggcggcggccccacccagaccatgctggacagactgaagagactgagcaacaccgacggcctgcccagagtgcagctgagcagccccagacagctgttcagcgccctggagagcgacagcgagcagctgtgcacctgggtgggcgagctgttcctggagctgcacaacggcacctacaccacccacgcccagatcaagaagggcaacagagagtgcgagagaatcctgcacgacgtggagctgctgagcagcctggccctggccagaagcgcccagttcctgtaccccgccgcccagctgcagcacctgtggagactgctgctgctgaaccagttccacgacgtggtgaccggcagctgcatccagatggtggccgaggaggccatgtgccactacgaggacatcagaagccacggcaacaccctgctgagcgccgccgccgccgccctgtgcgccggcgagcccggccccgagggcctgctgatcgtgaacaccctgccctggaagagaatcgaggtgatggccctgcccaagcccggcggcgcccacagcctggccctggtgaccgtgcccagcatgggctacgcccccgtgcccccccccaccagcctgcagcccctgctgccccagcagcccgtgttcgtggtgcaggagaccgacggcagcgtgaccctggacaacggcatcatcagagtgaagctggaccccaccggcagactgaccagcctggtgctggtggccagcggcagagaggccatcgccgagggcgccgtgggcaaccagttcgtgctgttcgacgacgtgcccctgtactgggacgcctgggacgtgatggactaccacctggagaccagaaagcccgtgctgggccaggccggcaccctggccgtgggcaccgagggcggcctgagaggcagcgcctggttcctgctgcagatcagccccaacagcagactgagccaggaggtggtgctggacgtgggctgcccctacgtgagattccacaccgaggtgcactggcacgaggcccacaagttcctgaaggtggagttccccgccagagtgagaagcagccaggccacctacgagatccagttcggccacctgcagagacccacccactacaacaccagctgggactgggccagattcgaggtgtgggcccacagatggatggacctgagcgagcacggcttcggcctggccctgctgaacgactgcaagtacggcgccagcgtgagaggcagcatcctgagcctgagcctgctgagagcccccaaggcccccgacgccaccgccgacaccggcagacacgagttcacctacgccctgatgccccacaaggcccccagccccgcccccgccaccagctggagcgccttcagcgtgagcagccccgccgtggtgctggagaccgtgaagcaggccgagagcagcccccagagaagaagcctggtgctgagactgtacgaggcccacggcagccacgtggactgctggctgcacctgagcctgcccgtgcaggaggccatcctgtgcgacctgctggagagacccgaccccgccggccacctgaccctgagagacaacagactgaagctgaccttcagccccttccaggtgctgagcctgctgctggtgctgcagccccccccccactag

SEQ ID NO: 87930 - DNA, 1104 bp, Artificial Sequence
  Description of Artificial Sequence: Synthetic coding sequence
atgcccgtgggcggcctgctgcccctgttcagcagccccgccggcggcgtgctgggcggcggcctgggcggcggcggcggcagaaagggcagcggccccgccgccctgagactgaccgagaagttcgtgctgctgctggtgttcagcgccttcatcaccctgtgcttcggcgccatcttcttcctgcccgacagcagcaagctgctgagcggcgtgctgttccacagcagccccgccctgcagcccgccgccgaccacaagcccggccccggcgccagagccgaggacgccgccgagggcagagccagaagaagagaggagggcgcccccggcgaccccgaggccgccctggaggacaacctggccagaatcagagagaaccacgagagagccctgagagaggccaaggagaccctgcagaagctgcccgaggagatccagagagacatcctgctggagaagaagaaggtggcccaggaccagctgagagacaaggcccccttcagaggcctgccccccgtggacttcgtgccccccatcggcgtggagagcagagagcccgccgacgccgccatcagagagaagagagccaagatcaaggaggagatcgaggccagaaagggccaggccaactgccccggcagcagcagcagctgcgaggtggagatccagatgatgaagcacgcctggaacaactacaagggctacgcctggggcctgaacgagctgaagcccatcagcaagggcggccacagcagcagcctgttcggcaacatcaagggcgccaccatcgtggacgccctggacaccctgttcatcatggagatgaagcacgagttcgaggaggccaagagctgggtggaggagaacctggacttcaacgtgaacgccgagatcagcgtgttcgaggtgaacatcagattcgtgggcggcctgctgagcgcctactacctgagcggcgaggagatcttcagaaagaaggccgtggagctgggcgtgaagctgctgcccgccttccacacccccagcggcatcccctgggccctgctgaacatgaagagatggatgtgcaacatccccagagccatggaggccaccatctag

SEQ ID NO: 87931 - DNA, 1962 bp, Artificial Sequence
  Description of Artificial Sequence: Synthetic coding sequence
atgcccgtgggcggcctgctgcccctgttcagcagccccgccggcggcgtgctgggcggcggcctgggcggcggcggcggcagaaagggcagcggccccgccgccctgagactgaccgagaagttcgtgctgctgctggtgttcagcgccttcatcaccctgtgcttcggcgccatcttcttcctgcccgacagcagcaagctgctgagcggcgtgctgttccacagcagccccgccctgcagcccgccgccgaccacaagcccggccccggcgccagagccgaggacgccgccgagggcagagccagaagaagagaggagggcgcccccggcgaccccgaggccgccctggaggacaacctggccagaatcagagagaaccacgagagagccctgagagaggccaaggagaccctgcagaagctgcccgaggagatccagagagacatcctgctggagaagaagaaggtggcccaggaccagctgagagacaaggcccccttcagaggcctgccccccgtggacttcgtgccccccatcggcgtggagagcagagagcccgccgacgccgccatcagagagaagagagccaagatcaaggagatgatgaagcacgcctggaacaactacaagggctacgcctggggcctgaacgagctgaagcccatcagcaagggcggccacagcagcagcctgttcggcaacatcaagggcgccaccatcgtggacgccctggacaccctgttcatcatggagatgaagcacgagttcgaggaggccaagagctgggtggaggagaacctggacttcaacgtgaacgccgagatcagcgtgttcgaggtgaacatcagattcgtgggcggcctgctgagcgcctactacctgagcggcgaggagatcttcagaaagaaggccgtggagctgggcgtgaagctgctgcccgccttccacacccccagcggcatcccctgggccctgctgaacatgaagagcggcatcggcagaaactggccctgggccagcggcggcagcagcatcctggccgagttcggcaccctgcacctggagttcatgcacctgagccacctgagcggcaaccccatcttcgccgagaaggtgatgaacatcagaaccgtgctgaacaagctggagaagccccagggcctgtaccccaactacctgaaccccagcagcggccagtggggccagcaccacgtgagcgtgggcggcctgggcgacagcttctacgagtacctgctgaaggcctggctgatgagcgacaagaccgacctggaggccaagaagatgtacttcgacgccgtgcaggccatcgagacccacctgatcagaaagagcagcagcggcctgacctacatcgccgagtggaagggcggcctgctggagcacaagatgggccacctgacctgcttcgccggcggcatgttcgccctgggcgccgacgccgcccccgagggcatggcccagcactacctggagctgggcgccgagatcgccagaacctgccacgagagctacaacagaaccttcatgaagctgggccccgaggccttcagattcgacggcggcgtggaggccatcgccaccagacagaacgagaagtactacatcctgagacccgaggtgatggagacctacatgtacatgtggagactgacccacgaccccaagtacagaaagtgggcctgggaggccgtggaggccctggagaaccactgcagagtgaacggcggctacagcggcctgagagacgtgtacctgctgcacgagagctacgacgacgtgcagcagagcttcttcctggccgagaccctgaagtacctgtacctgatcttcagcgacgacgacctgctgcccctggagcactggatcttcaacagcgaggcccacctgctgcccatcctgcccaaggacaagaaggaggtggagatcagagaggagtag

SEQ ID NO: 87932 - DNA, 579 bp, Artificial Sequence
  Description of Artificial Sequence: Synthetic coding sequence
atgttcgccctgggcgccgacggcagcagagccgacaaggccggccactacctggagctgggcgccgagatcgccagaacctgccacgagagctacgacagaaccgccctgaagctgggccccgagagcttcaagttcgacggcgccgtggaggccgtggccgtgagacaggccgagaagtactacatcctgagacccgaggtgatcgagacctactggtacctgtggagattcacccacgaccccagatacagacagtggggctgggaggccgccctggccatcgagaagtactgcagagtgaacggcggcttcagcggcgtgaaggacgtgtacagcagcacccccacccacgacgacgtgcagcagagcttcttcctggccgagaccctgaagtacctgtacctgctgttcagcggcgacgacctgctgcccctggaccactgggtgttcaacaccgaggcccaccccctgcccgtgctgcacctggccaacaccaccctgagcggcaccagccagggcatgagaagacagaacccctacttccaggtgctgtacctgtactaccccgacgactag

SEQ ID NO: 87933 - DNA, 1926 bp, Artificial Sequence
  Description of Artificial Sequence: Synthetic coding sequence
atgaccacccccgccctgctgcccctgagcggcagaagaatcccccccctgaacctgggcccccccagcttcccccaccacagagccaccctgagactgagcgagaagttcatcctgctgctgatcctgagcgccttcatcaccctgtgcttcggcgccttcttcttcctgcccgacagcagcaagcacaagagattcgacctgggcctggaggacgtgctgatcccccacgtggacgccggcaagggcgccaagaaccccggcgtgttcctgatccacggccccgacgagcacagacacagagaggaggaggagagactgagaaacaagatcagagccgaccacgagaaggccctggaggaggccaaggagaagctgagaaagagcagagaggagatcagagccgagatccagaccgagaagaacaaggtggtgcaggagatgaagatcaaggagaacaagcccctgccccccgtgcccatccccaacctggtgggcatcagaggcggcgaccccgaggacaacgacatcagagagaagagagagaagatcaaggagatgatgaagcacgcctgggacaactacagaacctacggctggggccacaacgagctgagacccatcgccagaaagggccacagccccaacatcttcggcagcagccagatgggcgccaccatcgtggacgccctggacaccctgtacatcatgggcctgcacgacgagttcctggacggccagagatggatcgaggacaacctggacttcagcgtgaacagcgaggtgagcgtgttcgaggtgaacatcagattcatcggcggcctgctggccgcctactacctgagcggcgaggagatcttcaagatcaaggccgtgcagctggccgagaagctgctgcccgccttcaacacccccaccggcatcccctgggccatggtgaacctgaagagcggcgtgggcagaaactggggctgggccagcgccggcagcagcatcctggccgagttcggcaccctgcacatggagttcatccacctgagctacctgaccggcgacctgacctactacaagaaggtgatgcacatcagaaagctgctgcagaagatggacagacccaacggcctgtaccccaactacctgaaccccagaaccggcagatggggccagtaccacaccagcgtgggcggcctgggcgacagcttctacgagtacctgctgaaggcctggctgatgagcgacaagaccgaccacgaggccagaaagatgtacgacgacgccatcgaggccatcgagaagcacctgatcaagaagagcagaggcggcctgaccttcatcggcgagtggaagaacggccacctggagaagaagatgggccacctggcctgcttcgccggcggcatgttcgccctgggcgccgacggcagcagagccgacaaggccggccactacctggagctgggcgccgagatcgccagaacctgccacgagagctacgacagaaccgccctgaagctgggccccgagagcttcaagttcgacggcgccgtggaggccgtggccgtgagacaggccgagaagtactacatcctgagacccgaggtgatcgagacctactggtacctgtggagattcacccacgaccccagatacagacagtggggctgggaggccgccctggccatcgagaagtactgcagagtgaacggcggcttcagcggcgtgaaggacgtgtacagcagcacccccacccacgacgacgtgcagcagagcttcttcctggccgagaccctgaagtacctgtacctgctgttcagcggcgacgacctgctgcccctggaccactgggtgttcaacaccgaggcccaccccctgcccgtgctgcacctggccaacaccaccctgagcggcaaccccgccgtgagatag

SEQ ID NO: 87934 - DNA, 1128 bp, Artificial Sequence
  Description of Artificial Sequence: Synthetic coding sequence
atgggcctgcacgacgagttcctggacggccagagatggatcgaggacaacctggacttcagcgtgaacagcgaggtgagcgtgttcgaggtgaacatcagattcatcggcggcctgctggccgcctactacctgagcggcgaggagatcttcaagatcaaggccgtgcagctggccgagaagctgctgcccgccttcaacacccccaccggcatcccctgggccatggtgaacctgaagagcggcgtgggcagaaactggggctgggccagcgccggcagcagcatcctggccgagttcggcaccctgcacatggagttcatccacctgagctacctgaccggcgacctgacctactacaagaaggtgatgcacatcagaaagctgctgcagaagatggacagacccaacggcctgtaccccaactacctgaaccccagaaccggcagatggggccagtaccacaccagcgtgggcggcctgggcgacagcttctacgagtacctgctgaaggcctggctgatgagcgacaagaccgaccacgaggccagaaagatgtacgacgacgccatcgaggccatcgagaagcacctgatcaagaagagcagaggcggcctgaccttcatcggcgagtggaagaacggccacctggagaagaagatgggccacctggcctgcttcgccggcggcatgttcgccctgggcgccgacggcagcagagccgacaaggccggccactacctggagctgggcgccgagatcgccagaacctgccacgagagctacgacagaaccgccctgaagctgggccccgagagcttcaagttcgacggcgccgtggaggccgtggccgtgagacaggccgagaagtactacatcctgagacccgaggtgatcgagacctactggtacctgtggagattcacccacgaccccagatacagacagtggggctgggaggccgccctggccatcgagaagtactgcagagtgaacggcggcttcagcggcgtgaaggacgtgtacagcagcacccccacccacgacgacgtgcagcagagcttcttcctggccgagaccctgaagctggccagctaccacgagagaaccgtgttccccgccggctag

SEQ ID NO: 87935 - DNA, 615 bp, Artificial Sequence
  Description of Artificial Sequence: Synthetic coding sequence
tgaatcaagaagagcagaggcggcctgaccttcatcggcgagtggaagaacggccacctggagaagaagatgggccacctggcctgcttcgccggcggcatgttcgccctgggcgccgacggcagcagagccgacaaggccggccactacctggagctgggcgccgagatcgccagaacctgccacgagagctacgacagaaccgccctgaagctgggccccgagagcttcaagttcgacggcgccgtggaggccgtggccgtgagacaggccgagaagtactacatcctgagacccgaggtgatcgagacctactggtacctgtggagattcacccacgaccccagatacagacagtggggctgggaggccgccctggccatcgagaagtactgcagagtgaacggcggcttcagcggcgtgaaggacgtgtacagcagcacccccacccacgacgacgtgcagcagagcttcttcctggccgagaccctgaagtacctgtacctgctgttcagcggcgacgacctgctgcccctggaccactgggtgttcaacaccgaggcccaccccctgcccgtgctgcacctggccaacaccaccctgagcgagagctag

SEQ ID NO: 87936 - DNA, 294 bp, Artificial Sequence
  Description of Artificial Sequence: Synthetic coding sequence
gagaagtactgcagagtgaacggcggcttcagcggcgtgaaggacgtgtacagcagcacccccacccacgacgacgtgcagcagagcttcttcctggccgagaccctgaagtacctgtacctgctgttcagcggcgacgacctgctgcccctggaccactgggtgttcaacaccgaggcccaccccctgcccgtgctgcacctggccaacaccaccctgagcggcaccagccagggcatgagaagacagaacccctacttccaggtgctgtacctgtactaccccgacgactag

SEQ ID NO: 87937 - DNA, 1035 bp, Artificial Sequence
  Description of Artificial Sequence: Synthetic coding sequence
tgaatcagattcatcggcggcctgctggccgcctactacctgagcggcgaggagatcttcaagatcaaggccgtgcagctggccgagaagctgctgcccgccttcaacacccccaccggcatcccctgggccatggtgaacctgaagagcggcgtgggcagaaactggggctgggccagcgccggcagcagcatcctggccgagttcggcaccctgcacatggagttcatccacctgagctacctgaccggcgacctgacctactacaagaaggtgatgcacatcagaaagctgctgcagaagatggacagacccaacggcctgtaccccaactacctgaaccccagaaccggcagatggggccagtaccacaccagcgtgggcggcctgggcgacagcttctacgagtacctgctgaaggcctggctgatgagcgacaagaccgaccacgaggccagaaagatgtacgacgacgccatcgaggccatcgagaagcacctgatcaagaagagcagaggcggcctgaccttcatcggcgagtggaagaacggccacctggagaagaagatgggccacctggcctgcttcgccggcggcatgttcgccctgggcgccgacggcagcagagccgacaaggccggccactacctggagctgggcgccgagatcgccagaacctgccacgagagctacgacagaaccgccctgaagctgggccccgagagcttcaagttcgacggcgccgtggaggccgtggccgtgagacaggccgagaagtactacatcctgagacccgaggtgatcgagacctactggtacctgtggagattcacccacgaccccagatacagacagtggggctgggaggccgccctggccatcgagaagtactgcagagtgaacggcggcttcagcggcgtgaaggacgtgtacagcagcacccccacccacgacgacgtgcagcagagcttcttcctggccgagaccctgaagctggccagctaccacgagagaaccgtgttccccgccggctag

SEQ ID NO: 87938 - DNA, 2100 bp, Artificial Sequence
  Description of Artificial Sequence: Synthetic coding sequence
atggccgcctgcgagggcagaagaagcggcgccctgggcagcagccagagcgacttcctgaccccccccgtgggcggcgccccctgggccgtggccaccaccgtggtgatgtacccccccccccccccccccccccacagagacttcatcagcgtgaccctgagcttcggcgagaactacgacaacagcaagagctggagaagaagaagctgctggagaaagtggaagcagctgagcagactgcagagaaacatgatcctgttcctgctggccttcctgctgttctgcggcctgctgttctacatcaacctggccgaccactggaaggccctggccttcagactggaggaggagcagaagatgagacccgagatcgccggcctgaagcccgccaacccccccgtgctgcccgccccccagaaggccgacaccgaccccgagaacctgcccgagatcagcagccagaagacccagagacacatccagagaggccccccccacctgcagatcagaccccccagccaggacctgaaggacggcacccaggaggaggccaccaagagacaggaggcccccgtggaccccagacccgagggcgacccccagagaaccgtgatcagctggagaggcgccgtgatcgagcccgagcagggcaccgagctgcccagcagaagagccgaggtgcccaccaagccccccctgccccccgccagaacccagggcacccccgtgcacctgaactacagacagaagggcgtgatcgacgtgttcctgcacgcctggaagggctacagaaagttcgcctggggccacgacgagctgaagcccgtgagcagaagcttcagcgagtggttcggcctgggcctgaccctgatcgacgccctggacaccatgtggatcctgggcctgagaaaggagttcgaggaggccagaaagtgggtgagcaagaagctgcacttcgagaaggacgtggacgtgaacctgttcgagagcaccatcagaatcctgggcggcctgctgagcgcctaccacctgagcggcgacagcctgttcctgagaaaggccgaggacttcggcaacagactgatgcccgccttcagaacccccagcaagatcccctacagcgacgtgaacatcggcaccggcgtggcccacccccccagatggaccagcgacagcaccgtggccgaggtgaccagcatccagctggagttcagagagctgagcagactgaccggcgacaagaagttccaggaggccgtggagaaggtgacccagcacatccacggcctgagcggcaagaaggacggcctggtgcccatgttcatcaacacccacagcggcctgttcacccacctgggcgtgttcaccctgggcgccagagccgacagctactacgagtacctgctgaagcagtggatccagggcggcaagcaggagacccagctgctggaggactacgtggaggccatcgagggcgtgagaacccacctgctgagacacagcgagcccagcaagctgaccttcgtgggcgagctggcccacggcagattcagcgccaagatggaccacctggtgtgcttcctgcccggcaccctggccctgggcgtgtaccacggcctgcccgccagccacatggagctggcccaggagctgatggagacctgctaccagatgaacagacagatggagaccggcctgagccccgagatcgtgcacttcaacctgtacccccagcccggcagaagagacgtggaggtgaagcccgccgacagacacaacctgctgagacccgagaccgtggagagcctgttctacctgtacagagtgaccggcgacagaaagtaccaggactggggctgggagatcctgcagagcttcagcagattcaccagagtgcccagcggcggctacagcagcatcaacaacgtgcaggacccccagaagcccgagcccagagacaagatggagagcttcttcctgggcgagaccctgaagtacctgttcctgctgttcagcgacgaccccaacctgctgagcctggacgcctacgtgttcaacaccgaggcccaccccctgcccatctggacccccgcctag

SEQ ID NO: 87939 - DNA, 1209 bp, Artificial Sequence
  Description of Artificial Sequence: Synthetic coding sequence
atgtggatcctgggcctgagaaaggagttcgaggaggccagaaagtgggtgagcaagaagctgcacttcgagaaggacgtggacgtgaacctgttcgagagcaccatcagaatcctgggcggcctgctgagcgcctaccacctgagcggcgacagcctgttcctgagaaaggccgaggacttcggcaacagactgatgcccgccttcagaacccccagcaagatcccctacagcgacgtgaacatcggcaccggcgtggcccacccccccagatggaccagcgacagcaccgtggccgaggtgaccagcatccagctggagttcagagagctgagcagactgaccggcgacaagaagttccaggaggccgtggagaaggtgacccagcacatccacggcctgagcggcaagaaggacggcctggtgcccatgttcatcaacacccacagcggcctgttcacccacctgggcgtgttcaccctgggcgccagagccgacagctactacgagtacctgctgaagcagtggatccagggcggcaagcaggagacccagctgctggaggactacgtggaggccatcgagggcgtgagaacccacctgctgagacacagcgagcccagcaagctgaccttcgtgggcgagctggcccacggcagattcagcgccaagatggaccacctggtgtgcttcctgcccggcaccctggccctgggcgtgtaccacggcctgcccgccagccacatggagctggcccaggagctgatggagacctgctaccagatgaacagacagatggagaccggcctgagccccgagatcgtgcacttcaacctgtacccccagcccggcagaagagacgtggaggtgaagcccgccgacagacacaacctgctgagacccgagaccgtggagagcctgttctacctgtacagagtgaccggcgacagaaagtaccaggactggggctgggagatcctgcagagcttcagcagattcaccagagtgcccagcggcggctacagcagcatcaacaacgtgcaggacccccagaagcccgagcccagagacaagatggagagcttcttcctgggcgagaccctgaagtacctgttcctgctgttcagcgacgaccccaacctgctgagcctggacgcctacgtgttcaacaccgaggcccaccccctgcccatctggacccccgcctag

SEQ ID NO: 87940 - DNA, 2118 bp, Artificial Sequence
  Description of Artificial Sequence: Synthetic coding sequence
tgaccctgggccgtggccaccaccgtggtgatgtacccccccccccccccccccccccacagagacttcatcagcgtgaccctgagcttcggcgagaactacgacaacagcaagagctggagaagaagaagctgctggagaaagtggaagcagctgagcagactgcagagaaacatgatcctgttcctgctggccttcctgctgttctgcggcctgctgttctacatcaacctggccgaccactggaaggccctggccttcagactggaggaggagcagaagatgagacccgagatcgccggcctgaagcccgccaacccccccgtgctgcccgccccccagaaggccgacaccgaccccgagaacctgcccgagatcagcagccagaagacccagagacacatccagagaggccccccccacctgcagatcagaccccccagccaggacctgaaggacggcacccaggaggaggccaccaagagacaggaggcccccgtggaccccagacccgagggcgacccccagagaaccgtgatcagctggagaggcgccgtgatcgagcccgagcagggcaccgagctgcccagcagaagagccgaggtgcccaccaagccccccctgccccccgccagaacccagggcacccccgtgcacctgaactacagacagaagggcgtgatcgacgtgttcctgcacgcctggaagggctacagaaagttcgcctggggccacgacgagctgaagcccgtgagcagaagcttcagcgagtggttcggcctgggcctgaccctgatcgacgccctggacaccatgtggatcctgggcctgagaaaggagttcgaggaggccagaaagtgggtgagcaagaagctgcacttcgagaaggacgtggacgtgaacctgttcgagagcaccatcagaatcctgggcggcctgctgagcgcctaccacctgagcggcgacagcctgttcctgagaaaggccgaggacttcggcaacagactgatgcccgccttcagaacccccagcaagatcccctacagcgacgtgaacatcggcaccggcgtggcccacccccccagatggaccagcgacagcaccgtggccgaggtgaccagcatccagctggagttcagagagctgagcagactgaccggcgacaagaagttccaggaggccgtggagaaggtgacccagcacatccacggcctgagcggcaagaaggacggcctggtgcccatgttcatcaacacccacagcggcctgttcacccacctgggcgtgttcaccctgggcgccagagccgacagctactacgagtacctgctgaagcagtggatccagggcggcaagcaggagacccagctgctggaggactacgtggaggccatcgagggcgtgagaacccacctgctgagacacagcgagcccagcaagctgaccttcgtgggcgagctggcccacggcagattcagcgccaagatggaccacctggtgtgcttcctgcccggcaccctggccctgggcgtgtaccacggcctgcccgccagccacatggagctggcccaggagctgatggagacctgctaccagatgaacagacagatggagaccggcctgagccccgagatcgtgcacttcaacctgtacccccagcccggcagaagagacgtggaggtgaagcccgccgacagacacaacctgctgagacccgagaccgtggagagcctgttctacctgtacagagtgaccggcgacagaaagtaccaggactggggctgggagatcctgcagagcttcagcagattcaccagagtgagcacctgccccagacccgcctggagcagaccccccggccacagacacggctgggccgtgggcctgagactggcccccctgctggtggtggccgtgacctggatcagagagggcagagcctgcagaagcctgggcgtggccaccctgcagctgggcggccccggcatccccatccccaccgagctgcacggctgcggcacccagagcacctggagaggctgggcccccctgatcttcatcagccagggcctgagcagagagggcctgtgctgcggccccagcatcccccccgtgtag

SEQ ID NO: 87941 - DNA, 3435 bp, Artificial Sequence
  Description of Artificial Sequence: Synthetic coding sequence
atgaagctgagcagacagttcaccgtgttcggcagcgccatcttctgcgtggtgatcttcagcctgtacctgatgctggacagaggccacctggactaccccagaaaccccagaagagagggcagcttcccccagggccagctgagcatgctgcaggagaagatcgaccacctggagagactgctggccgagaacaacgagatcatcagcaacatcagagacagcgtgatcaacctgagcgagagcgtggaggacggccccaagagcagccagagcaacttcagccagggcgccggcagccacctgctgcccagccagctgagcctgagcgtggacaccgccgactgcctgttcgccagccagagcggcagccacaacagcgacgtgcagatgctggacgtgtacagcctgatcagcttcgacaaccccgacggcggcgtgtggaagcagggcttcgacatcacctacgagagcaacgagtgggacaccgagcccctgcaggtgttcgtggtgccccacagccacaacgaccccggctggctgaagaccttcaacgactacttcagagacaagacccagtacatcttcaacaacatggtgctgaagctgaaggaggacagcagaagaaagttcatctggagcgagatcagctacctgagcaagtggtgggacatcatcgacatccagaagaaggacgccgtgaagagcctgatcgagaacggccagctggagatcgtgaccggcggctgggtgatgcccgacgaggccaccccccactacttcgccctgatcgaccagctgatcgagggccaccagtggctggagaacaacatcggcgtgaagcccagaagcggctgggccatcgaccccttcggccacagccccaccatggcctacctgctgaacagagccggcctgagccacatgctgatccagagagtgcactacgccgtgaagaagcacttcgccctgcacaagaccctggagttcttctggagacagaactgggacctgggcagcgtgaccgacatcctgtgccacatgatgcccttctacagctacgacatcccccacacctgcggccccgaccccaagatctgctgccagttcgacttcaagagactgcccggcggcagattcggctgcccctggggcgtgccccccgagaccatccaccccggcaacgtgcagagcagagccagaatgctgctggaccagtacagaaagaagagcaagctgttcagaaccaaggtgctgctggcccccctgggcgacgacttcagatactgcgagtacaccgagtgggacctgcagttcaagaactaccagcagctgttcgactacatgaacagccagagcaagttcaaggtgaagatccagttcggcaccctgagcgacttcttcgacgccctggacaaggccgacgagacccagagagacaagggccagagcatgttccccgtgctgagcggcgacttcttcacctacgccgacagagacgaccactactggagcggctacttcaccagcagacccttctacaagagaatggacagaatcatggagagccacctgagagccgccgagatcctgtactacttcgccctgagacaggcccacaagtacaagatcaacaagttcctgagcagcagcctgtacaccgccctgaccgaggccagaagaaacctgggcctgttccagcaccacgacgccatcaccggcaccgccaaggactgggtggtggtggactacggcaccagactgttccacagcctgatggtgctggagaagatcatcggcaacagcgccttcctgctgatcctgaaggacaagctgacctacgacagctacagccccgacaccttcctggagatggacctgaagcagaagagccaggacagcctgccccagaagaacatcatcagactgagcgccgagcccagatacctggtggtgtacaaccccctggagcaggacagaatcagcctggtgagcgtgtacgtgagcagccccaccgtgcaggtgttcagcgccagcggcaagcccgtggaggtgcaggtgagcgccgtgtgggacaccgccaacaccatcagcgagaccgcctacgagatcagcttcagagcccacatcccccccctgggcctgaaggtgtacaagatcctggagagcgccagcagcaacagccacctggccgactacgtgctgtacaagaacaaggtggaggacagcggcatcttcaccatcaagaacatgatcaacaccgaggagggcatcaccctggagaacagcttcgtgctgctgagattcgaccagaccggcctgatgaagcagatgatgaccaaggaggacggcaagcaccacgaggtgaacgtgcagttcagctggtacggcaccaccatcaagagagacaagagcggcgcctacctgttcctgcccgacggcaacgccaagccctacgtgtacaccaccccccccttcgtgagagtgacccacggcagaatctacagcgaggtgacctgcttcttcgaccacgtgacccacagagtgagactgtaccacatccagggcatcgagggccagagcgtggaggtgagcaacatcgtggacatcagaaaggtgtacaacagagagatcgccatgaagatcagcagcgacatcaagagccagaacagattctacaccgacctgaacggctaccagatccagcccagaatgaccctgagcaagctgcccctgcaggccaacgtgtaccccatgaccaccatggcctacatccaggacgccaagcacagactgaccctgctgagcgcccagagcctgggcgtgagcagcctgaacagcggccagatcgaggtgatcatggacagaagactgatgcaggacgacaacagaggcctggagcagggcatccaggacaacaagatcaccgccaacctgttcagaatcctgctggagaagagaagcgccgtgaacaccgaggaggagaagaagagcgtgagctaccccagcctgctgagccacatcaccagcagcctgatgaaccaccccgtgatccccatggccaacaagttcagcagccccaccctggagctgcagggcgagttcagccccctgcagagcagcctgccctgcgacatccacctggtgaacctgagaaccatccagagcaaggtgggcaacggccacagcaacgaggccgccctgatcctgcacagaaagggcttcgactgcagattcagcagcaagggcaccggcctgttctgcagcaccacccagggcaagatcctggtgcagaagctgctgaacaagttcatcgtggagagcctgacccccagcagcctgagcctgatgcacagcccccccggcacccagaacatcagcgagatcaacctgagccccatggagatcagcaccttcagaatccagctgagatag

SEQ ID NO: 87942 - DNA, 3453 bp, Artificial Sequence
  Description of Artificial Sequence: Synthetic coding sequence
atgaagctgaagaagcaggtgaccgtgtgcggcgccgccatcttctgcgtggccgtgttcagcctgtacctgatgctggacagagtgcagcacgaccccaccagacaccagaacggcggcaacttccccagaagccagatcagcgtgctgcagaacagaatcgagcagctggagcagctgctggaggagaaccacgagatcatcagccacatcaaggacagcgtgctggagctgaccgccaacgccgagggcccccccgccatgctgccctactacaccgtgaacggcagctgggtggtgccccccgagcccagacccagcttcttcagcatcagcccccaggactgccagttcgccctgggcggcagaggccagaagcccgagctgcagatgctgaccgtgagcgaggagctgcccttcgacaacgtggacggcggcgtgtggagacagggcttcgacatcagctacgacccccacgactgggacgccgaggacctgcaggtgttcgtggtgccccacagccacaacgaccccggctggatcaagaccttcgacaagtactacaccgagcagacccagcacatcctgaacagcatggtgagcaagctgcaggaggaccccagaagaagattcctgtgggccgaggtgagcttcttcgccaagtggtgggacaacatcaacgtgcagaagagagccgccgtgagaagactggtgggcaacggccagctggagatcgccaccggcggctgggtgatgcccgacgaggccaacagccactacttcgccctgatcgaccagctgatcgagggccaccagtggctggagagaaacctgggcgccacccccagaagcggctgggccgtggaccccttcggctacagcagcaccatgccctacctgctgagaagagccaacctgaccagcatgctgatccagagagtgcactacgccatcaagaagcacttcgccgccacccacagcctggagttcatgtggagacagacctgggacagcgacagcagcaccgacatcttctgccacatgatgcccttctacagctacgacgtgccccacacctgcggccccgaccccaagatctgctgccagttcgacttcaagagactgcccggcggcagaatcaactgcccctggaaggtgccccccagagccatcaccgaggccaacgtggccgagagagccgccctgctgctggaccagtacagaaagaagagccagctgttcagaagcaacgtgctgctggtgcccctgggcgacgacttcagatacgacaagccccaggagtgggacgcccagttcttcaactaccagagactgttcgacttcttcaacagcagacccaacctgcacgtgcaggcccagttcggcaccctgagcgactacttcgacgccctgtacaagagaaccggcgtggagcccggcgccagaccccccggcttccccgtgctgagcggcgacttcttcagctacgccgacagagaggaccactactggaccggctactacaccagcagacccttctacaagagcctggacagagtgctggaggcccacctgagaggcgccgaggtgctgtacagcctggccgccgcccacgccagaagaagcggcctggccggcagataccccctgagcgacttcaccctgctgaccgaggccagaagaaccctgggcctgttccagcaccacgacgccatcaccggcaccgccaaggaggccgtggtggtggactacggcgtgagactgctgagaagcctggtgaacctgaagcaggtgatcatccacgccgcccactacctggtgctgggcgacaaggagacctaccacttcgaccccgaggcccccttcctgcaggtggacgacaccagactgagccacgacgccctgcccgagagaaccgtgatccagctggacagcagccccagattcgtggtgctgttcaaccccctggagcaggagagattcagcatggtgagcctgctggtgaacagccccagagtgagagtgctgagcgaggagggccagcccctggccgtgcagatcagcgcccactggagcagcgccaccgaggccgtgcccgacgtgtaccaggtgagcgtgcccgtgagactgcccgccctgggcctgggcgtgctgcagctgcagctgggcctggacggccacagaaccctgcccagcagcgtgagaatctacctgcacggcagacagctgagcgtgagcagacacgaggccttccccctgagagtgatcgacagcggcaccagcgacttcgccctgagcaacagatacatgcaggtgtggttcagcggcctgaccggcctgctgaagagcatcagaagagtggacgaggagcacgagcagcaggtggacatgcaggtgctggtgtacggcaccagaaccagcaaggacaagagcggcgcctacctgttcctgcccgacggcgaggccaagccctacgtgcccaaggagccccccgtgctgagagtgaccgagggccccttcttcagcgaggtggtggcctactacgagcacatccaccaggccgtgagactgtacaacctgcccggcgtggagggcctgagcctggacatcagcagcctggtggacatcagagactacgtgaacaaggagctggccctgcacatccacaccgacatcgacagccagggcatcttcttcaccgacctgaacggcttccaggtgcagcccagaagatacctgaagaagctgcccctgcaggccaacttctaccccatgcccgtgatggcctacatccaggacgcccagaagagactgaccctgcacaccgcccaggccctgggcgtgagcagcctgaaggacggccagctggaggtgatcctggacagaagactgatgcaggacgacaacagaggcctgggccagggcctgaaggacaacaagagaacctgcaacagattcagactgctgctggagagaagaaccgtgggcagcgaggtgcaggacagccacagcaccagctaccccagcctgctgagccacctgaccagcatgtacctgaacgcccccgccctggccctgcccgtggccagaatgcagctgcccggccccggcctgagaagcttccaccccctggccagcagcctgccctgcgacttccacctgctgaacctgagaaccctgcaggccgaggaggacaccctgcccagcgccgagaccgccctgatcctgcacagaaagggcttcgactgcggcctggaggccaagaacctgggcttcaactgcaccaccagccagggcaaggtggccctgggcagcctgttccacggcctggacgtggtgttcctgcagcccaccagcctgaccctgctgtaccccctggccagccccagcaacagcaccgacgtgtacctggagcccatggagatcgccaccttcagactgagactgggctag

SEQ ID NO: 87943 - DNA, 1023 bp, Artificial Sequence
  Description of Artificial Sequence: Synthetic coding sequence
atgcaggtgtggttcagcggcctgaccggcctgctgaagccctacgtgcccaaggagccccccgtgctgagagtgaccgagggccccttcttcagcgaggtggtggcctactacgagcacatccaccaggccgtgagactgtacaacctgcccggcgtggagggcctgagcctggacatcagcagcctggtggacatcagagactacgtgaacaaggagctggccctgcacatccacaccgacatcgacagccagggcatcttcttcaccgacctgaacggcttccaggtgcagcccagaagatacctgaagaagctgcccctgcaggccaacttctaccccatgcccgtgatggcctacatccaggacgcccagaagagactgaccctgcacaccgcccaggccctgggcgtgagcagcctgaaggacggccagctggaggtgatcctggacagaagactgatgcaggacgacaacagaggcctgggccagggcctgaaggacaacaagagaacctgcaacagattcagactgctgctggagagaagaaccgtgggcagcgaggtgcaggacagccacagcaccagctaccccagcctgctgagccacctgaccagcatgtacctgaacgcccccgccctggccctgcccgtggccagaatgcagctgcccggccccggcctgagaagcttccaccccctggccagcagcctgccctgcgacttccacctgctgaacctgagaaccctgcaggccgaggaggacaccctgcccagcgccgagaccgccctgatcctgcacagaaagggcttcgactgcggcctggaggccaagaacctgggcttcaactgcaccaccagccagggcaaggtggccctgggcagcctgttccacggcctggacgtggtgttcctgcagcccaccagcctgaccctgctgtaccccctggccagccccagcaacagcaccgacgtgtacctggagcccatggagatcgccaccttcagactgagactgggctag

SEQ ID NO: 87944 - DNA, 1977 bp, Artificial Sequence
  Description of Artificial Sequence: Synthetic coding sequence
atgaccagcgacatgaccagccccagaagcggcatgcccagcagcagcaccaccaacggcagcctgaccagcagcaccgccggcctgaccagcatgtgcagaggcgccgaggtgctgtacagcctggccgccgcccacgccagaagaagcggcctggccggcagataccccctgagcgacttcaccctgctgaccgaggccagaagaaccctgggcctgttccagcaccacgacgccatcaccggcaccgccaaggaggccgtggtggtggactacggcgtgagactgctgagaagcctggtgaacctgaagcaggtgatcatccacgccgcccactacctggtgctgggcgacaaggagacctaccacttcgaccccgaggcccccttcctgcaggtggacgacaccagactgagccacgacgccctgcccgagagaaccgtgatccagctggacagcagccccagattcgtggtgctgttcaaccccctggagcaggagagattcagcatggtgagcctgctggtgaacagccccagagtgagagtgctgagcgaggagggccagcccctggccgtgcagatcagcgcccactggagcagcgccaccgaggccgtgcccgacgtgtaccaggtgagcgtgcccgtgagactgcccgccctgggcctgggcgtgctgcagctgcagctgggcctggacggccacagaaccctgcccagcagcgtgagaatctacctgcacggcagacagctgagcgtgagcagacacgaggccttccccctgagagtgatcgacagcggcaccagcgacttcgccctgagcaacagatacatgcaggtgtggttcagcggcctgaccggcctgctgaagagcatcagaagagtggacgaggagcacgagcagcaggtggacatgcaggtgctggtgtacggcaccagaaccagcaaggacaagagcggcgcctacctgttcctgcccgacggcgaggccaagccctacgtgcccaaggagccccccgtgctgagagtgaccgagggccccttcttcagcgaggtggtggcctactacgagcacatccaccaggccgtgagactgtacaacctgcccggcgtggagggcctgagcctggacatcagcagcctggtggacatcagagactacgtgaacaaggagctggccctgcacatccacaccgacatcgacagccagggcatcttcttcaccgacctgaacggcttccaggtgcagcccagaagatacctgaagaagctgcccctgcaggccaacttctaccccatgcccgtgatggcctacatccaggacgcccagaagagactgaccctgcacaccgcccaggccctgggcgtgagcagcctgaaggacggccagctggaggtgatcctggacagaagactgatgcaggacgacaacagaggcctgggccagggcctgaaggacaacaagagaacctgcaacagattcagactgctgctggagagaagaaccgtgggcagcgaggtgcaggacagccacagcaccagctaccccagcctgctgagccacctgaccagcatgtacctgaacgcccccgccctggccctgcccgtggccagaatgcagctgcccggccccggcctgagaagcttccaccccctggccagcagcctgccctgcgacttccacctgctgaacctgagaaccctgcaggccgaggaggacaccctgcccagcgccgagaccgccctgatcctgcacagaaagggcttcgactgcggcctggaggccaagaacctgggcttcaactgcaccaccagccagggcaaggtggccctgggcagcctgttccacggcctggacgtggtgttcctgcagcccaccagcctgaccctgctgtaccccctggccagccccagcaacagcaccgacgtgtacctggagcccatggagatcgccaccttcagactgagactgggctag

SEQ ID NO: 87945 - DNA, 219 bp, Artificial Sequence
  Description of Artificial Sequence: Synthetic coding sequence
atgaagctgaagaagcaggtgaccgtgtgcggcgccgccatcttctgcgtggccgtgttcagcctgtacctgatgctggacagagtgcagcacgaccccaccagacaccagaacggcggcaacttccccagaagccagatcagcgtgctgcagaacagaatcgagcagctggagcagctgctggaggagaaccacgagatcatcagccacatcaagtag

SEQ ID NO: 87946 - DNA, 153 bp, Artificial Sequence
  Description of Artificial Sequence: Synthetic coding sequence
atgaagctgaagaagcaggtgaccgtgtgcggcgccgccatcttctgcgtggccgtgttcagcctgtacctgatgctggacagagtgcagcacgaccccaccagacaccagaacggcggcaacttccccagaagccagatcagcgtgctgtag

SEQ ID NO: 87947 - DNA, 3192 bp, Artificial Sequence
  Description of Artificial Sequence: Synthetic coding sequence
atgctgccctactacaccgtgaacggcagctgggtggtgccccccgagcccagacccagcttcttcagcatcagcccccaggactgccagttcgccctgggcggcagaggccagaagcccgagctgcagatgctgaccgtgagcgaggagctgcccttcgacaacgtggacggcggcgtgtggagacagggcttcgacatcagctacgacccccacgactgggacgccgaggacctgcaggtgttcgtggtgccccacagccacaacgaccccggctggatcaagaccttcgacaagtactacaccgagcagacccagcacatcctgaacagcatggtgagcaagctgcaggaggaccccagaagaagattcctgtgggccgaggtgagcttcttcgccaagtggtgggacaacatcaacgtgcagaagagagccgccgtgagaagactggtgggcaacggccagctggagatcgccaccggcggctgggtgatgcccgacgaggccaacagccactacttcgccctgatcgaccagctgatcgagggccaccagtggctggagagaaacctgggcgccacccccagaagcggctgggccgtggaccccttcggctacagcagcaccatgccctacctgctgagaagagccaacctgaccagcatgctgatccagagagtgcactacgccatcaagaagcacttcgccgccacccacagcctggagttcatgtggagacagacctgggacagcgacagcagcaccgacatcttctgccacatgatgcccttctacagctacgacgtgccccacacctgcggccccgaccccaagatctgctgccagttcgacttcaagagactgcccggcggcagaatcaactgcccctggaaggtgccccccagagccatcaccgaggccaacgtggccgagagagccgccctgctgctggaccagtacagaaagaagagccagctgttcagaagcaacgtgctgctggtgcccctgggcgacgacttcagatacgacaagccccaggagtgggacgcccagttcttcaactaccagagactgttcgacttcttcaacagcagacccaacctgcacgtgcaggcccagttcggcaccctgagcgactacttcgacgccctgtacaagagaaccggcgtggagcccggcgccagaccccccggcttccccgtgctgagcggcgacttcttcagctacgccgacagagaggaccactactggaccggctactacaccagcagacccttctacaagagcctggacagagtgctggaggcccacctgagaggcgccgaggtgctgtacagcctggccgccgcccacgccagaagaagcggcctggccggcagataccccctgagcgacttcaccctgctgaccgaggccagaagaaccctgggcctgttccagcaccacgacgccatcaccggcaccgccaaggaggccgtggtggtggactacggcgtgagactgctgagaagcctggtgaacctgaagcaggtgatcatccacgccgcccactacctggtgctgggcgacaaggagacctaccacttcgaccccgaggcccccttcctgcaggtggacgacaccagactgagccacgacgccctgcccgagagaaccgtgatccagctggacagcagccccagattcgtggtgctgttcaaccccctggagcaggagagattcagcatggtgagcctgctggtgaacagccccagagtgagagtgctgagcgaggagggccagcccctggccgtgcagatcagcgcccactggagcagcgccaccgaggccgtgcccgacgtgtaccaggtgagcgtgcccgtgagactgcccgccctgggcctgggcgtgctgcagctgcagctgggcctggacggccacagaaccctgcccagcagcgtgagaatctacctgcacggcagacagctgagcgtgagcagacacgaggccttccccctgagagtgatcgacagcggcaccagcgacttcgccctgagcaacagatacatgcaggtgtggttcagcggcctgaccggcctgctgaagagcatcagaagagtggacgaggagcacgagcagcaggtggacatgcaggtgctggtgtacggcaccagaaccagcaaggacaagagcggcgcctacctgttcctgcccgacggcgaggccaagccctacgtgcccaaggagccccccgtgctgagagtgaccgagggccccttcttcagcgaggtggtggcctactacgagcacatccaccaggccgtgagactgtacaacctgcccggcgtggagggcctgagcctggacatcagcagcctggtggacatcagagactacgtgaacaaggagctggccctgcacatccacaccgacatcgacagccagggcatcttcttcaccgacctgaacggcttccaggtgcagcccagaagatacctgaagaagctgcccctgcaggccaacttctaccccatgcccgtgatggcctacatccaggacgcccagaagagactgaccctgcacaccgcccaggccctgggcgtgagcagcctgaaggacggccagctggaggtgatcctggacagaagactgatgcaggacgacaacagaggcctgggccagggcctgaaggacaacaagagaacctgcaacagattcagactgctgctggagagaagaaccgtgggcagcgaggtgcaggacagccacagcaccagctaccccagcctgctgagccacctgaccagcatgtacctgaacgcccccgccctggccctgcccgtggccagaatgcagctgcccggccccggcctgagaagcttccaccccctggccagcagcctgccctgcgacttccacctgctgaacctgagaaccctgcaggccgaggaggacaccctgcccagcgccgagaccgccctgatcctgcacagaaagggcttcgactgcggcctggaggccaagaacctgggcttcaactgcaccaccagccagggcaaggtggccctgggcagcctgttccacggcctggacgtggtgttcctgcagcccaccagcctgaccctgctgtaccccctggccagccccagcaacagcaccgacgtgtacctggagcccatggagatcgccaccttcagactgagactgggctag

SEQ ID NO: 87948 - DNA, 231 bp, Artificial Sequence
  Description of Artificial Sequence: Synthetic coding sequence
atgaagctgaagaagcaggtgaccgtgtgcggcgccgccatcttctgcgtggccgtgttcagcctgtacctgatgctggacagagtgcagcacgaccccaccagacaccagaacggcggcaacttccccagaagccagatcagcgtgctgcagaacagaatcgagcagctggagcagctgctggaggagaaccacgagatcatcagccacatcaaggacagcgtgctgtag

SEQ ID NO: 87949 - DNA, 363 bp, Artificial Sequence
  Description of Artificial Sequence: Synthetic coding sequence
atgaagctgaagaagcaggtgaccgtgtgcggcgccgccatcttctgcgtggccgtgttcagcctgtacctgatgctggacagagtgcagcacgaccccaccagacaccagaacggcggcaacttccccagaagccagatcagcgtgctgcagaacagaatcgagcagctggagcagctgctggaggagaaccacgagatcatcagccacatcaaggacagcgtgctggagctgaccgccaacgccgagggcccccccgccatgctgccctactacaccgtgaacggcagctgggtggtgccccccgagcccagacccagcttcttcagcatcagcccccaggactgccagttcgccctgtag

SEQ ID NO: 87950 - DNA, 3123 bp, Artificial Sequence
  Description of Artificial Sequence: Synthetic coding sequence
atggccgccgcccccgccctgaagcactggagaaccaccctggagagagtggagaagttcgtgagccccctgtacttcaccgactgcaacctgagaggcagactgttcggcgccagctgccccgtggccgtgctgagcagcttcctgacccccgagagactgccctaccaggaggccgtgcagagagacttcagacccgcccaggtgggcgacagcttcggccccacctggtggacctgctggttcagagtggagctgaccatccccgaggcctgggtgggccaggaggtgcacctgtgctgggagagcgacggcgagggcctggtgtggagagacggcgagcccgtgcagggcctgaccaaggagggcgagaagaccagctacgtgctgaccgacagactgggcgagagagaccccagaagcctgaccctgtacgtggaggtggcctgcaacggcctgctgggcgccggcaagggcagcatgatcgccgcccccgaccccgagaagatgttccagctgagcagagccgagctggccgtgttccacagagacgtgcacatgctgctggtggacctggagctgctgctgggcatcgccaagggcctgggcaaggacaaccagagaagcttccaggccctgtacaccgccaaccagatggtgaacgtgtgcgaccccgcccagcccgagaccttccccgtggcccaggccctggccagcagattcttcggccagcacggcggcgagagccagcacaccatccacgccaccggccactgccacatcgacaccgcctggctgtggcccttcaaggagaccgtgagaaagtgcgccagaagctgggtgaccgccctgcagctgatggagagaaaccccgagttcatcttcgcctgcagccaggcccagcagctggagtgggtgaagagcagataccccggcctgtacagcagaatccaggagttcgcctgcagaggccagttcgtgcccgtgggcggcacctgggtggagatggacggcaacctgcccagcggcgaggccatggtgagacagttcctgcagggccagaacttcttcctgcaggagttcggcaagatgtgcagcgagttctggctgcccgacaccttcggctacagcgcccagctgccccagatcatgcacggctgcggcatcagaagattcctgacccagaagctgagctggaacctggtgaacagcttcccccaccacaccttcttctgggagggcctggacggcagcagagtgctggtgcacttcccccccggcgacagctacggcatgcagggcagcgtggaggaggtgctgaagaccgtggccaacaacagagacaagggcagagccaaccacagcgccttcctgttcggcttcggcgacggcggcggcggccccacccagaccatgctggacagactgaagagactgagcaacaccgacggcctgcccagagtgcagctgagcagccccagacagctgttcagcgccctggagagcgacagcgagcagctgtgcacctgggtgggcgagctgttcctggagctgcacaacggcacctacaccacccacgcccagatcaagaagggcaacagagagtgcgagagaatcctgcacgacgtggagctgctgagcagcctggccctggccagaagcgcccagttcctgtaccccgccgcccagctgcagcacctgtggagactgctgctgctgaaccagttccacgacgtggtgaccggcagctgcatccagatggtggccgaggaggccatgtgccactacgaggacatcagaagccacggcaacaccctgctgagcgccgccgccgccgccctgtgcgccggcgagcccggccccgagggcctgctgatcgtgaacaccctgccctggaagagaatcgaggtgatggccctgcccaagcccggcggcgcccacagcctggccctggtgaccgtgcccagcatgggctacgcccccgtgcccccccccaccagcctgcagcccctgctgccccagcagcccgtgttcgtggtgcaggagaccgacggcagcgtgaccctggacaacggcatcatcagagtgaagctggaccccaccggcagactgaccagcctggtgctggtggccagcggcagagaggccatcgccgagggcgccgtgggcaaccagttcgtgctgttcgacgacgtgcccctgtactgggacgcctgggacgtgatggactaccacctggagaccagaaagcccgtgctgggccaggccggcaccctggccgtgggcaccgagggcggcctgagaggcagcgcctggttcctgctgcagatcagccccaacagcagactgagccaggaggtggtgctggacgtgggctgcccctacgtgagattccacaccgaggtgcactggcacgaggcccacaagttcctgaaggtggagttccccgccagagtgagaagcagccaggccacctacgagatccagttcggccacctgcagagacccacccactacaacaccagctgggactgggccagattcgaggtgtgggcccacagatggatggacctgagcgagcacggcttcggcctggccctgctgaacgactgcaagtacggcgccagcgtgagaggcagcatcctgagcctgagcctgctgagagcccccaaggcccccgacgccaccgccgacaccggcagacacgagttcacctacgccctgatgccccacaagggcagcttccaggacgccggcgtgatccaggccgcctacagcctgaacttccccctgctggccctgcccgcccccagccccgcccccgccaccagctggagcgccttcagcgtgagcagccccgccgtggtgctggagaccgtgaagcaggccgagagcagcccccagagaagaagcctggtgctgagactgtacgaggcccacggcagccacgtggactgctggctgcacctgagcctgcccgtgcaggaggccatcctgtgcgacctgctggagagacccgaccccgccggccacctgaccctgagagacaacagactgaagctgaccttcagccccttccaggtgctgagcctgctgctggtgctgcagccccccccccactag

SEQ ID NO: 87951 - DNA, 630 bp, Artificial Sequence
  Description of Artificial Sequence: Synthetic coding sequence
atggccgccgcccccgccctgaagcactggagaaccaccctggagagagtggagaagttcgtgagccccctgtacttcaccgactgcaacctgagaggcagactgttcggcgccagctgccccgtggccgtgctgagcagcttcctgacccccgagagactgccctaccaggaggccgtgcagagagacttcagacccgcccaggtgggcgacagcttcggccccacctggtggacctgctggttcagagtggagctgaccatccccgaggcctgggtgggccaggaggtgcacctgtgctgggagagcgacggcgagggcctggtgtggagagacggcgagcccgtgcagggcctgaccaaggagggcgagaagaccagctacgtgctgaccgacagactgggcgagagagaccccagaagcctgaccctgtacgtggaggtggcctgcaacggcctgctgggcgccggcaagggcagcatgatcgccgcccccgaccccgagaagatgttccagctgagcagagccgagctggccgtgttccacagagacgtgcacatgctgctggtggacctggagctgctgctgggcatcgccaagcccggcttcggccccagcaagagactgtag

SEQ ID NO: 87952 - DNA, 2910 bp, Artificial Sequence
  Description of Artificial Sequence: Synthetic coding sequence
atggccgaggacgacccctacctgggcagacccgagcagatgttccacctggaccccagcctgacccacaccatcttcaaccccgaggtgttccagccccagatggccctgcccaccgccgacggcccctacctgcagatcctggagcagcccaagcagagaggcttcagattcagatacgtgtgcgagggccccagccacggcggcctgcccggcgccagcagcgagaagaacaagaagagctacccccaggtgaagatctgcaactacgtgggccccgccaaggtgatcgtgcagctggtgaccaacggcaagaacatccacctgcacgcccacagcctggtgggcaagcactgcgaggacggcatctgcaccgtgaccgccggccccaaggacatggtggtgggcttcgccaacctgggcatcctgcacgtgaccaagaagaaggtgttcgagaccctggaggccagaatgaccgaggcctgcatcagaggctacaaccccggcctgctggtgcaccccgacctggcctacctgcaggccgagggcggcggcgacagacagctgggcgacagagagaaggagctgatcagacaggccgccctgcagcagaccaaggagatggacctgagcgtggtgagactgatgttcaccgccttcctgcccgacagcaccggcagcttcaccagaagactggagcccgtggtgagcgacgccatctacgacagcaaggcccccaacgccagcaacctgaagatcgtgagaatggacagaaccgccggctgcgtgaccggcggcgaggagatctacctgctgtgcgacaaggtgcagaaggacgacatccagatcagattctacgaggaggaggagaacggcggcgtgtgggagggcttcggcgacttcagccccaccgacgtgcacagacagttcgccatcgtgttcaagacccccaagtacaaggacatcaacatcaccaagcccgccagcgtgttcgtgcagctgagaagaaagagcgacctggagaccagcgagcccaagcccttcctgtactaccccgagatcaaggacaaggaggaggtgcagagaaagagacagaagctgatgcccaacttcagcgacagcttcggcggcggcagcggcgccggcgccggcggcggcggcatgttcggcagcggcggcggcggcggcggcaccggcagcaccggccccggctacagcttcccccactacggcttccccacctacggcggcatcaccttccaccccggcaccaccaagagcaacgccggcatgaagcacggcaccatggacaccgagagcaagaaggaccccgagggctgcgacaagagcgacgacaagaacaccgtgaacctgttcggcaaggtgatcgagaccaccgagcaggaccaggagcccagcgaggccaccgtgggcaacggcgaggtgaccctgacctacgccaccggcaccaaggaggagagcgccggcgtgcaggacaacctgttcctggagaaggccatgcagctggccaagagacacgccaacgccctgttcgactacgccgtgaccggcgacgtgaagatgctgctggccgtgcagagacacctgaccgccgtgcaggacgagaacggcgacagcgtgctgcacctggccatcatccacctgcacagccagctggtgagagacctgctggaggtgaccagcggcctgatcagcgacgacatcatcaacatgagaaacgacctgtaccagacccccctgcacctggccgtgatcaccaagcaggaggacgtggtggaggacctgctgagagccggcgccgacctgagcctgctggacagactgggcaacagcgtgctgcacctggccgccaaggagggccacgacaaggtgctgagcatcctgctgaagcacaagaaggccgccctgctgctggaccaccccaacggcgacggcctgaacgccatccacctggccatgatgagcaacagcctgccctgcctgctgctgctggtggccgccggcgccgacgtgaacgcccaggagcagaagagcggcagaaccgccctgcacctggccgtggagcacgacaacatcagcctggccggctgcctgctgctggagggcgacgcccacgtggacagcaccacctacgacggcaccacccccctgcacatcgccgccggcagaggcagcaccagactggccgccctgctgaaggccgccggcgccgaccccctggtggagaacttcgagcccctgtacgacctggacgacagctgggagaacgccggcgaggacgagggcgtggtgcccggcaccacccccctggacatggccaccagctggcaggtgttcgacatcctgaacggcaagccctacgagcccgagttcaccagcgacgacctgctggcccagggcgacatgaagcagctggccgaggacgtgaagctgcagctgtacaagctgctggagatccccgaccccgacaagaactgggccaccctggcccagaagctgggcctgggcatcctgaacaacgccttcagactgagccccgcccccagcaagaccctgatggacaactacgaggtgagcggcggcaccgtgagagagctggtggaggccctgagacagatgggctacaccgaggccatcgaggtgatccaggccgccagcagccccgtgaagaccaccagccaggcccacagcctgcccctgagccccgccagcaccagacagcagatcgacgagctgagagacagcgacagcgtgtgcgacagcggcgtggagaccagcttcagaaagctgagcttcaccgagagcctgaccagcggcgccagcctgctgaccctgaacaagatgccccacgactacggccaggagggccccctggagggcaagatctag

SEQ ID NO: 87953 - DNA, 1389 bp, Artificial Sequence
  Description of Artificial Sequence: Synthetic coding sequence
atggccaagttcagaagaagaacctgcatcatcctggccctgttcatcctgttcatcttcagcctgatgatgggcctgaagatgctgagacccaacaccgccaccttcggcgcccccttcggcctggacctgctgcccgagctgcaccagagaaccatccacctgggcaagaacttcgacttccagaagagcgacagaatcaacagcgagaccaacaccaagaacctgaagagcgtggagatcaccatgaagcccagcaaggccagcgagctgaacctggacgagctgccccccctgaacaactacctgcacgtgttctactacagctggtacggcaacccccagttcgacggcaagtacatccactggaaccaccccgtgctggagcactgggaccccagaatcgccaagaactacccccagggcagacacaacccccccgacgacatcggcagcagcttctaccccgagctgggcagctacagcagcagagaccccagcgtgatcgagacccacatgagacagatgagaagcgccagcatcggcgtgctggccctgagctggtacccccccgacgtgaacgacgagaacggcgagcccaccgacaacctggtgcccaccatcctggacaaggcccacaagtacaacctgaaggtgaccttccacatcgagccctacagcaacagagacgaccagaacatgtacaagaacgtgaagtacatcatcgacaagtacggcaaccaccccgccttctacagatacaagaccaagaccggcaacgccctgcccatgttctacgtgtacgacagctacatcaccaagcccgagaagtgggccaacctgctgaccaccagcggcagcagaagcatcagaaacagcccctacgacggcctgttcatcgccctgctggtggaggagaagcacaagtacgacatcctgcagagcggcttcgacggcatctacacctacttcgccaccaacggcttcacctacggcagcagccaccagaactgggccagcctgaagctgttctgcgacaagtacaacctgatcttcatccccagcgtgggccccggctacatcgacaccagcatcagaccctggaacacccagaacaccagaaacagaatcaacggcaagtactacgagatcggcctgagcgccgccctgcagaccagacccagcctgatcagcatcaccagcttcaacgagtggcacgagggcacccagatcgagaaggccgtgcccaagagaaccagcaacaccgtgtacctggactacagaccccacaagcccggcctgtacctggagctgaccagaaagtggagcgagaagtacagcaaggagagagccacctacgccctggacagacagctgcccgtgagctag

SEQ ID NO: 87954 - DNA, 597 bp, Artificial Sequence
  Description of Artificial Sequence: Synthetic coding sequence
atggccaagttcagaagaagaacctgcatcatcctggccctgttcatcctgttcatcttcagcctgatgatgggcctgaagatgctgagacccaacaccgccaccttcggcgcccccttcggcctggacctgctgcccgagctgcaccagagaaccatccacctgggcaagaacttcgacttccagaagagcgacagaatcaacagcgagaccaacaccaagaacctgaagagcgtggagatcaccatgaagcccagcaaggccagcgagctgaacctggacgagctgccccccctgaacaactacctgcacgtgttctactacagctggtacggcaacccccagttcgacggcaagtacatccactggaaccaccccgtgctggagcactgggaccccagaatcgccaagaactacccccagggcagacacaacccccccgacgacatcggcagcagcttctaccccgagctgggcagctacagcagcagagaccccagcgtgatcgagacccacatgagacagatgagaagcgccagcatcggcaactactgcatctacatctacgtgtgcctgtgcctgtacatctgcatctag

SEQ ID NO: 87955 - DNA, 624 bp, Artificial Sequence
  Description of Artificial Sequence: Synthetic coding sequence
atggccaagttcagaagaagaacctgcatcatcctggccctgttcatcctgttcatcttcagcctgatgatgggcctgaagatgctgagacccaacaccgccaccttcggcgcccccttcggcctggacctgctgcccgagctgcaccagagaaccatccacctgggcaagaacttcgacttccagaagagcgacagaatcaacagcgagaccaacaccaagaacctgaagagcgtggagatcaccatgaagcccagcaaggccagcgagctgaacctggacgagctgccccccctgaacaactacctgcacgtgttctactacagctggtacggcaacccccagttcgacggcaagtacatccactggaaccaccccgtgctggagcactgggaccccagaatcgccaagaactacccccagggcagacacaacccccccgacgacatcggcagcagcttctaccccgagctgggcagctacagcagcagagaccccagcgtgatcgagacccacatgagacagatgagaagcgccagcatcggcaactactgcatctacatctgcgtgttcgtgagcgtgtacatgcacatcaacgacttcctgtgcaacttcaccagctag

SEQ ID NO: 87956 - DNA, 2379 bp, Artificial Sequence
  Description of Artificial Sequence: Synthetic coding sequence
atgatcaccgtgaaccccgacggcaagatcatggtgagaagatgcctggtgaccctgagacccttcagactgttcgtgctgggcatcggcttcttcaccctgtgcttcctgatgaccagcctgggcggccagttcagcgccagaagactgggcgacagccccttcaccatcagaaccgaggtgatgggcggccccgagagcagaggcgtgctgagaaagatgagcgacctgctggagctgatggtgaagagaatggacgccctggccagactggagaacagcagcgagctgcacagagccggcggcgacctgcacttccccgccgacagaatgccccccggcgccggcctgatggagagaatccaggccatcgcccagaacgtgagcgacatcgccgtgaaggtggaccagatcctgagacacagcctgctgctgcacagcaaggtgagcgagggcagaagagaccagtgcgaggcccccagcgaccccaagttccccgactgcagcggcaaggtggagtggatgagagccagatggaccagcgacccctgctacgccttcttcggcgtggacggcaccgagtgcagcttcctgatctacctgagcgaggtggagtggttctgcccccccctgccctggagaaaccagaccgccgcccagagagcccccaagcccctgcccaaggtgcaggccgtgttcagaagcaacctgagccacctgctggacctgatgggcagcggcaaggagagcctgatcttcatgaagaagagaaccaagagactgaccgcccagtgggccctggccgcccagagactggcccagaagctgggcgccacccagagagaccagaagcagatcctggtgcacatcggcttcctgaccgaggagagcggcgacgtgttcagccccagagtgctgaagggcggccccctgggcgagatggtgcagtgggccgacatcctgaccgccctgtacgtgctgggccacggcctgagagtgaccgtgagcctgaaggagctgcagagcaacctgggcgtgccccccggcagaggcagctgccccctgaccatgcccctgcccttcgacctgatctacaccgactaccacggcctgcagcagatgaagagacacatgggcctgagcttcaagaagtacagatgcagaatcagagtgatcgacaccttcggcaccgagcccgcctacaaccacgaggagtacgccaccctgcacggctacagaaccaactggggctactggaacctgaaccccaagcagttcatgaccatgttcccccacacccccgacaacagcttcatgggcttcgtgagcgaggagctgaacgagaccgagaagagactgatcaagggcggcaaggccagcaacatggccgtggtgtacggcaaggaggccagcatctggaagctgcagggcaaggagaagttcctgggcatcctgaacaagtacatggagatccacggcaccgtgtactacgagagccagagaccccccgaggtgcccgccttcgtgaagaaccacggcctgctgccccagcccgagttccagcagctgctgagaaaggccaagctgttcatcggcttcggcttcccctacgagggccccgcccccctggaggccatcgccaacggctgcatcttcctgcagagcagattcagccccccccacagcagcctgaaccacgagttcttcagaggcaagcccaccagcagagaggtgttcagccagcacccctacgccgagaacttcatcggcaagccccacgtgtggaccgtggactacaacaacagcgaggagttcgaggccgccatcaaggccatcatgagaacccaggtggacccctacctgccctacgagtacacctgcgagggcatgctggagagaatccacgcctacatccagcaccaggacttctgcagagcccccgaccccgccctgcccgaggcccacgccccccagagccccttcgtgctggcccccaacgccacccacctggagtgggccagaaacaccagcctggcccccggcgcctggccccccgcccacgccctgagagcctggctggccgtgcccggcagagcctgcaccgacacctgcctggaccacggcctgatctgcgagcccagcttcttccccttcctgaacagccaggacgccttcctgaagctgcaggtgccctgcgacagcaccgagagcgagatgaaccacctgtaccccgccttcgcccagcccggccaggagtgctacctgcagaaggagcccctgctgttcagctgcgccggcagcaacaccaagtacagaagactgtgcccctgcagagacttcagaaagggccaggtggccctgtgccagggctgcctgtag

SEQ ID NO: 87957 - DNA, 1338 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatcgcctgcgacagaagcaccgtgagaagatgcctggacaagctgctgcactacagacccagcgccgagctgttccccatcatcgtgagccaggactgcggccacgaggagaccgcccaggccatcgccagctacggcagcgccgtgacccacatcagacagcccgacctgagcagcatcgccgtgccccccgaccacagaaagttccagggctactacaagatcgccagacactacagatgggccctgggccaggtgttcagacagttcagattccccgccgccgtggtggtggaggacgacctggaggtggcccccgacttcttcgagtacttcagagccacctaccccctgctgaaggccgaccccagcctgtggtgcgtgagcgcctggaacgacaacggcaaggagcagatggtggacgccagcagacccgagctgctgtacagaaccgacttcttccccggcctgggctggctgctgctggccgagctgtgggccgagctggagcccaagtggcccaaggccttctgggacgactggatgagaagacccgagcagagacagggcagagcctgcatcagacccgagatcagcagaaccatgaccttcggcagaaagggcgtgagccacggccagttcttcgaccagcacctgaagttcatcaagctgaaccagcagttcgtgcacttcacccagctggacctgagctacctgcagagagaggcctacgacagagacttcctggccagagtgtacggcgccccccagctgcaggtggagaaggtgagaaccaacgacagaaaggagctgggcgaggtgagagtgcagtacaccggcagagacagcttcaaggccttcgccaaggccctgggcgtgatggacgacctgaagagcggcgtgcccagagccggctacagaggcatcgtgaccttccagttcagaggcagaagagtgcacctggccccccccctgacctgggagggctacgaccccagctggaactag

SEQ ID NO: 87958 - DNA, 1338 bp, Artificial Sequence; identical to SEQ ID NO: 87957
  Description of Artificial Sequence: Synthetic coding sequence

SEQ ID NO: 87959 - DNA, 1338 bp, Artificial Sequence; identical to SEQ ID NO: 87957
  Description of Artificial Sequence: Synthetic coding sequence

SEQ ID NO: 87960 - DNA, 1338 bp, Artificial Sequence; identical to SEQ ID NO: 87957
  Description of Artificial Sequence: Synthetic coding sequence

SEQ ID NO: 87961 - DNA, 1338 bp, Artificial Sequence; identical to SEQ ID NO: 87957
  Description of Artificial Sequence: Synthetic coding sequence

SEQ ID NO: 87962 - DNA, 909 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagtgttcagacagttcagattccccgccgccgtggtggtggaggacgacctggaggtggcccccgacttcttcgagtacttcagagccacctaccccctgctgaaggccgaccccagcctgtggtgcgtgagcgcctggaacgacaacggcaaggagcagatggtggacgccagcagacccgagctgctgtacagaaccgacttcttccccggcctgggctggctgctgctggccgagctgtgggccgagctggagcccaagtggcccaaggccttctgggacgactggatgagaagacccgagcagagacagggcagagcctgcatcagacccgagatcagcagaaccatgaccttcggcagaaagggcgtgagccacggccagttcttcgaccagcacctgaagttcatcaagctgaaccagcagttcgtgcacttcacccagctggacctgagctacctgcagagagaggcctacgacagagacttcctggccagagtgtacggcgccccccagctgcaggtggagaaggtgagaaccaacgacagaaaggagctgggcgaggtgagagtgcagtacaccggcagagacagcttcaaggccttcgccaaggccctgggcgtgatggacgacctgaagagcggcgtgcccagagccggctacagaggcatcgtgaccttccagttcagaggcagaagagtgcacctggccccccccctgacctgggagggctacgaccccagctggaactag

SEQ ID NO: 87963 - DNA, 312 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgccccctag

SEQ ID NO: 87964 - DNA, 600 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatcgcctgcgacagaagcaccgtgagaagatgcctggacaagctgctgcactacagacccagcgccgagctgttccccatcatcgtgagccaggactgcggccacgaggagaccgcccaggccatcgccagctacggcagcgccgtgacccacatcagacagcccgacctgagcagcatcgccgtgccccccgaccacagaaagttccagggctactacaagatcgccagacactacagatgggccctgggccaggtgttcagacagtag

SEQ ID NO: 87965 - DNA, 336 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatctag

SEQ ID NO: 87966 - DNA, 465 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatcgcctgcgacagaagcaccgtgagaagatgcctggacaagctgctgcactacagacccagcgccgagctgttccccatcatcgtgagccaggactgcggccacgaggagaccgcccaggccatcgccagctag

SEQ ID NO: 87967 - DNA, 105 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgccccctag

SEQ ID NO: 87968 - DNA, 348 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatcgcctgcgacagatag

SEQ ID NO: 87969 - DNA, 288 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagccctag

SEQ ID NO: 87970 - DNA, 384 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgatccccatcctggtgatcgcctgcgacagaagcaccgtgagaagatgcctggacaagctgctgcactag

SEQ ID NO: 87971 - DNA, 318 bp, Artificial Sequence
  Description of Artificial Sequence: Synthetic coding sequence
atgctgaagaagcagagcgccggcctggtgctgtggggcgccatcctgttcgtggcctggaacgccctgctgctgctgttcttctggaccagacccgcccccggcagaccccccagcgtgagcgccctggacggcgaccccgccagcctgaccagagaggtgatcagactggcccaggacgccgaggtggagctggagagacagagaggcctgctgcagcagatcggcgacgccctgagcagccagagaggcagagtgcccaccgccgccccccccgcccagcccagagtgcccgtgacccccgcccccgccgtgtag

SEQ ID NO: 87972 - DNA, 1608 bp, Artificial Sequence
  Description of Artificial Sequence: Synthetic coding sequence
atgagactgagaaacggcaccgtggccaccgccctggccttcatcaccagcttcctgaccctgagctggtacaccacctggcagaacggcaaggagaagctgatcgcctaccagagagagttcctggccctgaaggagagactgagaatcgccgagcacagaatcagccagagaagcagcgagctgaacaccatcgtgcagcagttcaagagagtgggcgccgagaccaacggcagcaaggacgccctgaacaagttcagcgacaacaccctgaagctgctgaaggagctgaccagcaagaagagcctgcaggtgcccagcatctactaccacctgccccacctgctgaagaacgagggcagcctgcagcccgccgtgcagatcggcaacggcagaaccggcgtgagcatcgtgatgggcatccccaccgtgaagagagaggtgaagagctacctgatcgagaccctgcacagcctgatcgacaacctgtaccccgaggagaagctggactgcgtgatcgtggtgttcatcggcgagaccgacatcgactacgtgcacggcgtggtggccaacctggagaaggagttcagcaaggagatcagcagcggcctggtggaggtgatcagcccccccgagagctactaccccgacctgaccaacctgaaggagaccttcggcgacagcaaggagagagtgagatggagaaccaagcagaacctggactactgcttcctgatgatgtacgcccaggagaagggcatctactacatccagctggaggacgacatcatcgtgaagcagaactacttcaacaccatcaagaacttcgccctgcagctgagcagcgaggagtggatgatcctggagttcagccagctgggcttcatcggcaagatgttccaggcccccgacctgaccctgatcgtggagttcatcttcatgttctacaaggagaagcccatcgactggctgctggaccacatcctgtgggtgaaggtgtgcaaccccgagaaggacgccaagcactgcgacagacagaaggccaacctgagaatcagattcagacccagcctgttccagcacgtgggcctgcacagcagcctgagcggcaagatccagaagctgaccgacaaggactacatgaagcccctgctgctgaagatccacgtgaacccccccgccgaggtgagcaccagcctgaaggtgtaccagggccacaccctggagaagacctacatgggcgaggacttcttctgggccatcacccccatcgccggcgactacatcctgttcaagttcgacaagcccgtgaacgtggagagctacctgttccacagcggcaaccaggagcaccccggcgacatcctgctgaacaccaccgtggaggtgctgcccttcaagagcgagggcctggagatcagcaaggagaccaaggacaagagactggaggacggctacttcagaatcggcaagttcgagaacggcgtggccgagggcatggtggaccccagcctgaaccccatcagcgccttcagactgagcgtgatccagaacagcgccgtgtgggccatcctgaacgagatccacatcaagaaggccaccaactag

SEQ ID NO: 87973 - DNA, 1608 bp, Artificial Sequence; identical to SEQ ID NO: 87972
  Description of Artificial Sequence: Synthetic coding sequence

SEQ ID NO: 87974 - DNA, 1608 bp, Artificial Sequence; identical to SEQ ID NO: 87972
  Description of Artificial Sequence: Synthetic coding sequence

SEQ ID NO: 87975 - DNA, 1272 bp, Artificial Sequence
  Description of Artificial Sequence: Synthetic coding sequence
atgaactacagcatcaccgtgagcatcgtgatgggcatccccaccgtgaagagagaggtgaagagctacctgatcgagaccctgcacagcctgatcgacaacctgtaccccgaggagaagctggactgcgtgatcgtggtgttcatcggcgagaccgacatcgactacgtgcacggcgtggtggccaacctggagaaggagttcagcaaggagatcagcagcggcctggtggaggtgatcagcccccccgagagctactaccccgacctgaccaacctgaaggagaccttcggcgacagcaaggagagagtgagatggagaaccaagcagaacctggactactgcttcctgatgatgtacgcccaggagaagggcatctactacatccagctggaggacgacatcatcgtgaagcagaactacttcaacaccatcaagaacttcgccctgcagctgagcagcgaggagtggatgatcctggagttcagccagctgggcttcatcggcaagatgttccaggcccccgacctgaccctgatcgtggagttcatcttcatgttctacaaggagaagcccatcgactggctgctggaccacatcctgtgggtgaaggtgtgcaaccccgagaaggacgccaagcactgcgacagacagaaggccaacctgagaatcagattcagacccagcctgttccagcacgtgggcctgcacagcagcctgagcggcaagatccagaagctgaccgacaaggactacatgaagcccctgctgctgaagatccacgtgaacccccccgccgaggtgagcaccagcctgaaggtgtaccagggccacaccctggagaagacctacatgggcgaggacttcttctgggccatcacccccatcgccggcgactacatcctgttcaagttcgacaagcccgtgaacgtggagagctacctgttccacagcggcaaccaggagcaccccggcgacatcctgctgaacaccaccgtggaggtgctgcccttcaagagcgagggcctggagatcagcaaggagaccaaggacaagagactggaggacggctacttcagaatcggcaagttcgagaacggcgtggccgagggcatggtggaccccagcctgaaccccatcagcgccttcagactgagcgtgatccagaacagcgccgtgtgggccatcctgaacgagcagagagtgttcagcggctggtggcagaagagcagagacaaggccgagggcccccaggcccccctgctgttctag

SEQ ID NO: 87976 - DNA, 1647 bp, Artificial Sequence
  Description of Artificial Sequence: Synthetic coding sequence
atgagactgagaaacggcaccttcctgaccctgctgctgttctgcctgtgcgccttcctgagcctgagctggtacgccgccctgagcggccagaagggcgacgtggtggacgtgtaccagagagagttcctggccctgagagacagactgcacgccgccgagcaggagagcctgaagagaagcaaggagctgaacctggtgctggacgagatcaagagagccgtgagcgagagacaggccctgagagacggcgacggcaacagaacctggggcagactgaccgaggaccccagactgaagccctggaacggcagccacagacacgtgctgcacctgcccaccgtgttccaccacctgccccacctgctggccaaggagagcagcctgcagcccgccgtgagagtgggccagggcagaaccggcgtgagcgtggtgatgggcatccccagcgtgagaagagaggtgcacagctacctgaccgacaccctgcacagcctgatcagcgagctgagcccccaggagaaggaggacagcgtgatcgtggtgctgatcgccgagaccgacagccagtacaccagcgccgtgaccgagaacatcaaggccctgttccccaccgagatccacagcggcctgctggaggtgatcagccccagcccccacttctaccccgacttcagcagactgagagagagcttcggcgaccccaaggagagagtgagatggagaaccaagcagaacctggactactgcttcctgatgatgtacgcccagagcaagggcatctactacgtgcagctggaggacgacatcgtggccaagcccaactacctgagcaccatgaagaacttcgccctgcagcagcccagcgaggactggatgatcctggagttcagccagctgggcttcatcggcaagatgttcaagagcctggacctgagcctgatcgtggagttcatcctgatgttctacagagacaagcccatcgactggctgctggaccacatcctgtgggtgaaggtgtgcaaccccgagaaggacgccaagcactgcgacagacagaaggccaacctgagaatcagattcaagcccagcctgttccagcacgtgggcacccacagcagcctggccggcaagatccagaagctgaaggacaaggacttcggcaagcaggccctgagaaaggagcacgtgaacccccccgccgaggtgagcaccagcctgaagacctaccagcacttcaccctggagaaggcctacctgagagaggacttcttctgggccttcacccccgccgccggcgacttcatcagattcagattcttccagcccctgagactggagagattcttcttcagaagcggcaacatcgagcaccccgaggacaagctgttcaacaccagcgtggaggtgctgcccttcgacaacccccagagcgacaaggaggccctgcaggagggcagaaccgccaccctgagataccccagaagccccgacggctacctgcagatcggcagcttctacaagggcgtggccgagggcgaggtggaccccgccttcggccccctggaggccctgagactgagcatccagaccgacagccccgtgtgggtgatcctgagcgagatcttcctgaagaaggccgactag

SEQ ID NO: 87977 - DNA, 1692 bp, Artificial Sequence
  Description of Artificial Sequence: Synthetic coding sequence
atgagcagagtggccggcaccagaaccgacgtgaacgagctgctgcagagatggacccccagatgcgtgagatggcacaccggcggcgccagaagagtggccctggacagacccctggtgaccgcctgcctgccccccgccggcgacgtggtggacgtgtaccagagagagttcctggccctgagagacagactgcacgccgccgagcaggagagcctgaagagaagcaaggagctgaacctggtgctggacgagatcaagagagccgtgagcgagagacaggccctgagagacggcgacggcaacagaacctggggcagactgaccgaggaccccagactgaagccctggaacggcagccacagacacgtgctgcacctgcccaccgtgttccaccacctgccccacctgctggccaaggagagcagcctgcagcccgccgtgagagtgggccagggcagaaccggcgtgagcgtggtgatgggcatccccagcgtgagaagagaggtgcacagctacctgaccgacaccctgcacagcctgatcagcgagctgagcccccaggagaaggaggacagcgtgatcgtggtgctgatcgccgagaccgacagccagtacaccagcgccgtgaccgagaacatcaaggccctgttccccaccgagatccacagcggcctgctggaggtgatcagccccagcccccacttctaccccgacttcagcagactgagagagagcttcggcgaccccaaggagagagtgagatggagaaccaagcagaacctggactactgcttcctgatgatgtacgcccagagcaagggcatctactacgtgcagctggaggacgacatcgtggccaagcccaactacctgagcaccatgaagaacttcgccctgcagcagcccagcgaggactggatgatcctggagttcagccagctgggcttcatcggcaagatgttcaagagcctggacctgagcctgatcgtggagttcatcctgatgttctacagagacaagcccatcgactggctgctggaccacatcctgtgggtgaaggtgtgcaaccccgagaaggacgccaagcactgcgacagacagaaggccaacctgagaatcagattcaagcccagcctgttccagcacgtgggcacccacagcagcctggccggcaagatccagaagctgaaggacaaggacttcggcaagcaggccctgagaaaggagcacgtgaacccccccgccgaggtgagcaccagcctgaagacctaccagcacttcaccctggagaaggcctacctgagagaggacttcttctgggccttcacccccgccgccggcgacttcatcagattcagattcttccagcccctgagactggagagattcttcttcagaagcggcaacatcgagcaccccgaggacaagctgttcaacaccagcgtggaggtgctgcccttcgacaacccccagagcgacaaggaggccctgcaggagggcagaaccgccaccctgagataccccagaagccccgacggctacctgcagatcggcagcttctacaagggcgtggccgagggcgaggtggaccccgccttcggccccctggaggccctgagactgagcatccagaccgacagccccgtgtgggtgatcctgagcgagatcttcctgaagaaggccgactag

SEQ ID NO: 87978 - DNA, 1344 bp, Artificial Sequence
  Description of Artificial Sequence: Synthetic coding sequence
atgagattcagaatctacaagagaaaggtgctgatcctgaccctggtggtggccgcctgcggcttcgtgctgtggagcagcaacggcagacagagaaagaacgaggccctggccccccccctgctggacgccgagcccgccagaggcgccggcggcagaggcggcgaccaccccagcgtggccgtgggcatcagaagagtgagcaacgtgagcgccgccagcctggtgcccgccgtgccccagcccgaggccgacaacctgaccctgagatacagaagcctggtgtaccagctgaacttcgaccagaccctgagaaacgtggacaaggccggcacctgggcccccagagagctggtgctggtggtgcaggtgcacaacagacccgagtacctgagactgctgctggacagcctgagaaaggcccagggcatcgacaacgtgctggtgatcttcagccacgacttctggagcaccgagatcaaccagctgatcgccggcgtgaacttctgccccgtgctgcaggtgttcttccccttcagcatccagctgtaccccaacgagttccccggcagcgaccccagagactgccccagagacctgcccaagaacgccgccctgaagctgggctgcatcaacgccgagtaccccgacagcttcggccactacagagaggccaagttcagccagaccaagcaccactggtggtggaagctgcacttcgtgtgggagagagtgaagatcctgagagactacgccggcctgatcctgttcctggaggaggaccactacctggcccccgacttctaccacgtgttcaagaagatgtggaagctgaagcagcaggagtgccccgagtgcgacgtgctgagcctgggcacctacagcgccagcagaagcttctacggcatggccgacaaggtggacgtgaagacctggaagagcaccgagcacaacatgggcctggccctgaccagaaacgcctaccagaagctgatcgagtgcaccgacaccttctgcacctacgacgactacaactgggactggaccctgcagtacctgaccgtgagctgcctgcccaagttctggaaggtgctggtgccccagatccccagaatcttccacgccggcgactgcggcatgcaccacaagaagacctgcagacccagcacccagagcgcccagatcgagagcctgctgaacaacaacaagcagtacatgttccccgagaccctgaccatcagcgagaagttcaccgtggtggccatcagcccccccagaaagaacggcggctggggcgacatcagagaccacgagctgtgcaagagctacagaagactgcagtag

SEQ ID NO: 87979 - DNA, 1362 bp, Artificial Sequence
  Description of Artificial Sequence: Synthetic coding sequence
atggagagaaccgagaccatgagattcagaatctacaagagaaaggtgctgatcctgaccctggtggtggccgcctgcggcttcgtgctgtggagcagcaacggcagacagagaaagaacgaggccctggccccccccctgctggacgccgagcccgccagaggcgccggcggcagaggcggcgaccaccccagcgtggccgtgggcatcagaagagtgagcaacgtgagcgccgccagcctggtgcccgccgtgccccagcccgaggccgacaacctgaccctgagatacagaagcctggtgtaccagctgaacttcgaccagaccctgagaaacgtggacaaggccggcacctgggcccccagagagctggtgctggtggtgcaggtgcacaacagacccgagtacctgagactgctgctggacagcctgagaaaggcccagggcatcgacaacgtgctggtgatcttcagccacgacttctggagcaccgagatcaaccagctgatcgccggcgtgaacttctgccccgtgctgcaggtgttcttccccttcagcatccagctgtaccccaacgagttccccggcagcgaccccagagactgccccagagacctgcccaagaacgccgccctgaagctgggctgcatcaacgccgagtaccccgacagcttcggccactacagagaggccaagttcagccagaccaagcaccactggtggtggaagctgcacttcgtgtgggagagagtgaagatcctgagagactacgccggcctgatcctgttcctggaggaggaccactacctggcccccgacttctaccacgtgttcaagaagatgtggaagctgaagcagcaggagtgccccgagtgcgacgtgctgagcctgggcacctacagcgccagcagaagcttctacggcatggccgacaaggtggacgtgaagacctggaagagcaccgagcacaacatgggcctggccctgaccagaaacgcctaccagaagctgatcgagtgcaccgacaccttctgcacctacgacgactacaactgggactggaccctgcagtacctgaccgtgagctgcctgcccaagttctggaaggtgctggtgccccagatccccagaatcttccacgccggcgactgcggcatgcaccacaagaagacctgcagacccagcacccagagcgcccagatcgagagcctgctgaacaacaacaagcagtacatgttccccgagaccctgaccatcagcgagaagttcaccgtggtggccatcagcccccccagaaagaacggcggctggggcgacatcagagaccacgagctgtgcaagagctacagaagactgcagtag

SEQ ID NO: 87980 - DNA, 2373 bp, Artificial Sequence
  Description of Artificial Sequence: Synthetic coding sequence
atgatcaccgtgaaccccgacggcaagatcatggtgagaagatgcctggtgaccctgagacccttcagactgttcgtgctgggcatcggcttcttcaccctgtgcttcctgatgaccagcctgggcggccagttcagcgccagaagactgggcgacagccccttcaccatcagaaccgaggtgatgggcggccccgagagcagaggcgtgctgagaaagatgagcgacctgctggagctgatggtgaagagaatggacgccctggccagactggagaacagcagcgagctgcacagagccggcggcgacctgcacttccccgccgacagaatgccccccggcgccggcctgatggagagaatccaggccatcgcccagaacgtgagcgacatcgccgtgaaggtggaccagatcctgagacacagcctgctgctgcacagcaaggtgagcgagggcagaagagaccagtgcgaggcccccagcgaccccaagttccccgactgcagcggcaaggtggagtggatgagagccagatggaccagcgacccctgctacgccttcttcggcgtggacggcaccgagtgcagcttcctgatctacctgagcgaggtggagtggttctgcccccccctgccctggagaaaccagaccgccgcccagagagcccccaagcccctgcccaaggtgcaggccgtgttcagaagcaacctgagccacctgctggacctgatgggcagcggcaaggagagcctgatcttcatgaagaagagaaccaagagactgaccgcccagtgggccctggccgcccagagactggcccagaagctgggcgccacccagagagaccagaagcagatcctggtgcacatcggcttcctgaccgaggagagcggcgacgtgttcagccccagagtgctgaagggcggccccctgggcgagatggtgcagtgggccgacatcctgaccgccctgtacgtgctgggccacggcctgagagtgaccgtgagcctgaaggagctgcagagcaacctgggcgtgccccccggcagaggcagctgccccctgaccatgcccctgcccttcgacctgatctacaccgactaccacggcctgcagcagatgaagagacacatgggcctgagcttcaagaagtacagatgcagaatcagagtgatcgacaccttcggcaccgagcccgcctacaaccacgaggagtacgccaccctgcacggctacagaaccaactggggctactggaacctgaaccccaagcagttcatgaccatgttcccccacacccccgacaacagcttcatgggcttcgtgagcgaggagctgaacgagaccgagaagagactgatcaagggcggcaaggccagcaacatggccgtggtgtacggcaaggaggccagcatctggaagggcaaggagaagttcctgggcatcctgaacaagtacatggagatccacggcaccgtgtactacgagagccagagaccccccgaggtgcccgccttcgtgaagaaccacggcctgctgccccagcccgagttccagcagctgctgagaaaggccaagctgttcatcggcttcggcttcccctacgagggccccgcccccctggaggccatcgccaacggctgcatcttcctgcagagcagattcagccccccccacagcagcctgaaccacgagttcttcagaggcaagcccaccagcagagaggtgttcagccagcacccctacgccgagaacttcatcggcaagccccacgtgtggaccgtggactacaacaacagcgaggagttcgaggccgccatcaaggccatcatgagaacccaggtggacccctacctgccctacgagtacacctgcgagggcatgctggagagaatccacgcctacatccagcaccaggacttctgcagagcccccgaccccgccctgcccgaggcccacgccccccagagccccttcgtgctggcccccaacgccacccacctggagtgggccagaaacaccagcctggcccccggcgcctggccccccgcccacgccctgagagcctggctggccgtgcccggcagagcctgcaccgacacctgcctggaccacggcctgatctgcgagcccagcttcttccccttcctgaacagccaggacgccttcctgaagctgcaggtgccctgcgacagcaccgagagcgagatgaaccacctgtaccccgccttcgcccagcccggccaggagtgctacctgcagaaggagcccctgctgttcagctgcgccggcagcaacaccaagtacagaagactgtgcccctgcagagacttcagaaagggccaggtggccctgtgccagggctgcctgtag

SEQ ID NO: 87981 - DNA, 1185 bp, Artificial Sequence
  Description of Artificial Sequence: Synthetic coding sequence
atgatcaccgtgaaccccgacggcaagatcatggtgagaagatgcctggtgaccctgagacccttcagactgttcgtgctgggcatcggcttcttcaccctgtgcttcctgatgaccagcctgggcggccagttcagcgccagaagactgggcgacagccccttcaccatcagaaccgaggtgatgggcggccccgagagcagaggcgtgctgagaaagatgagcgacctgctggagctgatggtgaagagaatggacgccctggccagactggagaacagcagcgagctgcacagagccggcggcgacctgcacttccccgccgacagaatgccccccggcgccggcctgatggagagaatccaggccatcgcccagaacgtgagcgacatcgccgtgaaggtggaccagatcctgagacacagcctgctgctgcacagcaaggtgagcgagggcagaagagaccagtgcgaggcccccagcgaccccaagttccccgactgcagcggcaaggtggagtggatgagagccagatggaccagcgacccctgctacgccttcttcggcgtggacggcaccgagtgcagcttcctgatctacctgagcgaggtggagtggttctgcccccccctgccctggagaaaccagaccgccgcccagagagcccccaagcccctgcccaaggtgcaggccgtgttcagaagcaacctgagccacctgctggacctgatgggcagcggcaaggagagcctgatcttcatgaagaagagaaccaagagactgaccgcccagtgggccctggccgcccagagactggcccagaagctgggcgccacccagagagaccagaagcagatcctggtgcacatcggcttcctgaccgaggagagcggcgacgtgttcagccccagagtgctgaagggcggccccctgggcgagatggtgcagtgggccgacatcctgaccgccctgtacgtgctgggccacggcctgagagtgaccgtgagcctgaaggagctgcagagacagagaagactgagaagcagccaggagcaggccagatgcggcgtgatgggcgcctgcgagaagatgctgctggagggcgacgtggccagcaacaccctgctgatcgagaagcccagcaagaaggagaccgagaagtgccccaagaacctggtgacctag

SEQ ID NO: 87982 - DNA, 2406 bp, Artificial Sequence
  Description of Artificial Sequence: Synthetic coding sequence
atgcacagcttcgtgaagcacctgtgcagcagatacgtggtggagagacagggcaccatggccctgcccgccctgctgaccagactgctgcccctgagaagactgttcgtgctgggcatcggcttcttcaccctgtgcttcctgatgaccagcctgggcggccagttcagcgccagaagactgggcgacagccccttcaccatcagaaccgaggtgatgggcggccccgagagcagaggcgtgctgagaaagatgagcgacctgctggagctgatggtgaagagaatggacgccctggccagactggagaacagcagcgagctgcacagagccggcggcgacctgcacttccccgccgacagaatgccccccggcgccggcctgatggagagaatccaggccatcgcccagaacgtgagcgacatcgccgtgaaggtggaccagatcctgagacacagcctgctgctgcacagcaaggtgagcgagggcagaagagaccagtgcgaggcccccagcgaccccaagttccccgactgcagcggcaaggtggagtggatgagagccagatggaccagcgacccctgctacgccttcttcggcgtggacggcaccgagtgcagcttcctgatctacctgagcgaggtggagtggttctgcccccccctgccctggagaaaccagaccgccgcccagagagcccccaagcccctgcccaaggtgcaggccgtgttcagaagcaacctgagccacctgctggacctgatgggcagcggcaaggagagcctgatcttcatgaagaagagaaccaagagactgaccgcccagtgggccctggccgcccagagactggcccagaagctgggcgccacccagagagaccagaagcagatcctggtgcacatcggcttcctgaccgaggagagcggcgacgtgttcagccccagagtgctgaagggcggccccctgggcgagatggtgcagtgggccgacatcctgaccgccctgtacgtgctgggccacggcctgagagtgaccgtgagcctgaaggagctgcagagcaacctgggcgtgccccccggcagaggcagctgccccctgaccatgcccctgcccttcgacctgatctacaccgactaccacggcctgcagcagatgaagagacacatgggcctgagcttcaagaagtacagatgcagaatcagagtgatcgacaccttcggcaccgagcccgcctacaaccacgaggagtacgccaccctgcacggctacagaaccaactggggctactggaacctgaaccccaagcagttcatgaccatgttcccccacacccccgacaacagcttcatgggcttcgtgagcgaggagctgaacgagaccgagaagagactgatcaagggcggcaaggccagcaacatggccgtggtgtacggcaaggaggccagcatctggaagggcaaggagaagttcctgggcatcctgaacaagtacatggagatccacggcaccgtgtactacgagagccagagaccccccgaggtgcccgccttcgtgaagaaccacggcctgctgccccagcccgagttccagcagctgctgagaaaggccaagctgttcatcggcttcggcttcccctacgagggccccgcccccctggaggccatcgccaacggctgcatcttcctgcagagcagattcagccccccccacagcagcctgaaccacgagttcttcagaggcaagcccaccagcagagaggtgttcagccagcacccctacgccgagaacttcatcggcaagccccacgtgtggaccgtggactacaacaacagcgaggagttcgaggccgccatcaaggccatcatgagaacccaggtggacccctacctgccctacgagtacacctgcgagggcatgctggagagaatccacgcctacatccagcaccaggacttctgcagagcccccgaccccgccctgcccgaggcccacgccccccagagccccttcgtgctggcccccaacgccacccacctggagtgggccagaaacaccagcctggcccccggcgcctggccccccgcccacgccctgagagcctggctggccgtgcccggcagagcctgcaccgacacctgcctggaccacggcctgatctgcgagcccagcttcttccccttcctgaacagccaggacgccttcctgaagctgcaggtgccctgcgacagcaccgagagcgagatgaaccacctgtaccccgccttcgcccagcccggccaggagtgctacctgcagaaggagcccctgctgttcagctgcgccggcagcaacaccaagtacagaagactgtgcccctgcagagacttcagaaagggccaggtggccctgtgccagggctgcctgtag

SEQ ID NO: 87983 - DNA, 1602 bp, Artificial Sequence
  Description of Artificial Sequence: Synthetic coding sequence
atgaagatgagaagatacaagctgttcctgatgttctgcatggccggcctgtgcctgatcagcttcctgcacttcttcaagaccctgagctacgtgaccttccccagagagctggccagcctgagccccaacctggtgagcagcttcttctggaacaacgcccccgtgaccccccaggccagccccgagcccggcggccccgacctgctgagaacccccctgtacagccacagccccctgctgcagcccctgccccccagcaaggccgccgaggagctgcacagagtggacctggtgctgcccgaggacaccaccgagtacttcgtgagaaccaaggccggcggcgtgtgcttcaagcccggcaccaagatgctggagagacccccccccggcagacccgaggagaagcccgagggcgccaacggcagcagcgccagaagaccccccagatacctgctgagcgccagagagagaaccggcggcagaggcgccagaagaaagtgggtggagtgcgtgtgcctgcccggctggcacggccccagctgcggcgtgcccaccgtggtgcagtacagcaacctgcccaccaaggagagactggtgcccagagaggtgcccagaagagtgatcaacgccatcaacgtgaaccacgagttcgacctgctggacgtgagattccacgagctgggcgacgtggtggacgccttcgtggtgtgcgagagcaacttcaccgcctacggcgagcccagacccctgaagttcagagagatgctgaccaacggcaccttcgagtacatcagacacaaggtgctgtacgtgttcctggaccacttcccccccggcggcagacaggacggctggatcgccgacgactacctgagaaccttcctgacccaggacggcgtgagcagactgagaaacctgagacccgacgacgtgttcatcatcgacgacgccgacgagatccccgccagagacggcgtgctgttcctgaagctgtacgacggctggaccgagcccttcgccttccacatgagaaagagcctgtacggcttcttctggaagcagcccggcaccctggaggtggtgagcggctgcaccgtggacatgctgcaggccgtgtacggcctggacggcatcagactgagaagaagacagtactacaccatgcccaacttcagacagtacgagaacagaaccggccacatcctggtgcagtggagcctgggcagccccctgcacttcgccggctggcactgcagctggtgcttcacccccgagggcatctacttcaagctggtgagcgcccagaacggcgacttccccagatggggcgactacgaggacaagagagacctgaactacatcagaggcctgatcagaaccggcggctggttcgacggcacccagcaggagtacccccccgccgaccccagcgagcacatgtacgcccccaagtacctgctgaagaactacgacagattccactacctgctggacaacccctaccaggagcccagaagcaccgccgccggcggctggagacacagaggccccgagggcagaccccccgccagaggcaagctggacgaggccgaggtgtag

SEQ ID NO: 87984 - DNA, 327 bp, Artificial Sequence
  Description of Artificial Sequence: Synthetic coding sequence
atggagagctgcagctgccaccccggcagcggcgtgcagtggagagaccacggcagcctgcagctgcccccccccggcttcaagatgaagatgagaagatacaagctgttcctgatgttctgcatggccggcctgtgcctgatcagcttcctgcacttcttcaagaccctgagctacgtgaccttccccagagagctggccagcctgagccccaacctggtgagcagcttcttctggaacaacgcccccgtgaccccccaggccagccccgagcccggcggccccgacctgctgagaacccccctgtacagccacagccccctgtag

SEQ ID NO: 87985 - DNA, 486 bp, Artificial Sequence
  Description of Artificial Sequence: Synthetic coding sequence
atgaagatgagaagatacaagctgttcctgatgttctgcatggccggcctgtgcctgatcagcttcctgcacttcttcaagaccctgagctacgtgaccttccccagagagctggccagcctgagccccaacctggtgagcagcttcttctggaacaacgcccccgtgaccccccaggccagccccgagcccggcggccccgacctgctgagaacccccctgtacagccacagccccctgctgcagcccctgccccccagcaaggccgccgaggagctgcacagagtggacctggtgctgcccgaggacaccaccgagtacttcgtgagaaccaaggccggcggcgtgtgcttcaagcccggcaccaagatgctggagagacccccccccggcagacccgaggagaagcccgagggcgccaacggcagcagcgccagaagaccccccagatacctgctgagcgccagagagagaaccggcggctag

SEQ ID NO: 87986 - DNA, 1044 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgccagggcaacaagaacatcctggagctgatcgagttcttcgaggacgacaccagattctacctggtgttcgagaagctgcagggcggcagcatcctggcccacatccagaagcagaagcacttcaacgagagagaggccagcagagtggtgagagacgtggccgccgccctggacttcctgcacaccaagggcatcgcccacagagacctgaagcccgagaacatcctgtgcgagagccccgagaaggtgagccccgtgaagatctgcgacttcgacctgggcagcggcatgaagctgaacaacagctgcacccccatcaccacccccgagctgaccaccccctgcggcagcgccgagtacatggcccccgaggtggtggaggtgttcaccgaccaggccaccttctacgacaagagatgcgacctgtggagcctgggcgtggtgctgtacatcatgctgagcggctacccccccttcgtgggccactgcggcgccgactgcggctgggacagaggcgaggtgtgcagagtgtgccagaacaagctgttcgagagcatccaggagggcaagtacgagttccccgacaaggactgggcccacatcagcagcgaggccaaggacctgatcagcaagctgctggtgagagacgccaagcagagactgagcgccgcccaggtgctgcagcacccctgggtgcagggcgagcagcagcacaacggccccgacgccctgagaagctag

SEQ ID NO: 87987 - DNA, 990 bp, Artificial Sequence
  Description of Artificial Sequence: Synthetic coding sequence
atggccaagagcatgcccagcaagagcagcagaaacaagcagggcaccgtgggcgtgggctgcttcgagagatggagaagatgcatcagcgtgagagagaccagcagcatcctggcccacatccagaagcagaagcacttcaacgagagagaggccagcagagtggtgagagacgtggccgccgccctggacttcctgcacaccaagggcatcgcccacagagacctgaagcccgagaacatcctgtgcgagagccccgagaaggtgagccccgtgaagatctgcgacttcgacctgggcagcggcatgaagctgaacaacagctgcacccccatcaccacccccgagctgaccaccccctgcggcagcgccgagtacatggcccccgaggtggtggaggtgttcaccgaccaggccaccttctacgacaagagatgcgacctgtggagcctgggcgtggtgctgtacatcatgctgagcggctacccccccttcgtgggccactgcggcgccgactgcggctgggacagaggcgaggtgtgcagagtgtgccagaacaagctgttcgagagcatccaggagggcaagtacgagttccccgacaaggactgggcccacatcagcagcgaggccaaggacctgatcagcaagctgctggtgagagacgccaagcagagactgagcgccgcccaggtgctgcagcacccctgggtgcagggccaggcccccgagaagggcctgcccaccccccaggtgctgcagagaaacagcagcaccatggacctgaccctgttcgccgccgaggccatcgccctgaacagacagctgagccagcacgaggagaacgagctggccgaggagcccgaggccctggccgacggcctgtgcagcatgaagctgagccccccctgcaagagcagactggccagaagaagagccctggcccaggccggcagaggcgaggacagaagcccccccaccgccctgtag

SEQ ID NO: 87988 - DNA, 1275 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgccagggcaacaagaacatcctggagctgatcgagttcttcgaggacgacaccagattctacctggtgttcgagaagctgcagggcggcagcatcctggcccacatccagaagcagaagcacttcaacgagagagaggccagcagagtggtgagagacgtggccgccgccctggacttcctgcacaccaagggcatcgcccacagagacctgaagcccgagaacatcctgtgcgagagccccgagaaggtgagccccgtgaagatctgcgacttcgacctgggcagcggcatgaagctgaacaacagctgcacccccatcaccacccccgagctgaccaccccctgcggcagcgccgagtacatggcccccgaggtggtggaggtgttcaccgaccaggccaccttctacgacaagagatgcgacctgtggagcctgggcgtggtgctgtacatcatgctgagcggctacccccccttcgtgggccactgcggcgccgactgcggctgggacagaggcgaggtgtgcagagtgtgccagaacaagctgttcgagagcatccaggagggcaagtacgagttccccgacaaggactgggcccacatcagcagcgaggccaaggacctgatcagcaagctgctggtgagagacgccaagcagagactgagcgccgcccaggtgctgcagcacccctgggtgcagggccaggcccccgagaagggcctgcccaccccccaggtgctgcagagaaacagcagcaccatggacctgaccctgttcgccgccgaggccatcgccctgaacagacagctgagccagcacgaggagaacgagctggccgaggagcccgaggccctggccgacggcctgtgcagcatgaagctgagccccccctgcaagagcagactggccagaagaagagccctggcccaggccggcagaggcgaggacagaagcccccccaccgccctgtag

SEQ ID NO: 87989 - DNA, 1398 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgccagggcaacaagaacatcctggagctgatcgagttcttcgaggacgacaccagattctacctggtgttcgagaagctgcagggcggcagcatcctggcccacatccagaagcagaagcacttcaacgagagagaggccagcagagtggtgagagacgtggccgccgccctggacttcctgcacaccaaggacaaggtgagcctgtgccacctgggctggagcgccatggcccccagcggcctgaccgccgcccccaccagcctgggcagcagcgacccccccaccagcgccagccaggtggccggcaccaccggcatcgcccacagagacctgaagcccgagaacatcctgtgcgagagccccgagaaggtgagccccgtgaagatctgcgacttcgacctgggcagcggcatgaagctgaacaacagctgcacccccatcaccacccccgagctgaccaccccctgcggcagcgccgagtacatggcccccgaggtggtggaggtgttcaccgaccaggccaccttctacgacaagagatgcgacctgtggagcctgggcgtggtgctgtacatcatgctgagcggctacccccccttcgtgggccactgcggcgccgactgcggctgggacagaggcgaggtgtgcagagtgtgccagaacaagctgttcgagagcatccaggagggcaagtacgagttccccgacaaggactgggcccacatcagcagcgaggccaaggacctgatcagcaagctgctggtgagagacgccaagcagagactgagcgccgcccaggtgctgcagcacccctgggtgcagggccaggcccccgagaagggcctgcccaccccccaggtgctgcagagaaacagcagcaccatggacctgaccctgttcgccgccgaggccatcgccctgaacagacagctgagccagcacgaggagaacgagctggccgaggagcccgaggccctggccgacggcctgtgcagcatgaagctgagccccccctgcaagagcagactggccagaagaagagccctggcccaggccggcagaggcgaggacagaagcccccccaccgccctgtag

SEQ ID NO: 87990 - DNA, 1044 bp, Artificial Sequence; identical to SEQ ID NO: 87986
  Description of Artificial Sequence: Synthetic coding sequence

SEQ ID NO: 87991 - DNA, 537 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgccagggcaacaagaacatcctggagctgatcgagttcttcgaggacgacaccagattctacctggtgttcgagaagctgcagggcggcagcatcctggcccacatccagaagcagaagcacttcaacgagagagaggccagcagagtggtgagagacgtggccgccgccctggacttcctgcacaccaagggcatcgcccacagagacctgaagcccgagaacatcctgtgctag

SEQ ID NO: 87992 - DNA, 306 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgctag

SEQ ID NO: 87993 - DNA, 303 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtag

SEQ ID NO: 87994 - DNA, 402 bp, Artificial Sequence
  Description of Artificial Sequence: Synthetic coding sequence
atggtgagcagccagaagctggagaagcccatcgagatgggcagcagcgagcccctgcccatcgccgacggcgacagaagaagaaagaagaagagaagaggcagagccaccgacagcctgcccggcaagttcgaggacatgtacaagctgaccagcgagctgctgggcgagggcgcctacgccaaggtgcagggcgccgtgagcctgcagaacggcaaggagtacgccgtgaagatcatcgagaagcaggccggccacagcagaagcagagtgttcagagaggtggagaccctgtaccagtgccagggcaacaagaacatcctggagctgatcgagttcttcgaggacgacaccagattctacctggtgttcgagaagctgcagggcggcacctacagatag

SEQ ID NO: 87995 - DNA, 1398 bp, Artificial Sequence
  Description of Artificial Sequence: Synthetic coding sequence
atggtgcagaagaagcccgccgagctgcagggcttccacagaagcttcaagggccagaaccccttcgagctggccttcagcctggaccagcccgaccacggcgacagcgacttcggcctgcagtgcagcgccagacccgacatgcccgccagccagcccatcgacatccccgacgccaagaagagaggcaagaagaagaagagaggcagagccaccgacagcttcagcggcagattcgaggacgtgtaccagctgcaggaggacgtgctgggcgagggcgcccacgccagagtgcagacctgcatcaacctgatcaccagccaggagtacgccgtgaagatcatcgagaagcagcccggccacatcagaagcagagtgttcagagaggtggagatgctgtaccagtgccagggccacagaaacgtgctggagctgatcgagttcttcgaggaggaggacagattctacctggtgttcgagaagatgagaggcggcagcatcctgagccacatccacaagagaagacacttcaacgagctggaggccagcgtggtggtgcaggacgtggccagcgccctggacttcctgcacaacaagggcatcgcccacagagacctgaagcccgagaacatcctgtgcgagcaccccaaccaggtgagccccgtgaagatctgcgacttcgacctgggcagcggcatcaagctgaacggcgactgcagccccatcagcacccccgagctgctgaccccctgcggcagcgccgagtacatggcccccgaggtggtggaggccttcagcgaggaggccagcatctacgacaagagatgcgacctgtggagcctgggcgtgatcctgtacatcctgctgagcggctacccccccttcgtgggcagatgcggcagcgactgcggctgggacagaggcgaggcctgccccgcctgccagaacatgctgttcgagagcatccaggagggcaagtacgagttccccgacaaggactgggcccacatcagctgcgccgccaaggacctgatcagcaagctgctggtgagagacgccaagcagagactgagcgccgcccaggtgctgcagcacccctgggtgcagggctgcgcccccgagaacaccctgcccacccccatggtgctgcagagaaacagctgcgccaaggacctgaccagcttcgccgccgaggccatcgccatgaacagacagctggcccagcacgacgaggacctggccgaggaggaggccgccggccagggccagcccgtgctggtgagagccaccagcagatgcctgcagctgagcccccccagccagagcaagctggcccagagaagacagagagccagcctgagcagcgcccccgtggtgctggtgggcgaccacgcctag

SEQ ID NO: 87996 - DNA, 1245 bp, Artificial Sequence
  Description of Artificial Sequence: Synthetic coding sequence
atggtgcagaagaagcccgccgagctgcagggcttccacagaagcttcaagggccagaaccccttcgagctggccttcagcctggaccagcccgaccacggcgacagcgacttcggcctgcagtgcagcgccagacccgacatgcccgccagccagcccatcgacatccccgacgccaagaagagaggcaagaagaagaagagaggcagagccaccgacagcttcagcggcagattcgaggacgtgtaccagctgcaggaggacgtgctgggcgagggcgcccacgccagagtgcagacctgcatcaacctgatcaccagccaggagtacgccgtgaagatcatcgagaagcagcccggccacatcagaagcagagtgttcagagaggtggagatgctgtaccagtgccagggccacagaaacgtgctggagctgatcgagttcttcgaggaggaggacagattctacctggtgttcgagaagatgagaggcggcagcatcctgagccacatccacaagagaagacacttcaacgagctggaggccagcgtggtggtgcaggacgtggccagcgccctggacttcctgcacaacaagggcatcgcccacagagacctgaagcccgagaacatcctgtgcgagcaccccaaccaggtgagccccgtgaagatctgcgacttcgacctgggcagcggcatcaagctgaacggcgactgcagccccatcagcacccccgagctgctgaccccctgcggcagcgccgagtacatggcccccgaggtggtggaggccttcagcgaggaggccagcatctacgacaagagatgcgacctgtggagcctgggcgtgatcctgtacatcctgctgagcggctacccccccttcgtgggcagatgcggcagcgactgcggctgggacagaggcgaggcctgccccgcctgccagaacatgctgttcgagagcatccaggagggcaagtacgagttccccgacaaggactgggcccacatcagctgcgccgccaaggacctgatcagcaagctgctggtgagagacgccaagcagagactgagcgccgcccaggtgctgcagcacccctgggtgcagggctgcgcccccgagaacaccctgcccacccccatggtgctgcagagatgggacagccacttcctgctgcccccccacccctgcagaatccacgtgagacccggcggcctggtgagaaccgtgaccgtgaacgagtag

SEQ ID NO: 87997 - DNA, 1005 bp, Artificial Sequence
  Description of Artificial Sequence: Synthetic coding sequence
atgctgtaccagtgccagggccacagaaacgtgctggagctgatcgagttcttcgaggaggaggacagattctacctggtgttcgagaagatgagaggcggcagcatcctgagccacatccacaagagaagacacttcaacgagctggaggccagcgtggtggtgcaggacgtggccagcgccctggacttcctgcacaacaagggcatcgcccacagagacctgaagcccgagaacatcctgtgcgagcaccccaaccaggtgagccccgtgaagatctgcgacttcgacctgggcagcggcatcaagctgaacggcgactgcagccccatcagcacccccgagctgctgaccccctgcggcagcgccgagtacatggcccccgaggtggtggaggccttcagcgaggaggccagcatctacgacaagagatgcgacctgtggagcctgggcgtgatcctgtacatcctgctgagcggctacccccccttcgtgggcagatgcggcagcgactgcggctgggacagaggcgaggcctgccccgcctgccagaacatgctgttcgagagcatccaggagggcaagtacgagttccccgacaaggactgggcccacatcagctgcgccgccaaggacctgatcagcaagctgctggtgagagacgccaagcagagactgagcgccgcccaggtgctgcagcacccctgggtgcagggctgcgcccccgagaacaccctgcccacccccatggtgctgcagagaaacagctgcgccaaggacctgaccagcttcgccgccgaggccatcgccatgaacagacagctggcccagcacgacgaggacctggccgaggaggaggccgccggccagggccagcccgtgctggtgagagccaccagcagatgcctgcagctgagcccccccagccagagcaagctggcccagagaagacagagagccagcctgagcagcgcccccgtggtgctggtgggcgaccacgcctag

SEQ ID NO: 87998 - DNA, 1218 bp, Artificial Sequence
  Description of Artificial Sequence: Synthetic coding sequence
atgcccgccagccagcccatcgacatccccgacgccaagaagagaggcaagaagaagaagagaggcagagccaccgacagcttcagcggcagattcgaggacgtgtaccagctgcaggaggacgtgctgggcgagggcgcccacgccagagtgcagacctgcatcaacctgatcaccagccaggagtacgccgtgaagatcatcgagaagcagcccggccacatcagaagcagagtgttcagagaggtggagatgctgtaccagtgccagggccacagaaacgtgctggagctgatcgagaagatgagaggcggcagcatcctgagccacatccacaagagaagacacttcaacgagctggaggccagcgtggtggtgcaggacgtggccagcgccctggacttcctgcacaacaagggcatcgcccacagagacctgaagcccgagaacatcctgtgcgagcaccccaaccaggtgagccccgtgaagatctgcgacttcgacctgggcagcggcatcaagctgaacggcgactgcagccccatcagcacccccgagctgctgaccccctgcggcagcgccgagtacatggcccccgaggtggtggaggccttcagcgaggaggccagcatctacgacaagagatgcgacctgtggagcctgggcgtgatcctgtacatcctgctgagcggctacccccccttcgtgggcagatgcggcagcgactgcggctgggacagaggcgaggcctgccccgcctgccagaacatgctgttcgagagcatccaggagggcaagtacgagttccccgacaaggactgggcccacatcagctgcgccgccaaggacctgatcagcaagctgctggtgagagacgccaagcagagactgagcgccgcccaggtgctgcagcacccctgggtgcagggctgcgcccccgagaacaccctgcccacccccatggtgctgcagagaaacagctgcgccaaggacctgaccagcttcgccgccgaggccatcgccatgaacagacagctggcccagcacgacgaggacctggccgaggaggaggccgccggccagggccagcccgtgctggtgagagccaccagcagatgcctgcagctgagcccccccagccagagcaagctggcccagagaagacagagagccagcctgagcagcgcccccgtggtgctggtgggcgaccacgcctag

SEQ ID NO: 87999 - DNA, 2388 bp, Artificial Sequence
  Description of Artificial Sequence: Synthetic coding sequence
atgagcgccagaacccccctgcccaccgtgaacgagagagacaccgagaaccacaccagcgtggacggctacaccgagccccacatccagcccaccaagagcagcagcagacagaacatccccagatgcagaaacagcatcaccagcgccaccgacgagcagccccacatcggcaactacagactgcagaagaccatcggcaagggcaacttcgccaaggtgaagctggccagacacgtgctgaccggcagagaggtggccgtgaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagtacatcgtgcacagagacctgaaggccgagaacctgctgctggacggcgacatgaacatcaagatcgccgacttcggcttcagcaacgagttcaccgtgggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagctgctggtgctgaaccccatcaagagaggcagcctggagcagatcatgaaggacagatggatgaacgtgggccacgaggaggaggagctgaagccctacaccgagcccgaccccgacttcaacgacaccaagagaatcgacatcatggtgaccatgggcttcgccagagacgagatcaacgacgccctgatcaaccagaagtacgacgaggtgatggccacctacatcctgctgggcagaaagccccccgagttcgagggcggcgagagcctgagcagcggcaacctgtgccagagaagcagacccagcagcgacctgaacaacagcaccctgcagagccccgcccacctgaaggtgcagagaagcatcagcgccaaccagaagcagagaagattcagcgaccacgccggccccagcatcccccccgccgtgagctacaccaagagaccccaggccaacagcgtggagagcgagcagaaggaggagtgggacaaggacgtggccagaaagctgggcagcaccaccgtgggcagcaagagcgagatgaccgccagccccctggtgggccccgagagaaagaagagcagcaccatccccagcaacaacgtgtacagcggcggcagcatggccagaagaaacacctacgtgtgcgagagaaccaccgacagatacgtggccctgcagaacggcaaggacagcagcctgaccgagatgagcgtgagcagcatcagcagcgccggcagcagcgtggccagcgccgtgcccagcgccagacccagacaccagaagagcatgagcaccagcggccaccccatcaaggtgaccctgcccaccatcaaggacggcagcgaggcctacagacccggcaccacccagagagtgcccgccgccagccccagcgcccacagcatcagcaccgccacccccgacagaaccagattccccagaggcagcagcagcagaagcaccttccacggcgagcagctgagagagagaagaagcgtggcctacaacggcccccccgccagccccagccacgagaccggcgccttcgcccacgccagaagaggcaccagcaccggcatcatcagcaagatcaccagcaagttcgtgagaagagaccccagcgagggcgaggccagcggcagaaccgacaccagcagaagcaccagcggcgagcccaaggagagagacaaggaggagggcaaggacagcaagcccagaagcctgagattcacctggagcatgaagaccaccagcagcatggaccccaacgacatgatgagagagatcagaaaggtgctggacgccaacaactgcgactacgagcagaaggagagattcctgctgttctgcgtgcacggcgacgccagacaggacagcctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88000 - DNA, 2277 bp, Artificial Sequence
  Description of Artificial Sequence: Synthetic coding sequence
atgagcgccagaacccccctgcccaccgtgaacgagagagacaccgagaaccacaccagcgtggacggctacaccgagccccacatccagcccaccaagagcagcagcagacagaacatccccagatgcagaaacagcatcaccagcgccaccgacgagcagccccacatcggcaactacagactgcagaagaccatcggcaagggcaacttcgccaaggtgaagctggccagacacgtgctgaccggcagagaggtggccgtgaagatcatcgacaagacccagctgaaccccaccagcctgcagaagctgttcagagaggtgagaatcatgaagatcctgaaccaccccaacatcggcgaggtgttcgactacctggtggcccacggcagaatgaaggagaaggaggccagagccaagttcagacagatcgtgagcgccgtgcagtactgccaccagaagtacatcgtgcacagagacctgaaggccgagaacctgctgctggacggcgacatgaacatcaagatcgccgacttcggcttcagcaacgagttcaccgtgggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagctgctggtgctgaaccccatcaagagaggcagcctggagcagatcatgaaggacagatggatgaacgtgggccacgaggaggaggagctgaagccctacaccgagcccgaccccgacttcaacgacaccaagagaatcgacatcatggtgaccatgggcttcgccagagacgagatcaacgacgccctgatcaaccagaagtacgacgaggtgatggccacctacatcctgctgggcagaaagccccccgagttcgagggcggcgagagcctgagcagcggcaacctgtgccagagaagcagacccagcagcgacctgaacaacagcaccctgcagagccccgcccacctgaaggtgcagagaagcatcagcgccaaccagaagcagagaagattcagcgaccacgccggccccagcatcccccccgccgtgagctacaccaagagaccccaggccaacagcgtggagagcgagcagaaggaggagtgggacaaggacgtggccagaaagctgggcagcaccaccgtgggcagcaagagcgagatgaccgccagccccctggtgggccccgagagaaagaagagcagcaccatccccagcaacaacgtgtacagcggcggcagcatggccagaagaaacacctacgtgtgcgagagaaccaccgacagatacgtggccctgcagaacggcaaggacagcagcctgaccgagatgagcgtgagcagcatcagcagcgccggcagcagcgtggccagcgccgtgcccagcgccagacccagacaccagaagagcatgagcaccagcggccaccccatcaaggtgaccctgcccaccatcaaggacggcagcgaggcctacagacccggcaccacccagagagtgcccgccgccagccccagcgcccacagcatcagcaccgccacccccgacagaaccagattccccagaggcagcagcagcagaagcaccttccacggcgagcagctgagagagagaagaagcgtggcctacaacggcccccccgccagccccagccacgagaccggcgccttcgcccacgccagaagaggcaccagcaccggcatcatcagcaagatcaccagcaagttcgtgagaagaagcaccagcggcgagcccaaggagagagacaaggaggagggcaaggacagcaagcccagaagcctgagattcacctggagcatgaagaccaccagcagcatggaccccaacgacatgatgagagagatcagaaaggtgctggacgccaacaactgcgactacgagcagaaggagagattcctgctgttctgcgtgcacggcgacgccagacaggacagcctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88001 - DNA, 1938 bp, Artificial Sequence
  Description of Artificial Sequence: Synthetic coding sequence
atggagtacgccagcggcggcgaggtgttcgactacctggtggcccacggcagaatgaaggagaaggaggccagagccaagttcagacagatcgtgagcgccgtgcagtactgccaccagaagtacatcgtgcacagagacctgaaggccgagaacctgctgctggacggcgacatgaacatcaagatcgccgacttcggcttcagcaacgagttcaccgtgggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagctgctggtgctgaaccccatcaagagaggcagcctggagcagatcatgaaggacagatggatgaacgtgggccacgaggaggaggagctgaagccctacaccgagcccgaccccgacttcaacgacaccaagagaatcgacatcatggtgaccatgggcttcgccagagacgagatcaacgacgccctgatcaaccagaagtacgacgaggtgatggccacctacatcctgctgggcagaaagccccccgagttcgagggcggcgagagcctgagcagcggcaacctgtgccagagaagcagacccagcagcgacctgaacaacagcaccctgcagagccccgcccacctgaaggtgcagagaagcatcagcgccaaccagaagcagagaagattcagcgaccacgccggccccagcatcccccccgccgtgagctacaccaagagaccccaggccaacagcgtggagagcgagcagaaggaggagtgggacaaggacgtggccagaaagctgggcagcaccaccgtgggcagcaagagcgagatgaccgccagccccctggtgggccccgagagaaagaagagcagcaccatccccagcaacaacgtgtacagcggcggcagcatggccagaagaaacacctacgtgtgcgagagaaccaccgacagatacgtggccctgcagaacggcaaggacagcagcctgaccgagatgagcgtgagcagcatcagcagcgccggcagcagcgtggccagcgccgtgcccagcgccagacccagacaccagaagagcatgagcaccagcggccaccccatcaaggtgaccctgcccaccatcaaggacggcagcgaggcctacagacccggcaccacccagagagtgcccgccgccagccccagcgcccacagcatcagcaccgccacccccgacagaaccagattccccagaggcagcagcagcagaagcaccttccacggcgagcagctgagagagagaagaagcgtggcctacaacggcccccccgccagccccagccacgagaccggcgccttcgcccacgccagaagaggcaccagcaccggcatcatcagcaagatcaccagcaagttcgtgagaagaagcaccagcggcgagcccaaggagagagacaaggaggagggcaaggacagcaagcccagaagcctgagattcacctggagcatgaagaccaccagcagcatggaccccaacgacatgatgagagagatcagaaaggtgctggacgccaacaactgcgactacgagcagaaggagagattcctgctgttctgcgtgcacggcgacgccagacaggacagcctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88002 - DNA, 2340 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccgccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcctgaccatgcccggcagcagagccagcaccgccagcgccagcgccgccgtgagcgccgccagacccagacagcaccagaagagcatgagcgccagcgtgcaccccaacaaggccagcggcctgccccccaccgagagcaactgcgaggtgcccagacccagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88003 - DNA, 2130 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88004 - DNA, 2160 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccgccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgagcttcagattcgccagaagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88005 - DNA, 2322 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccgccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcctgaccatgcccggcagcagagccagcaccgccagcgccagcgccgccgtgagcgccgccagacccagacagcaccagaagagcatgagcgccagcgtgcaccccaacaaggccagcggcctgccccccaccgagagcaactgcgaggtgcccagacccagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgagcttcagattcgccagaagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88006 - DNA, 2076 bp, Artificial Sequence
  Description of Artificial Sequence: Synthetic coding sequence
atgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88007 - DNA, 2367 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccgccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcctgaccatgcccggcagcagagccagcaccgccagcgccagcgccgccgtgagcgccgccagacccagacagcaccagaagagcatgagcgccagcgtgcaccccaacaaggccagcggcctgccccccaccgagagcaactgcgaggtgcccagacccagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgagcttcagattcgccagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88008 - DNA, 2076 bp, Artificial Sequence; identical to SEQ ID NO: 88006
  Description of Artificial Sequence: Synthetic coding sequence

SEQ ID NO: 88009 - DNA, 2205 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccgccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgagcttcagattcgccagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88010 - DNA, 2343 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcctgaccatgcccggcagcagagccagcaccgccagcgccagcgccgccgtgagcgccgccagacccagacagcaccagaagagcatgagcgccagcgtgcaccccaacaaggccagcggcctgccccccaccgagagcaactgcgaggtgcccagacccagacaggtgaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88011 - DNA, 126 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgcctag

SEQ ID NO: 88012 - DNA, 2175 bp, Artificial Sequence
  Description of Artificial Sequence: Synthetic coding sequence
atgagcagcgccagaacccccctgcccaccctgaacgagagagacaccgagcagcccaccctgggccacctggacagcaagcccagcagcaagagcaacatgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88013 - DNA, 186 bp, Artificial Sequence
  Description of Artificial Sequence: Synthetic coding sequence
atggaggtggccggcagccccttccccttcctgcagagcgtggcctgcctgctgaccctggcccacatccccgccgtgggcaacatcctgcagcacagaagaagaggcgccggccccaccctgggccacctggacagcaagcccagcagcaagagcaacatgatcagaggcagaaacagcgcctag

SEQ ID NO: 88014 - DNA, 339 bp, Artificial Sequence
  Description of Artificial Sequence: Synthetic coding sequence
atgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggctag

SEQ ID NO: 88015 - DNA, 486 bp, Artificial Sequence
  Description of Artificial Sequence: Synthetic coding sequence
atgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttctag

SEQ ID NO: 88016 - DNA, 276 bp, Artificial Sequence
  Description of Artificial Sequence: Synthetic coding sequence
atgggcggccagagaaacaccagcgtgggcaacatcgtgcagagatggagagaccacgtggtgtgccagaaggccggcgtgatctacagcggcagaaaggcccaggagcacggcaccggcagaaccgacttcacccccgcccagagactgatgatgcccaccctgggccacctggacagcaagcccagcagcaagagcaacatgatcagaggcagaaacagcgccaccagcgccgacgagcagccccacatcggcaactacagactgctgaagtag

SEQ ID NO: 88017 - DNA, 2238 bp, Artificial Sequence
  Description of Artificial Sequence: Synthetic coding sequence
atgatcagaggcagaaacagcgccaccagcgccgacgagcagccccacatcggcaactacagactgctgaagaccatcggcaagggcaacttcgccaaggtgaagctggccagacacatcctgaccggcaaggaggtggccgtgaagatcatcgacaagacccagctgaacagcagcagcctgcagaagctgttcagagaggtgagaatcatgaaggtgctgaaccaccccaacatcgtgaagctgttcgaggtgatcgagaccgagaagaccctgtacctggtgatggagtacgccagcggcggcgaggtgttcgactacctggtggcccacggcagaatgaaggagaaggaggccagagccaagttcagacagatcgtgagcgccgtgcagtactgccaccagaagttcatcgtgcacagagacctgaaggccgagaacctgctgctggacgccgacatgaacatcaagatcgccgacttcggcttcagcaacgagttcaccttcggcaacaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagaagttcctgatcctgaaccccagcaagagaggcaccctggagcagatcatgaaggacagatggatgaacgtgggccacgaggacgacgagctgaagccctacgtggagcccctgcccgactacaaggaccccagaagaaccgagctgatggtgagcatgggctacaccagagaggagatccaggacagcctggtgggccagagatacaacgaggtgatggccacctacctgctgctgggctacaagagcagcgagctggagggcgacaccatcaccctgaagcccagacccagcgccgacctgaccaacagcagcgcccccagccccagccacaaggtgcagagaagcgtgagcgccaaccccaagcagagaagattcagcgaccaggccggccccgccatccccaccagcaacagctacagcaagaagacccagagcaacaacgccgagaacaagagacccgaggaggacagagagagcggcagaaaggccagcagcaccgccaaggtgcccgccagccccctgcccggcctggagagaaagaagaccacccccacccccagcaccaacagcgtgctgagcaccagcaccaacagaagcagaaacagccccctgctggagagagccagcctgggccaggccagcatccagaacggcaaggacagcctgaccatgcccggcagcagagccagcaccgccagcgccagcgccgccgtgagcgccgccagacccagacagcaccagaagagcatgagcgccagcgtgcaccccaacaaggccagcggcctgccccccaccgagagcaactgcgaggtgcccagacccagcaccgccccccagagagtgcccgtggccagccccagcgcccacaacatcagcagcagcggcggcgcccccgacagaaccaacttccccagaggcgtgagcagcagaagcaccttccacgccggccagctgagacaggtgagagaccagcagaacctgccctacggcgtgacccccgccagccccagcggccacagccagggcagaagaggcgccagcggcagcatcttcagcaagttcaccagcaagttcgtgagaagaaacctgaacgagcccgagagcaaggacagagtggagaccctgagaccccacgtggtgggcagcggcggcaacgacaaggagaaggaggagttcagagaggccaagcccagaagcctgagattcacctggagcatgaagaccaccagcagcatggagcccaacgagatgatgagagagatcagaaaggtgctggacgccaacagctgccagagcgagctgcacgagaagtacatgctgctgtgcatgcacggcacccccggccacgaggacttcgtgcagtgggagatggaggtgtgcaagctgcccagactgagcctgaacggcgtgagattcaagagaatcagcggcaccagcatggccttcaagaacatcgccagcaagatcgccaacgagctgaagctgtag

SEQ ID NO: 88018 - DNA, 4128 bp, Artificial Sequence
  Description of Artificial Sequence: Synthetic coding sequence
atggagggcgacagagtggccggcagacccgtgctgagcagcctgcccgtgctgctgctgctgcccctgctgatgctgagagccgccgccctgcaccccgacgagctgttcccccacggcgagagctggggcgaccagctgctgcaggagggcgacgacgagagcagcgccgtggtgaagctggccaaccccctgcacttctacgaggccagattcagcaacctgtacgtgggcaccaacggcatcatcagcacccaggacttccccagagagacccagtacgtggactacgacttccccaccgacttccccgccatcgcccccttcctggccgacatcgacaccagccacggcagaggcagagtgctgtacagagaggacaccagccccgccgtgctgggcctggccgccagatacgtgagagccggcttccccagaagcgccagattcacccccacccacgccttcctggccacctgggagcaggtgggcgcctacgaggaggtgaagagaggcgccctgcccagcggcgagctgaacaccttccaggccgtgctggccagcgacggcagcgacagctacgccctgttcctgtaccccgccaacggcctgcagttcctgggcaccagacccaaggagagctacaacgtgcagctgcagctgcccgccagagtgggcttctgcagaggcgaggccgacgacctgaagagcgagggcccctacttcagcctgaccagcaccgagcagagcgtgaagaacctgtaccagctgagcaacctgggcatccccggcgtgtgggccttccacatcggcagcaccagccccctggacaacgtgagacccgccgccgtgggcgacctgagcgccgcccacagcagcgtgcccctgggcagaagcttcagccacgccaccgccctggagagcgactacaacgaggacaacctggactactacgacgtgaacgaggaggaggccgagtacctgcccggcgagcccgaggaggccctgaacggccacagcagcatcgacgtgagcttccagagcaaggtggacaccaagcccctggaggagagcagcaccctggacccccacaccaaggagggcaccagcctgggcgaggtgggcggccccgacctgaagggccaggtggagccctgggacgagagagagaccagaagccccgccccccccgaggtggacagagacagcctggcccccagctgggagaccccccccccctaccccgagaacggcagcatccagccctaccccgacggcggccccgtgcccagcgagatggacgtgccccccgcccaccccgaggaggagatcgtgctgagaagctaccccgccagcggccacaccacccccctgagcagaggcacctacgaggtgggcctggaggacaacatcggcagcaacaccgaggtgttcacctacaacgccgccaacaaggagacctgcgagcacaaccacagacagtgcagcagacacgccttctgcaccgactacgccaccggcttctgctgccactgccagagcaagttctacggcaacggcaagcactgcctgcccgagggcgccccccacagagtgaacggcaaggtgagcggccacctgcacgtgggccacacccccgtgcacttcaccgacgtggacctgcacgcctacatcgtgggcaacgacggcagagcctacaccgccatcagccacatcccccagcccgccgcccaggccctgctgcccctgacccccatcggcggcctgttcggctggctgttcgccctggagaagcccggcagcgagaacggcttcagcctggccggcgccgccttcacccacgacatggaggtgaccttctaccccggcgaggagaccgtgagaatcacccagaccgccgagggcctggaccccgagaactacctgagcatcaagaccaacatccagggccaggtgccctacgtgagcgccaacttcaccgcccacatcagcccctacaaggagctgtaccactacagcgacagcaccgtgaccagcaccagcagcagagactacagcctgaccttcggcgccatcaaccagacctggagctacagaatccaccagaacatcacctaccaggtgtgcagacacgcccccagacaccccagcttccccaccacccagcagctgaacgtggacagagtgttcgccctgtacaacgacgaggagagagtgctgagattcgccgtgaccaaccagatcggccccgtgaaggaggacagcgaccccacccccggcaacccctgctacgacggcagccacatgtgcgacaccaccgccagatgccaccccggcaccggcgtggactacacctgcgagtgcgccagcggctaccagggcgacggcagaaactgcgtggacgagaacgagtgcgccaccggcttccacagatgcggccccaacagcgtgtgcatcaacctgcccggcagctacagatgcgagtgcagaagcggctacgagttcgccgacgacagacacacctgcatcctgatcaccccccccgccaacccctgcgaggacggcagccacacctgcgcccccgccggccaggccagatgcgtgcaccacggcggcagcaccttcagctgcgcctgcctgcccggctacgccggcgacggccaccagtgcaccgacgtggacgagtgcagcgagaacagatgccaccccgccgccacctgctacaacacccccggcagcttcagctgcagatgccagcccggctactacggcgacggcttccagtgcatccccgacagcaccagcagcctgaccccctgcgagcagcagcagagacacgcccaggcccagtacgcctaccccggcgccagattccacatcccccagtgcgacgagcagggcaacttcctgcccctgcagtgccacggcagcaccggcttctgctggtgcgtggaccccgacggccacgaggtgcccggcacccagaccccccccggcagcacccccccccactgcggccccagccccgagcccacccagagaccccccaccatctgcgagagatggagagagaacctgctggagcactacggcggcacccccagagacgaccagtacgtgccccagtgcgacgacctgggccacttcatccccctgcagtgccacggcaagagcgacttctgctggtgcgtggacaaggacggcagagaggtgcagggcaccagaagccagcccggcaccacccccgcctgcatccccaccgtggccccccccatggtgagacccacccccagacccgacgtgaccccccccagcgtgggcaccttcctgctgtacacccagggccagcagatcggctacctgcccctgaacggcaccagactgcagaaggacgccgccaagaccctgctgagcctgcacggcagcatcatcgtgggcatcgactacgactgcagagagagaatggtgtactggaccgacgtggccggcagaaccatcagcagagccggcctggagctgggcgccgagcccgagaccatcgtgaacagcggcctgatcagccccgagggcctggccatcgaccacatcagaagaaccatgtactggaccgacagcgtgctggacaagatcgagagcgccctgctggacggcagcgagagaaaggtgctgttctacaccgacctggtgaaccccagagccatcgccgtggaccccatcagaggcaacctgtactggaccgactggaacagagaggcccccaagatcgagaccagcagcctggacggcgagaacagaagaatcctgatcaacaccgacatcggcctgcccaacggcctgaccttcgaccccttcagcaagctgctgtgctgggccgacgccggcaccaagaagctggagtgcaccctgcccgacggcaccggcagaagagtgatccagaacaacctgaagtaccccttcagcatcgtgagctacgccgaccacttctaccacaccgactggagaagagacggcgtggtgagcgtgaacaagcacagcggccagttcaccgacgagtacctgcccgagcagagaagccacctgtacggcatcaccgccgtgtacccctactgccccaccggcagaaagtag

SEQ ID NO: 88019 - DNA, 2190 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagatcgtgagcgccgtgcagtactgccaccagaagagaatcgtgcacagagacctgaaggccgagaacctgctgctggacgccgacatgaacatcaagatcgccgacttcggcttcagcaacgagttcaccgtgggcggcaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88020 - DNA, 1338 bp, Artificial Sequence
  Description of Artificial Sequence: Synthetic coding sequence
atgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcctgaccgagatgttcgcctacgccgccagccccgccagcgtgtgcaccagcacctgcagactgagacaccagaagagcatgagcatgagcgccagcggccaccccaagatgatgctgccccccatcgacagcgagggcgacaacttcaaggccatcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagactgcccaccgagtacgagagaaacggcagatacgagggcagcagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88021 - DNA, 2259 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagggctgccaggccggccagaccatcaaggtgcaggtgagcttcgacctgctgagcctgatgttcaccttcatcgtgagcgccgtgcagtactgccaccagaagagaatcgtgcacagagacctgaaggccgagaacctgctgctggacgccgacatgaacatcaagatcgccgacttcggcttcagcaacgagttcaccgtgggcggcaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88022 - DNA, 2262 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagatcgtgagcgccgtgcagtactgccaccagaagagaatcgtgcacagagacctgaaggccgagaacctgctgctggacgccgacatgaacatcaagatcgccgacttcggcttcagcaacgagttcaccgtgggcggcaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagaaacatgagcttcagattcatcaagagactgcccaccgagtacgagagaaacggcagatacgagggcagcagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88023 - DNA, 1980 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagatcgtgagcgccgtgcagtactgccaccagaagagaatcgtgcacagagacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagaaacatgagcttcagattcatcaagagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88024 - DNA, 2235 bp, Artificial Sequence
  Description of Artificial Sequence: Synthetic coding sequence
atgagcaccagaacccccctgcccaccgtgaacgagagagacaccgagaaccacaccagccacggcgacggcagacaggaggtgaccagcagaaccagcagaagcggcgccagatgcagaaacagcatcgccagctgcgccgacgagcagccccacatcggcaactacagactgctgaagaccatcggcaagggcaacttcgccaaggtgaagctggccagacacatcctgaccggcagagaggtggccatcaagatcatcgacaagacccagctgaaccccaccagcctgcagaagctgttcagagaggtgagaatcatgaagatcctgaaccaccccaacatcgtgaagctgttcgaggtgatcgagaccgagaagaccctgtacctgatcatggagtacgccagcggcggcgaggtgttcgactacctggtggcccacggcagaatgaaggagaaggaggccagaagcaagttcagacagatcgtgagcgccgtgcagtactgccaccagaagagaatcgtgcacagagacctgaaggccgagaacctgctgctggacgccgacatgaacatcaagatcgccgacttcggcttcagcaacgagttcaccgtgggcggcaagctggacaccttctgcggcagccccccctacgccgcccccgagctgttccagggcaagaagtacgacggccccgaggtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgagctggacgccagcgacagcagcagcagcagcaacctgagcctggccaaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagactgcccaccgagtacgagagaaacggcagatacgagggcagcagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88025 - DNA, 1518 bp, Artificial Sequence
  Description of Artificial Sequence: Synthetic coding sequence
tgagtggacgtgtggagcctgggcgtgatcctgtacaccctggtgagcggcagcctgcccttcgacggccagaacctgaaggagctgagagagagagtgctgagaggcaagtacagaatccccttctacatgagcaccgactgcgagaacctgctgaagagattcctggtgctgaaccccatcaagagaggcaccctggagcagatcatgaaggacagatggatcaacgccggccacgaggaggacgagctgaagcccttcgtggagcccgagctggacatcagcgaccagaagagaatcgacatcatggtgggcatgggctacagccaggaggagatccaggagagcctgagcaagatgaagtacgacgagatcaccgccacctacctgctgctgggcagaaagagcagcgaggtgagacccagcagcgacctgaacaacagcaccggccagagcccccaccacaaggtgcagagaagcgtgttcagcagccagaagcagagaagatacagcgaccacgccggccccgccatccccagcgtggtggcctaccccaagagaagccagaccagcaccgccgacagcgacctgaaggaggacggcatcagcagcagaaagagcagcggcagcgccgtgggcggcaagggcatcgcccccgccagccccatgctgggcaacgccagcaaccccaacaaggccgacatccccgagagaaagaagagcagcaccgtgcccagcagcaacaccgccagcggcggcatgaccagaagaaacacctacgtgtgcagcgagagaaccaccgccgacagacacagcgtgatccagaacggcaaggagaacagcaccatccccgaccagagaacccccgtggccagcacccacagcatcagcagcgccgccacccccgacagaatcagattccccagaggcaccgccagcagaagcaccttccacggccagcccagagagagaagaaccgccacctacaacggcccccccgccagccccagcctgagccacgaggccacccccctgagccagaccagaagcagaggcagcaccaacctgttcagcaagctgaccagcaagctgaccagaagaaacatgagcttcagattcatcaagagactgcccaccgagtacgagagaaacggcagatacgagggcagcagcagaaacgtgagcgccgagcagaaggacgagaacaaggaggccaagcccagaagcctgagattcacctggagcatgaagaccaccagcagcatggaccccggcgacatgatgagagagatcagaaaggtgctggacgccaacaactgcgactacgagcagagagagagattcctgctgttctgcgtgcacggcgacggccacgccgagaacctggtgcagtgggagatggaggtgtgcaagctgcccagactgagcctgaacggcgtgagattcaagagaatcagcggcaccagcatcgccttcaagaacatcgccagcaagatcgccaacgagctgaagctgtag

SEQ ID NO: 88026 - DNA, 2259 bp, Artificial Sequence
  Description of Artificial Sequence: Synthetic coding sequence
atgagcagcagaaccgtgctggcccccggcaacgacagaaacagcgacacccacggcaccctgggcagcggcagaagcagcgacaagggccccagctggagcagcagaagcctgggcgccagatgcagaaacagcatcgccagctgccccgaggagcagccccacgtgggcaactacagactgctgagaaccatcggcaagggcaacttcgccaaggtgaagctggccagacacatcctgaccggcagagaggtggccatcaagatcatcgacaagacccagctgaaccccagcagcctgcagaagctgttcagagaggtgagaatcatgaagggcctgaaccaccccaacatcgtgaagctgttcgaggtgatcgagaccgagaagaccctgtacctggtgatggagtacgccagcgccggcgaggtgttcgactacctggtgagccacggcagaatgaaggagaaggaggccagagccaagttcagacagatcgtgagcgccgtgcactactgccaccagaagaacatcgtgcacagagacctgaaggccgagaacctgctgctggacgccgaggccaacatcaagatcgccgacttcggcttcagcaacgagttcaccctgggcagcaagctggacaccttctgcggcagccccccctacgccgcccccgagctgttccagggcaagaagtacgacggccccgaggtggacatctggagcctgggcgtgatcctgtacaccctggtgagcggcagcctgcccttcgacggccacaacctgaaggagctgagagagagagtgctgagaggcaagtacagagtgcccttctacatgagcaccgactgcgagagcatcctgagaagattcctggtgctgaaccccgccaagagatgcaccctggagcagatcatgaaggacaagtggatcaacatcggctacgagggcgaggagctgaagccctacaccgagcccgaggaggacttcggcgacaccaagagaatcgaggtgatggtgggcatgggctacaccagagaggagatcaaggagagcctgaccagccagaagtacaacgaggtgaccgccacctacctgctgctgggcagaaagaccgaggagggcggcgacagaggcgcccccggcctggccctggccagagtgagagcccccagcgacaccaccaacggcaccagcagcagcaagggcaccagccacagcaagggccagagaagcagcagcagcacctaccacagacagagaagacacagcgacttctgcggccccagccccgcccccctgcaccccaagagaagccccaccagcaccggcgaggccgagctgaaggaggagagactgcccggcagaaaggccagctgcagcaccgccggcagcggcagcagaggcctgccccccagcagccccatggtgagcagcgcccacaaccccaacaaggccgagatccccgagagaagaaaggacagcaccagcacccccaacaacctgccccccagcatgatgaccagaagaaacacctacgtgtgcaccgagagacccggcgccgagagacccagcctgctgcccaacggcaaggagaacagcagcggcacccccagagtgccccccgccagccccagcagccacagcctggccccccccagcggcgagagaagcagactggccagaggcagcaccatcagaagcaccttccacggcggccaggtgagagacagaagagccggcggcggcggcggcggcggcgtgcagaacggcccccccgccagccccaccctggcccacgaggccgcccccctgcccgccggcagacccagacccaccaccaacctgttcaccaagctgaccagcaagctgaccagaagagtggccgacgagcccgagagaatcggcggccccgaggtgaccagctgccacctgccctgggaccagaccgagaccgcccccagactgctgagattcccctggagcgtgaagctgaccagcagcagaccccccgaggccctgatggccgccctgagacaggccaccgccgccgccagatgcagatgcagacagccccagcccttcctgctggcctgcctgcacggcggcgccggcggccccgagcccctgagccacttcgaggtggaggtgtgccagctgcccagacccggcctgagaggcgtgctgttcagaagagtggccggcaccgccctggccttcagaaccctggtgaccagaatcagcaacgacctggagctgtag

SEQ ID NO: 88027 - DNA, 1389 bp, Artificial Sequence
  Description of Artificial Sequence: Synthetic coding sequence
atgagcagcagaaccgtgctggcccccggcaacgacagaaacagcgacacccacggcaccctgggcagcggcagaagcagcgacaagggccccagctggagcagcagaagcctgggcgccagatgcagaaacagcatcgccagctgccccgaggagcagccccacgtgggcaactacagactgctgagaaccatcggcaagggcaacttcgccaaggtgaagctggccagacacatcctgaccggcagagaggtggccatcaagatcatcgacaagacccagctgaaccccagcagcctgcagaagctgttcagagaggtgagaatcatgaagggcctgaaccaccccaacatcgtgaagctgttcgaggtgatcgagaccgagaagaccctgtacctggtgatggagtacgccagcgccggcgagccccccaccctgagcgccctgcccctgtgccacctgcccctgcccctgcacctgaccctgacccccctgggcctgtgccccgccggcgaggtgttcgactacctggtgagccacggcagaatgaaggagaaggaggccagagccaagttcagacagatcgtgagcgccgtgcactactgccaccagaagaacatcgtgcacagagacctgaaggccgagaacctgctgctggacgccgaggccaacatcaagatcgccgacttcggcttcagcaacgagttcaccctgggcagcaagctggacaccttctgcggcagccccccctacgccgcccccgagctgttccagggcaagaagtacgacggccccgaggtggacatctggagcctgggcgtgatcctgtacaccctggtgagcggcagcctgcccttcgacggccacaacctgaaggagctgagagagagagtgctgagaggcaagtacagagtgcccttctacatgagcaccgactgcgagagcatcctgagaagattcctggtgctgaaccccgccaagagatgcaccctggagcagatcatgaaggacaagtggatcaacatcggctacgagggcgaggagctgaagccctacaccgagcccgaggaggacttcggcgacaccaagagaatcgaggtgatggtgggcatgggctacaccagagaggagatcaaggagagcctgaccagccagaagtacaacgaggtgaccgccacctacctgctgctgggcagaaagaccgagcccgacgagcacggcggcggcggcgccgagggcggcgccgccgccagacccgagggcgagctgcagcacagaggcgagtgggagagcagagccgcccccctgcagccccacggccagcagagaccccagccccagcagggcagagaccccagagccgccgagggccagcacgagcacccctag

SEQ ID NO: 88028 - DNA, 2067 bp, Artificial Sequence
  Description of Artificial Sequence: Synthetic coding sequence
atgagcagcagaaccgtgctggcccccggcaacgacagaaacagcgacacccacggcaccctgggcagcggcagaagcagcgacaagggccccagctggagcagcagaagcctgggcgccagatgcagaaacagcatcgccagctgccccgaggagcagccccacgtgggcaactacagactgctgagaaccatcggcaagggcaacttcgccaaggtgaagctggccagacacatcctgaccggcagagaggtggccatcaagatcatcgacaagacccagctgaaccccagcagcctgcagaagctgttcagagaggtgagaatcatgaagggcctgaaccaccccaacatcgtgaagctgttcgaggtgatcgagaccgagaagaccctgtacctggtgatggagtacgccagcgccggcgaggtgttcgactacctggtgagccacggcagaatgaaggagaaggaggccagagccaagttcagacagatcgtgagcgccgtgcactactgccaccagaagaacatcgtgcacagagacctgaaggccgagaacctgctgctggacgccgaggccaacatcaagatcgccgacttcggcttcagcaacgagttcaccctgggcagcaagctggacaccttctgcggcagccccccctacgccgcccccgagctgttccagggcaagaagtacgacggccccgaggtggacatctggagcctgggcgtgatcctgtacaccctggtgagcggcagcctgcccttcgacggccacaacctgaaggagctgagagagagagtgctgagaggcaagtacagagtgcccttctacatgagcaccgactgcgagagcatcctgagaagattcctggtgctgaaccccgccaagagatgcaccctggagcagatcatgaaggacaagtggatcaacatcggctacgagggcgaggagctgaagccctacaccgagcccgaggaggacttcggcgacaccaagagaatcgaggtgatggtgggcatgggctacaccagagaggagatcaaggagagcctgaccagccagaagtacaacgaggtgaccgccacctacctgctgctgggcagaaagaccgaggagggcggcgacagaggcgcccccggcctggccctggccagagtgagagcccccagcgacaccaccaacggcaccagcagcagcaagggcaccagccacagcaagggccagagaagcagcagcagcacctaccacagacagagaagacacagcgacttctgcggccccagccccgcccccctgcaccccaagagaagccccaccagcaccggcgaggccgagctgaaggaggagagactgcccggcagaaaggccagctgcagcaccgccggcagcggcagcagaggcctgccccccagcagccccatggtgagcagcgcccacaaccccaacaaggccgagatccccgagagaagaaaggacagcaccagcacccccaacaacctgccccccagcatgatgaccagaagaaacacctacgtgtgcaccgagagacccggcgccgagagacccagcctgctgcccaacggcaaggagaacagcagcggcacccccagagtgccccccgccagccccagcagccacagcctggccccccccagcggcgagagaagcagactggccagaggcagcaccatcagaagcaccttccacggcggccaggtgagagacagaagagccggcggcggcggcggcggcggcgtgcagaacggcccccccgccagccccaccctggcccacgaggccgcccccctgcccgccggcagacccagacccaccaccaacctgttcaccaagctgaccagcaagctgaccagaagagtgaccctggaccccagcaagagacagaacagcaacagatgcgtgagcggcgccagcctgccccagggcagcaagatcagaagccagaccaacctgagagagagcggcgacctgagaagccaggtggccatctacctgggcatcaagagaaagcccccccccggctgcagcgacagccccggcgtgtag

SEQ ID NO: 88029 - DNA, 240 bp, Artificial Sequence
  Description of Artificial Sequence: Synthetic coding sequence
atggccgccctgagacaggccaccgccgccgccagatgcagatgcagacagccccagcccttcctgctggcctgcctgcacggcggcgccggcggccccgagcccctgagccacttcgaggtggaggtgtgccagctgcccagacccggcctgagaggcgtgctgttcagaagagtggccggcaccgccctggccttcagaaccctggtgaccagaatcagcaacgacctggagctgtag

SEQ ID NO: 88030 - DNA, 1032 bp, Artificial Sequence
  Description of Artificial Sequence: Synthetic coding sequence
atggccgccgccaccgagctgaacagacccagcagcggcgacagaaacctggagagaagatgcagacccaacctgagcagagaggtgctgtacgagatcttcagaagcctgcacaccctggtgggccagctggacctgagagacgacgtggtgaagatcaccatcgactggaacaagctgcagagcctgagcgccttccagcccgccctgctgttcagcgccctggagcagcacatcctgtacctgcagcccttcctggccaagctgcagagccccatcaaggaggagaacaccaccgccgtggaggagatcggcagaaccgagatgggcaacaagaacgaggtgaacgacaagttcagcatcggcgacctgcaggaggaggagaagcacaaggagagcgacctgagagacgtgaagaagacccagatccacttcgaccccgaggtggtgcagatcaaggccggcaaggccgagatcgacagaagaatcagcgccttcatcgagagaaagcaggccgagatcaacgagaacaacgtgagagagttctgcaacgtgatcgactgcaaccaggagaacagctgcgccagaaccgacgccatcttcaccccctaccccggcttcaagagccacgtgaaggtgagcagagtggtgaacacctacggcccccagaccagacccgagggcatccccggcagcggccacaagcccaacagcatgctgagagactgcggcaaccaggccgtggaggagagactgcagaacatcgaggcccacctgagactgcagaccggcggccccgtgcccagagacatctaccagagaatcaagaagctggaggacaagatcctggagctggagggcatcagccccgagtacttccagagcgtgagcttcagcggcaagagaagaaaggtgcagcccccccagaactacagcctggccgagctggacgagaagatcagcgccctgaagcaggccctgctgagaaagagcagagaggccgagagcatggccacccaccacctgccctag

SEQ ID NO: 88031 - DNA, 1035 bp, Artificial Sequence
  Description of Artificial Sequence: Synthetic coding sequence
atggccgccgccaccgagctgaacagacccagcagcggcgacagaaacctggagagaagatgcagacccaacctgagcagagaggtgctgtacgagatcttcagaagcctgcacaccctggtgggccagctggacctgagagacgacgtggtgaagatcaccatcgactggaacaagctgcagagcctgagcgccttccagcccgccctgctgttcagcgccctggagcagcacatcctgtacctgcagcccttcctggccaagctgcagagccccatcaaggaggagaacaccaccgccgtggaggagatcggcagaaccgagatgggcaacaagaacgaggtgaacgacaagttcagcatcggcgacctgcaggaggaggagaagcacaaggagagcgacctgagagacgtgaagaagacccagatccacttcgaccccgaggtggtgcagatcaaggccggcaaggccgagatcgacagaagaatcagcgccttcatcgagagaaagcaggccgagatcaacgagaacaacgtgagagagttctgcaacgtgatcgactgcaaccaggagaacagctgcgccagaaccgacgccatcttcaccccctaccccggcttcaagagccacgtgaaggtgagcagagtggtgaacacctacggcccccagaccagacccgagggcatccccggcagcggccacaagcccaacagcatgctgagagactgcggcaaccaggccgtggaggagagactgcagaacatcgaggcccacctgagactgcagaccggcggccccgtgcccagagacatctaccagagaatcaagaagctggaggacaagatcctggagctggagggcatcagccccgagtacttccagagcgtgagcttcagcggcaagagaagaaaggtgcagcccccccagcagaactacagcctggccgagctggacgagaagatcagcgccctgaagcaggccctgctgagaaagagcagagaggccgagagcatggccacccaccacctgccctag

SEQ ID NO: 88032 - DNA, 4944 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcagcgtgagaagaagaatctacgacaacccctacttcgagccccagtacggcttcccccccgaggaggacgaggacgagcagggcgagagctacacccccagattcagccagcacgtgagcggcaacagagcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaaggtgttcggcctgaacaccctgatggagatcgtgaccgaggccggccccggcagcggcgagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcgagctgtggaacaagcaccaggaggtgaagaagcagaaggccctggagaagcagagacccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcagagacaagggcagcatgtgggaccagctggaggacgccgccatggagaccttcagcatcagcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88033 - DNA, 4767 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcagcgtgagaagaagaatctacgacaacccctacttcgagccccagtacggcttcccccccgaggaggacgaggacgagcagggcgagagctacacccccagattcagccagcacgtgagcggcaacagagcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88034 - DNA, 4827 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcagcgtgagaagaagaatctacgacaacccctacttcgagccccagtacggcttcccccccgaggaggacgaggacgagcagggcgagagctacacccccagattcagccagcacgtgagcggcaacagagcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaaggtgttcggcctgaacaccctgatggagatcgtgaccgaggccggccccggcagcggcgagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88035 - DNA, 4746 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcagcgtgagaagaagaatctacgacaacccctacttcgagccccagtacggcttcccccccgaggaggacgaggacgagcagggcgagagctacacccccagattcagccagcacgtgagcggcaacagagcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaaggtgttcggcctgaacaccctgatggagatcgtgaccgaggccggccccggcagcggcgagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcgagctgtggaacaagcaccaggaggtgaagaagcagaaggccctggagaagcagagacccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcagagacaagggcagcatgtgggaccagctggaggacgccgccatggagaccttcagcatcagcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccagttcctgaagctgaagaagtggtag

SEQ ID NO: 88036 - DNA, 4440 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcgcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccagctgctgagaagactgagatggtag

SEQ ID NO: 88037 - DNA, 4626 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcgcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88038 - DNA, 4764 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcagcgtgagaagaagaatctacgacaacccctacttcgagccccagtacggcttcccccccgaggaggacgaggacgagcagggcgagagctacacccccagattcagccagcacgtgagcggcaacagagcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88039 - DNA, 4638 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcgcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88040 - DNA, 4440 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcgcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccagttcctgaagctgaagaagtggtag

SEQ ID NO: 88041 - DNA, 4698 bp, Artificial Sequence
  Description of Artificial Sequence: Synthetic coding sequence
atggtgcagaagaagaagttctgccccagactgctggactacctggtgatcgtgggcgccagacaccccagcagcgacagcgtggcccagacccccgagctgctgagaagataccccctggaggaccacaccgagttccccctgccccccgacgtggtgttcttctgccagcccgagggctgcctgagcgtgagacagagaagaatgagcctgagagacgacaccagcttcgtgttcaccctgaccgacaaggacaccggcgtgaccagatacggcatctgcgtgaacttctacagaagcttccagaagagaatcagcaaggagaagggcgagggcggcgccggcagcagaggcaaggagggcacccacgccacctgcgccagcgaggagggcggcaccgagagcagcgagagcggcagcagcctgcagcccctgagcgccgacagcacccccgacgtgaaccagagccccagaggcaagagaagagccaaggccggcagcagaagcagaaacagcaccctgaccagcctgtgcgtgctgagccactaccccttcttcagcaccttcagagagtgcctgtacaccctgaagagactggtggactgctgcagcgagagactgctgggcaagaagctgggcatccccagaggcgtgcagagagacaccatgtggagaatcttcaccggcagcctgctggtggaggagaagagcagcgccctgctgcacgacctgagagagatcgaggcctggatctacagactgctgagaagccccgtgcccgtgagcggccagaagagagtggacatcgaggtgctgccccaggagctgcagcccgccctgaccttcgccctgcccgaccccagcagattcaccctggtggacttccccctgcacctgcccctggagctgctgggcgtggacgcctgcctgcaggtgctgacctgcatcctgctggagcacaaggtggtgctgcagagcagagactacaacgccctgagcatgagcgtgatggccttcgtggccatgatctaccccctggagtacatgttccccgtgatccccctgctgcccacctgcatggccagcgccgagcagctgctgctggcccccaccccctacatcatcggcgtgcccgccagcttcttcctgtacaagctggacttcaagatgcccgacgacgtgtggctggtggacctggacagcaacagagtgatcgcccccaccaacgccgaggtgctgcccatcctgcccgagcccgagagcctggagctgaagaagcacctgaagcaggccctggccagcatgagcctgaacacccagcccatcctgaacctggagaagttccacgagggccaggagatccccctgctgctgggcagacccagcaacgacctgcagagcacccccagcaccgagttcaaccccctgatctacggcaacgacgtggacagcgtggacgtggccaccagagtggccatggtgagattcttcaacagcgccaacgtgctgcagggcttccagatgcacaccagaaccctgagactgttccccagacccgtggtggccttccaggccggcagcttcctggccagcagacccagacagacccccttcgccgagaagctggccagaacccaggccgtggagtacttcggcgagtggatcctgaaccccaccaactacgccttccagagaatccacaacaacatgttcgaccccgccctgatcggcgacaagcccaagtggtacgcccaccagctgcagcccatccactacagagtgtacgacagcaacagccagctggccgaggccctgagcgtgccccccgagagagacagcgacagcgagcccaccgacgacagcggcagcgacagcatggactacgacgacagcagcagcagctacagcagcctgggcgacttcgtgagcgagatgatgaagtgcgacatcaacggcgacacccccaacgtggaccccctgacccacgccgccctgggcgacgccagcgaggtggagatcgacgagctgcagaaccagaaggaggccgaggagcccggccccgacagcgagaacagccaggagaacccccccctgagaagcagcagcagcaccaccgccagcagcagccccagcaccgtgatccacggcgccaacagcgagcccgccgacagcaccgagatggacgacaaggccgccgtgggcgtgagcaagcccctgcccagcgtgccccccagcatcggcaagagcaacgtggacagaagacaggccgagatcggcgagggcgcccagaagctgctgagacccaacagcctgagactggccagcgacagcgacgccgagagcgacagcagagccagcagccccaacagcaccgtgagcaacaccagcaccgagggcttcggcggcatcatgagcttcgccagcagcctgtacagaaaccacagcaccagcttcagcctgagcaacctgaccctgcccaccaagggcgccagagagaaggccacccccttccccagcctgaaggtgttcggcctgaacaccctgatggagatcgtgaccgaggccggccccggcagcggcgagggcaacagaagagccctggtggaccagaagagcagcgtgatcaagcacagccccaccgtgaagagagagccccccagcccccagggcagaagcagcaacagcagcgagaaccagcagttcctgaaggaggtggtgcacagcgtgctggacggccagggcgtgggctggctgaacatgaagaaggtgagaagactgctggagagcgagcagctgagagtgttcgtgctgagcaagctgaacagaatggtgcagagcgaggacgacgccagacaggacatcatccccgacgtggagatcagcagaaaggtgtacaagggcatgctggacctgctgaagtgcaccgtgctgagcctggagcagagctacgcccacgccggcctgggcggcatggccagcatcttcggcctgctggagatcgcccagacccactactacagcaaggagcccgacaagagaaagagaagccccaccgagagcgtgaacacccccgtgggcaaggaccccggcctggccggcagaggcgaccccaaggccatggcccagctgagagtgccccagctgggccccagagcccccagcgccaccggcaagggccccaaggagctggacaccagaagcctgaaggaggagaacttcatcgccagcatcggccccgaggtgatcaagcccgtgttcgacctgggcgagaccgaggagaagaagagccagatcagcgccgacagcggcgtgagcctgaccagcagcagccagagaaccgaccaggacagcgtgatcggcgtgagccccgccgtgatgatcagaagcagcagccaggacagcgaggtgagcaccgtggtgagcaacagcagcggcgagaccctgggcgccgacagcgacctgagcagcaacgccggcgacggccccggcggcgagggcagcgtgcacctggccagcagcagaggcaccctgagcgacagcgagatcgagaccaacagcgccaccagcaccatcttcggcaaggcccacagcctgaagcccagcatcaaggagaagctggccggcagccccatcagaaccagcgaggacgtgagccagagagtgtacctgtacgagggcctgctgggcaaggagagaagcaccctgtgggaccagatgcagttctgggaggacgccttcctggacgccgtgatgctggagagagagggcatgggcatggaccagggcccccaggagatgatcgacagatacctgagcctgggcgagcacgacagaaagagactggaggacgacgaggacagactgctggccaccctgctgcacaacctgatcagctacatgctgctgatgaaggtgaacaagaacgacatcagaaagaaggtgagaagactgatgggcaagagccacatcggcctggtgtacagccagcagatcaacgaggtgctggaccagctggccaacctgaacggcagagacctgagcatctggagcagcggcagcagacacatgaagaagcagaccttcgtggtgcacgccggcaccgacaccaacggcgacatcttcttcatggaggtgtgcgacgactgcgtggtgctgagaagcaacatcggcaccgtgtacgagagatggtggtacgagaagctgatcaacatgacctactgccccaagaccaaggtgctgtgcctgtggagaagaaacggcagcgagacccagctgaacaagttctacaccaagaagtgcagagagctgtactactgcgtgaaggacagcatggagagagccgccgccagacagcagagcatcaagcccggccccgagctgggcggcgagttccccgtgcaggacctgaagaccggcgagggcggcctgctgcaggtgaccctggagggcatcaacctgaagttcatgcacaaccaggtgttcatcgagctgaaccacatcaagaagtgcaacaccgtgagaggcgtgttcgtgctggaggagttcgtgcccgagatcaaggaggtggtgagccacaagtacaagacccccatggcccacgagatctgctacagcgtgctgtgcctgttcagctacgtggccgccgtgcacagcagcgaggaggacctgagaaccccccccagacccgtgagcagctag

SEQ ID NO: 88042 - DNA, 588 bp, Artificial Sequence
  Description of Artificial Sequence: Synthetic coding sequence
atgggcagccagagcagcaaggcccccagaggcgacgtgaccgccgaggaggccgccggcgccagccccgccaaggccaacggccaggagaacggccacgtgaagagcaacggcgacctgagccccaagggcgagggcgagagcccccccgtgaacggcaccgacgaggccgccggcgccaccggcgacgccatcgagcccgccccccccagccagggcgccgaggccaagggcgaggtgccccccaaggagacccccaagaagaagaagaagttcagcttcaagaagcccttcaagctgagcggcctgagcttcaagagaaacagaaaggagggcggcggcgacagcagcgccagcagccccaccgaggaggagcaggagcagggcgagatcggcgcctgcagcgacgagggcaccgcccaggagggcaaggccgccgccacccccgagagccaggagccccaggccaagggcgccgaggccagcgccgccagcgaggaggaggccggcccccaggccaccgagcccagcacccccagcggccccgagagcggccccacccccgccagcgccgagcagaacgagtag

SEQ ID NO: 88043 - DNA, 1377 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagcagcagaaaggaggccgacgccgtgttccccagagacccctacggcagcctggacagacacacccagaccgtgagaacctacagcgagaaggtggaggagtacaacctgagatacagctacatgaagagctgggccggcctgctgagaatcctgggcgtggtggagctgctgctgggcgccggcgtgttcgcctgcgtgaccgcctacatccacaaggacagcgagtggtacaacctgttcggctacagccagccctacggcatgggcggcgtgggcggcctgggcagcatgtacggcggctactactacaccggccccaagacccccttcgtgctggtggtggccggcctggcctggatcaccaccatcatcatcctggtgctgggcatgagcatgtactacagaaccatcctgctggacagcaactggtggcccctgaccgagttcggcatcaacgtggccctgttcatcctgtacatggccgccgccatcgtgtacgtgaacgacaccaacagaggcggcctgtgctactaccccctgttcaacacccccgtgaacgccgtgttctgcagagtggagggcggccagatcgccgccatgatcttcctgttcgtgaccatgatcgtgtacctgatcagcgccctggtgtgcctgaagctgtggagacacgaggccgccagaagacacagagagtacatggagcagcaggagatcaacgagcccagcctgagcagcaagagaaagatgtgcgagatggccaccagcggcgacagacagagagacagcgaggtgaacttcaaggagctgagaaccgccaagatgaagcccgagctgctgagcggccacatccccccccccagacccgccaacttcttcgtgttcctggtggagatgggcttccacagagtgagccaggacgacctggacctgctgaccagctag

SEQ ID NO: 88044 - DNA, 1677 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagcagcagaaaggaggccgacgccgtgttccccagagacccctacggcagcctggacagacacacccagaccgtgagaacctacagcgagaaggtggaggagtacaacctgagatacagctacatgaagagctgggccggcctgctgagaatcctgggcgtggtggagctgctgctgggcgccggcgtgttcgcctgcgtgaccgcctacatccacaaggacagcgagtggtacaacctgttcggctacagccagccctacggcatgggcggcgtgggcggcctgggcagcatgtacggcggctactactacaccggccccaagacccccttcgtgctggtggtggccggcctggcctggatcaccaccatcatcatcctggtgctgggcatgagcatgtactacagaaccatcctgctggacagcaactggtggcccctgaccgagttcggcatcaacgtggccctgttcatcctgtacatggccgccgccatcgtgtacgtgaacgacaccaacagaggcggcctgtgctactaccccctgttcaacacccccgtgaacgccgtgttctgcagagtggagggcggccagatcgccgccatgatcttcctgttcgtgaccatgatcgtgtacctgatcagcgccctggtgtgcctgaagctgtggagacacgaggccgccagaagacacagagagtacatggagcagcaggagatcaacgagcccagcctgagcagcaagagaaagatgtgcgagatggccaccagcggcgacagacagagagacagcgaggtgaacttcaaggagctgagaaccgccaagatgaagcccgagctgctgagcggccacatcccccccggccacatccccaagcccatcgtgatgcccgactacgtggccaagtaccccgtgatccagaccgacgacgagagagagagatacaaggccgtgttccaggaccagttcagcgagtacaaggagctgagcgccgaggtgcaggccgtgctgagaaagttcgacgagctggacgccgtgatgagcagactgccccaccacagcgagagcagacaggagcacgagagaatcagcagaatccacgaggagttcaagaagaagaagaacgaccccaccttcctggagaagaaggagagatgcgactacctgaagaacaagctgagccacatcaagcagagaatccaggagtacgacaaggtgatgaactgggacgtgcagggctacagctag

SEQ ID NO: 88045 - DNA, 1329 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagcagcagaaaggaggccgacgccgtgttccccagagacccctacggcagcctggacagacacacccagaccgtgagaacctacagcgagaaggtggaggagtacaacctgagatacagctacatgaagagctgggccggcctgctgagaatcctgggcgtggtggagctgctgctgggcgccggcgtgttcgcctgcgtgaccgcctacatccacaaggacagcgagtggtacaacctgttcggctacagccagccctacggcatgggcggcgtgggcggcctgggcagcatcgccctggtgtgcctgaagctgtggagacacgaggccgccagaagacacagagagtacatggagcagcaggagatcaacgagcccagcctgagcagcaagagaaagatgtgcgagatggccaccagcggcgacagacagagagacagcgaggtgaacttcaaggagctgagaaccgccaagatgaagcccgagctgctgagcggccacatcccccccggccacatccccaagcccatcgtgatgcccgactacgtggccaagtaccccgtgatccagaccgacgacgagagagagagatacaaggccgtgttccaggaccagttcagcgagtacaaggagctgagcgccgaggtgcaggccgtgctgagaaagttcgacgagctggacgccgtgatgagcagactgccccaccacagcgagagcagacaggagcacgagagaatcagcagaatccacgaggagttcaagaagaagaagaacgaccccaccttcctggagaagaaggagagatgcgactacctgaagaacaagctgagccacatcaagcagagaatccaggagtacgacaaggtgatgaactgggacgtgcagggctacagctag

SEQ ID NO: 88046 - DNA, 1641 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagcagcagaaaggaggccgacgccgtgttccccagagacccctacggcagcctggacagacacacccagaccgtgagaacctacagcgagaaggtggaggagtacaacctgagatacagctacatgaagagctgggccggcctgctgagaatcctgggcgtggtggagctgctgctgggcgccggcgtgttcgcctgcgtgaccgcctacatccacaaggacagcgagtggtacaacctgttcggctacagccagccctacggcatgggcggcgtgggcggcctgggcagcatgtacggcggctactactacaccggccccaagacccccttcgtgctggtggtggccggcctggcctggatcaccaccatcatcatcctggtgctgggcatgagcatgtactacagaaccatcctgctggacagcaactggtggcccctgaccgagttcggcatcaacgtggccctgttcatcctgtacatggccgccgccatcgtgtacgtgaacgacaccaacagaggcggcctgtgctactaccccctgttcaacacccccgtgaacgccgtgttctgcagagtggagggcggccagatcgccgccatgatcttcctgttcgtgaccatgatcgtgtacctgatcagcgccctggtgtgcctgaagctgtggagacacgaggccgccagaagacacagagagtacatggagcagcaggagtgcgagatggccaccagcggcgacagacagagagacagcgaggtgaacttcaaggagctgagaaccgccaagatgaagcccgagctgctgagcggccacatcccccccggccacatccccaagcccatcgtgatgcccgactacgtggccaagtaccccgtgatccagaccgacgacgagagagagagatacaaggccgtgttccaggaccagttcagcgagtacaaggagctgagcgccgaggtgcaggccgtgctgagaaagttcgacgagctggacgccgtgatgagcagactgccccaccacagcgagagcagacaggagcacgagagaatcagcagaatccacgaggagttcaagaagaagaagaacgaccccaccttcctggagaagaaggagagatgcgactacctgaagaacaagctgagccacatcaagcagagaatccaggagtacgacaaggtgatgaactgggacgtgcagggctacagctag

SEQ ID NO: 88047 - DNA, 1551 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagcagcagaaaggaggccgacgccgtgttccccagagacccctacggcagcctggacagacacacccagaccgtgagaacctacagcgagaaggtggaggagtacaacctgagatacagctacatgaagagctgggccggcctgctgagaatcctgggcgtggtggagctgctgctgggcgccggcgtgttcgcctgcgtgaccgcctacatccacaaggacagcgagtggtacaacctgttcggctacagccagccctacggcatgggcggcgtgggcggcctgggcagcatgtacggcggctactactacaccggccccaagacccccttcgtgctggtggtggccggcctggcctggatcaccaccatcatcatcctggtgctgggcatgagcatgtactacagaaccatcctgctggacagcaactggtggcccctgaccgagttcggcatcaacgtggccctgttcatcctgtacatggccgccgccatcgtgtacgtgaacgacaccaacagaggcggcctgtgctactaccccctgttcaacacccccgtgaacgccgtgttctgcagagtggagggcggccagatcgccgccatgatcttcctgttcgtgaccatgatcgtgtacctgatcagcgccctggtgtgcctgaagctgtggagacacgaggccgccagaagacacagagagtacatggagcagcaggagatcaacgagcccagcctgagcagcaagagaaagatgtgcgagatggccaccagcggcgacagacagagagacagcgaggtgaacttcaaggagctgagaaccgccaagatgaagcccgagctgctgagcggccacatcccccccggccacatccccaagcccatcgtgatgcccgactacgtggccaagtaccccgtgatccagaccgacgacgagagagagagatacaaggccgtgttccaggaccagttcagcgagtacaaggagctgagcgccgaggtgcaggccgtgctgagaaagttcgacgagctggacgccgtgatgagcagactgccccaccacagcgagagcagacaggagcacgagagaatcagcagaatccacgaggagttcaagaagaagtag

SEQ ID NO: 88048 - DNA, 438 bp, Artificial Sequence
  Description of Artificial Sequence: Synthetic coding sequence
atgagcaacgacggcagaagcagaaacagagacagaagatacgacgaggtgcccagcgacctgccctaccaggacaccaccatcagaacccaccccaccctgcacgacagcgagagagccgtgagcgccgaccccctgccccccccccccctgcccctgcagccccccttcggccccgacttctacagcagcgacaccgaggagcccgccatcgcccccgacctgaagcccgtgagaagattcgtgcccgacagctggaagaacttcttcagaggcaagaagaaggaccccgagtgggacaagcccgtgagcgacatcagatacatcagcgacggcgtggagtgcagcccccccgccagccccgccagacccaaccacagaagccccctgaacagctgcaaggacccctacggcggcagcgagggcaccttcagctag

SEQ ID NO: 88049 - DNA, 1206 bp, Artificial Sequence
  Description of Artificial Sequence: Synthetic coding sequence
atggaggaccccagcggcgccagagagcccagagccagacccagagagagagaccccggcagaagaccccaccccgaccagggcagaacccacgacagacccagagacagacccggcgaccccagaagaaagagaagcagcgacggcaacagaagaagagacggcgacagagaccccgagagagaccaggagagagacggcaacagagacagaaacagagacagagagagagagagagagagagagagagaccccgacagaggccccagaagagacacccacagagacgccggccccagagccggcgagcacggcgtgtgggagaagcccagacagagcagaaccagagacggcgccagaggcctgacctgggacgccgccgccccccccggccccgccccctgggaggcccccgagcccccccagccccagagaaagggcgaccccggcagaagaagacccgagagcgagccccccagcgagagatacctgcccagcacccccagacccggcagagaggaggtggagtactaccagagcgaggccgagggcctgctggagtgccacaagtgcaagtacctgtgcaccggcagagcctgctgccagatgctggaggtgctgctgaacctgctgatcctggcctgcagcagcgtgagctacagcagcaccggcggctacaccggcatcaccagcctgggcggcatctactactaccagttcggcggcgcctacagcggcttcgacggcgccgacggcgagaaggcccagcagctggacgtgcagttctaccagctgaagctgcccatggtgaccgtggccatggcctgcagcggcgccctgaccgccctgtgctgcctgttcgtggccatgggcgtgctgagagtgccctggcactgccccctgctgctggtgaccgagggcctgctggacatgctgatcgccggcggctacatccccgccctgtacttctacttccactacctgagcgccgcctacggcagccccgtgtgcaaggagagacaggccctgtaccagagcaagggctacagcggcttcggctgcagcttccacggcgccgacatcggcgccggcatcttcgccgccctgggcatcgtggtgttcgccctgggcgccgtgctggccatcaagggctacagaaaggtgagaaagctgaaggagaagcccgccgagatgttcgagttctag

SEQ ID NO: 88050 - DNA, 1233 bp, Artificial Sequence
  Description of Artificial Sequence: Synthetic coding sequence
atggaggaccccagcggcgccagagagcccagagccagacccagagagagagaccccggcagaagaccccaccccgaccagggcagaacccacgacagacccagagacagacccggcgaccccagaagaaagagaagcagcgacggcaacagaagaagagacggcgacagagaccccgagagagaccaggagagagacggcaacagagacagaaacagagacagagagagagagagagagagagagagagaccccgacagaggccccagaagagacacccacagagacgccggccccagagccggcgagcacggcgtgtgggagaagcccagacagagcagaaccagagacggcgccagaggcctgacctgggacgccgccgccccccccggccccgccccctgggaggcccccgagcccccccagccccagagaaagggcgaccccggcagaagaagacccgagagcgagccccccagcgagagatacctgcccagcacccccagacccggcagagaggaggtggagtactaccagagcgaggccgagggcctgctggagtgccacaagtgcaagtacctgtgcaccggcagaggcgtggtgcagatcgtggaggtggtgctgaacggcatggtgctgatctgcatcgtggccagctacttcgtgctggccggcttcagcgccagcttcagcagcggcggcggcttcggcaacaactactacagccccttcgagggcaccgagctggagcaggtgagacagctggaccagcagtacaccatcctgagaagccccctgatctacggcggcgtggccgtgagcctgggcctgggcgtgctgaccatgggcgtgctgctgcagggcgccaagagcagaaccatgctgagcggcaagtggctgctgaccgaggccgccttcagcctgctggccgccgtgggctactgcaccggcatcggcgtgtacctgcacgtggccctgcagatcaacagcaccgacacctgcaagaccagagagagactgtacgccagaaagggcctgacctggatggactgccagctggccggcaccgacggcgccgccgccaccttcgcctgcctgctggtgatcatgtacggcgccagcgtggtgctggccctgagaagctacagagagcagaagagatacaagggcagcagagagcagcccggcagctacagcgacgcccccgagtacctgtggagcggcaccctgtag

SEQ ID NO: 88051 - DNA, 978 bp, Artificial Sequence
  Description of Artificial Sequence: Synthetic coding sequence
atggacggcagcaacgtgaccagcttcgtggtggaggagcccaccaacatcagcaccggcagaaacgccagcgtgggcaacgcccacagacagatccccatcgtgcactgggtgatcatgagcatcagccccgtgggcttcgtggagaacggcatcctgctgtggttcctgtgcttcagaatgagaagaaaccccttcaccgtgtacatcacccacctgagcatcgccgacatcagcctgctgttctgcatcttcatcctgagcatcgactacgccctggactacgagctgagcagcggccactactacaccatcgtgaccctgagcgtgaccttcctgttcggctacaacaccggcctgtacctgctgaccgccatcagcgtggagagatgcctgagcgtgctgtaccccatctggtacagatgccacagacccaagtaccagagcgccctggtgtgcgccctgctgtgggccctgagctgcctggtgaccaccatggagtacgtgatgtgcatcgacagagaggaggagagccacagcagaaacgactgcagagccgtgatcatcttcatcgccatcctgagcttcctggtgttcacccccctgatgctggtgagcagcaccatcctggtggtgaagatcagaaagaacacctgggccagccacagcagcaagctgtacatcgtgatcatggtgaccatcatcatcttcctgatcttcgccatgcccatgagactgctgtacctgctgtactacgagtactggagcaccttcggcaacctgcaccacatcagcctgctgttcagcaccatcaacagcagcgccaaccccttcatctacttcttcgtgggcagcagcaagaagaagagattcaaggagagcctgaaggtggtgctgaccagagccttcaaggacgagatgcagcccagaagacagaaggacaactgcaacaccgtgaccgtggagaccgtggtgtag

SEQ ID NO: 88052 - DNA, 1137 bp, Artificial Sequence
  Description of Artificial Sequence: Synthetic coding sequence
atggtgtggggcaagatctgctggttcagccagagagccggctggaccgtgttcgccgagagccagatcagcctgagctgcagcctgtgcctgcacagcggcgaccaggaggcccagaaccccaacctggtgagccagctgtgcggcgtgttcctgcagaacgagaccaacgagaccatccacatgcagatgagcatggccgtgggccagcaggccctgcccctgaacatcatcgcccccaaggccgtgctggtgagcctgtgcggcgtgctgctgaacggcaccgtgttctggctgctgtgctgcggcgccaccaacccctacatggtgtacatcctgcacctggtggccgccgacgtgatctacctgtgctgcagcgccgtgggcttcctgcaggtgaccctgctgacctaccacggcgtggtgttcttcatccccgacttcctggccatcctgagccccttcagcttcgaggtgtgcctgtgcctgctggtggccatcagcaccgagagatgcgtgtgcgtgctgttccccatctggtacagatgccacagacccaagtacaccagcaacgtggtgtgcaccctgatctggggcctgcccttctgcatcaacatcgtgaagagcctgttcctgacctactggaagcacgtgaaggcctgcgtgatcttcctgaagctgagcggcctgttccacgccatcctgagcctggtgatgtgcgtgagcagcctgaccctgctgatcagattcctgtgctgcagccagcagcagaaggccaccagagtgtacgccgtggtgcagatcagcgcccccatgttcctgctgtgggccctgcccctgagcgtggcccccctgatcaccgacttcaagatgttcgtgaccaccagctacctgatcagcctgttcctgatcatcaacagcagcgccaaccccatcatctacttcttcgtgggcagcctgagaaagaagagactgaaggagagcctgagagtgatcctgcagagagccctggccgacaagcccgaggtgggcagaaacaagaaggccgccggcatcgaccccatggagcagccccacagcacccagcacgtggagaacctgctgcccagagagcacagagtggacgtggagacctag

SEQ ID NO: 88053 - DNA, 1137 bp, Artificial Sequence; identical to SEQ ID NO: 88052
  Description of Artificial Sequence: Synthetic coding sequence

SEQ ID NO: 88054 - DNA, 1137 bp, Artificial Sequence; identical to SEQ ID NO: 88052
  Description of Artificial Sequence: Synthetic coding sequence

SEQ ID NO: 88055 - DNA, 1137 bp, Artificial Sequence; identical to SEQ ID NO: 88052
  Description of Artificial Sequence: Synthetic coding sequence

SEQ ID NO: 88056 - DNA, 1137 bp, Artificial Sequence; identical to SEQ ID NO: 88052
  Description of Artificial Sequence: Synthetic coding sequence

SEQ ID NO: 88057 - DNA, 1137 bp, Artificial Sequence; identical to SEQ ID NO: 88052
  Description of Artificial Sequence: Synthetic coding sequence

SEQ ID NO: 88058 - DNA, 1137 bp, Artificial Sequence; identical to SEQ ID NO: 88052
  Description of Artificial Sequence: Synthetic coding sequence

SEQ ID NO: 88059 - DNA, 1137 bp, Artificial Sequence; identical to SEQ ID NO: 88052
  Description of Artificial Sequence: Synthetic coding sequence

SEQ ID NO: 88060 - DNA, 966 bp, Artificial Sequence
  Description of Artificial Sequence: Synthetic coding sequence
atgaaccagaccctgaacagcagcggcaccgtggagagcgccctgaactacagcagaggcagcaccgtgcacaccgcctacctggtgctgagcagcctggccatgttcacctgcctgtgcggcatggccggcaacagcatggtgatctggctgctgggcttcagaatgcacagaaaccccttctgcatctacatcctgaacctggccgccgccgacctgctgttcctgttcagcatggccagcaccctgagcctggagacccagcccctggtgaacaccaccgacaaggtgcacgagctgatgaagagactgatgtacttcgcctacaccgtgggcctgagcctgctgaccgccatcagcacccagagatgcctgagcgtgctgttccccatctggttcaagtgccacagacccagacacctgagcgcctgggtgtgcggcctgctgtggaccctgtgcctgctgatgaacggcctgaccagcagcttctgcagcaagttcctgaagttcaacgaggacagatgcttcagagtggacatggtgcaggccgccctgatcatgggcgtgctgacccccgtgatgaccctgagcagcctgaccctgttcgtgtgggtgagaagaagcagccagcagtggagaagacagcccaccagactgttcgtggtggtgctggccagcgtgctggtgttcctgatctgcagcctgcccctgagcatctactggttcgtgctgtactggctgagcctgccccccgagatgcaggtgctgtgcttcagcctgagcagactgagcagcagcgtgagcagcagcgccaaccccgtgatctacttcctggtgggcagcagaagaagccacagactgcccaccagaagcctgggcaccgtgctgcagcaggccctgagagaggagcccgagctggagggcggcgagacccccaccgtgggcaccaacgagatgggcgcctag

SEQ ID NO: 88061 - DNA, 936 bp, Artificial Sequence
  Description of Artificial Sequence: Synthetic coding sequence
atggagcccagagaggccggccagcacgtgggcgccgccaacggcgcccaggaggacgtggccttcaacctgatcatcctgagcctgaccgagggcctgggcctgggcggcctgctgggcaacggcgccgtgctgtggctgctgagcagcaacgtgtacagaaaccccttcgccatctacctgctggacgtggcctgcgccgacctgatcttcctgggctgccacatggtggccatcgtgcccgacctgctgcagggcagactggacttccccggcttcgtgcagaccagcctggccaccctgagattcttctgctacatcgtgggcctgagcctgctggccgccgtgagcgtggagcagtgcctggccgccctgttccccgcctggtacagctgcagaagacccagacacctgaccacctgcgtgtgcgccctgacctgggccctgtgcctgctgctgcacctgctgctgagcggcgcctgcacccagttcttcggcgagcccagcagacacctgtgcagaaccctgtggctggtggccgccgtgctgctggccctgctgtgctgcaccatgtgcggcgccagcctgatgctgctgctgagagtggagagaggcccccagagacccccccccagaggcttccccggcctgatcctgctgaccgtgctgctgttcctgttctgcggcctgcccttcggcatctactggctgagcagaaacctgctgtggtacatcccccactacttctaccacttcagcttcctgatggccgccgtgcactgcgccgccaagcccgtggtgtacttctgcctgggcagcgcccagggcagaagactgcccctgagactggtgctgcagagagccctgggcgacgaggccgagctgggcgccgtgagagagaccagcagaagaggcctggtggacatcgccgcctag

SEQ ID NO: 88062 - DNA, 939 bp, Artificial Sequence
  Description of Artificial Sequence: Synthetic coding sequence
atgatggagcccagagaggccggccagcacgtgggcgccgccaacggcgcccaggaggacgtggccttcaacctgatcatcctgagcctgaccgagggcctgggcctgggcggcctgctgggcaacggcgccgtgctgtggctgctgagcagcaacgtgtacagaaaccccttcgccatctacctgctggacgtggcctgcgccgacctgatcttcctgggctgccacatggtggccatcgtgcccgacctgctgcagggcagactggacttccccggcttcgtgcagaccagcctggccaccctgagattcttctgctacatcgtgggcctgagcctgctggccgccgtgagcgtggagcagtgcctggccgccctgttccccgcctggtacagctgcagaagacccagacacctgaccacctgcgtgtgcgccctgacctgggccctgtgcctgctgctgcacctgctgctgagcggcgcctgcacccagttcttcggcgagcccagcagacacctgtgcagaaccctgtggctggtggccgccgtgctgctggccctgctgtgctgcaccatgtgcggcgccagcctgatgctgctgctgagagtggagagaggcccccagagacccccccccagaggcttccccggcctgatcctgctgaccgtgctgctgttcctgttctgcggcctgcccttcggcatctactggctgagcagaaacctgctgtggtacatcccccactacttctaccacttcagcttcctgatggccgccgtgcactgcgccgccaagcccgtggtgtacttctgcctgggcagcgcccagggcagaagactgcccctgagactggtgctgcagagagccctgggcgacgaggccgagctgggcgccgtgagagagaccagcagaagaggcctggtggacatcgccgcctag

SEQ ID NO: 88063 - DNA, 1032 bp, Artificial Sequence
  Description of Artificial Sequence: Synthetic coding sequence
atggccggcaactgcagctgggaggcccaccccggcaacagaaacaagatgtgccccggcctgagcgaggcccccgagctgtacagcagaggcttcctgaccatcgagcagatcgccatgctgcccccccccgccgtgatgaactacatcttcctgctgctgtgcctgtgcggcctggtgggcaacggcctggtgctgtggttcttcggcttcagcatcaagagaaaccccttcagcatctacttcctgcacctggccagcgccgacgtgggctacctgttcagcaaggccgtgttcagcatcctgaacaccggcggcttcctgggcaccttcgccgactacatcagaagcgtgtgcagagtgctgggcctgtgcatgttcctgaccggcgtgagcctgctgcccgccgtgagcgccgagagatgcgccagcgtgatcttccccgcctggtactggagaagaagacccaagagactgagcgccgtggtgtgcgccctgctgtgggtgctgagcctgctggtgacctgcctgcacaactacttctgcgtgttcctgggcagaggcgcccccggcgccgcctgcagacacatggacatcttcctgggcatcctgctgttcctgctgtgctgccccctgatggtgctgccctgcctggccctgatcctgcacgtggagtgcagagccagaagaagacagagaagcgccaagctgaaccacgtgatcctggccatggtgagcgtgttcctggtgagcagcatctacctgggcatcgactggttcctgttctgggtgttccagatccccgcccccttccccgagtacgtgaccgacctgtgcatctgcatcaacagcagcgccaagcccatcgtgtacttcctggccggcagagacaagagccagagactgtgggagcccctgagagtggtgttccagagagccctgagagacggcgccgagctgggcgaggccggcggcagcacccccaacaccgtgaccatggagatgcagtgcccccccggcaacgccagctag

SEQ ID NO: 88064 - DNA, 948 bp, Artificial Sequence
  Description of Artificial Sequence: Synthetic coding sequence
atggccggcaactgcagctgggaggcccaccccggcaacagaaacaagatgtgccccggcctgagcgaggcccccgagctgtacagcagaggcttcctgaccatcgagcagatcgccatgctgcccccccccgccgtgatgaactacatcttcctgctgctgtgcctgtgcggcctggtgggcaacggcctggtgctgtggttcttcggcttcagcatcctgaacaccggcggcttcctgggcaccttcgccgactacatcagaagcgtgtgcagagtgctgggcctgtgcatgttcctgaccggcgtgagcctgctgcccgccgtgagcgccgagagatgcgccagcgtgatcttccccgcctggtactggagaagaagacccaagagactgagcgccgtggtgtgcgccctgctgtgggtgctgagcctgctggtgacctgcctgcacaactacttctgcgtgttcctgggcagaggcgcccccggcgccgcctgcagacacatggacatcttcctgggcatcctgctgttcctgctgtgctgccccctgatggtgctgccctgcctggccctgatcctgcacgtggagtgcagagccagaagaagacagagaagcgccaagctgaaccacgtgatcctggccatggtgagcgtgttcctggtgagcagcatctacctgggcatcgactggttcctgttctgggtgttccagatccccgcccccttccccgagtacgtgaccgacctgtgcatctgcatcaacagcagcgccaagcccatcgtgtacttcctggccggcagagacaagagccagagactgtgggagcccctgagagtggtgttccagagagccctgagagacggcgccgagctgggcgaggccggcggcagcacccccaacaccgtgaccatggagatgcagtgcccccccggcaacgccagctag

SEQ ID NO: 88065 - DNA, 1032 bp, Artificial Sequence; identical to SEQ ID NO: 88063
  Description of Artificial Sequence: Synthetic coding sequence

SEQ ID NO: 88066 - DNA, 870 bp, Artificial Sequence
  Description of Artificial Sequence: Synthetic coding sequence
atgttcggcctgttcggcctgtggagaaccttcgacagcgtggtgttctacctgaccctgatcgtgggcctgggcggccccgtgggcaacggcctggtgctgtggaacctgggcttcagaatcaagaagggccccttcagcatctacctgctgcacctggccgccgccgacttcctgttcctgagctgcagagtgggcttcagcgtggcccaggccgccctgggcgcccaggacaccctgtacttcgtgctgaccttcctgtggttcgccgtgggcctgtggctgctggccgccttcagcgtggagagatgcctgagcgacctgttccccgcctgctaccagggctgcagacccagacacgccagcgccgtgctgtgcgccctggtgtggacccccaccctgcccgccgtgcccctgcccgccaacgcctgcggcctgctgagaaacagcgcctgccccctggtgtgccccagataccacgtggccagcgtgacctggttcctggtgctggccagagtggcctggaccgccggcgtggtgctgttcgtgtgggtgacctgctgcagcaccagacccagacccagactgtacggcatcgtgctgggcgccctgctgctgctgttcttctgcggcctgcccagcgtgttctactggagcctgcagcccctgctgaacttcctgctgcccgtgttcagccccctggccaccctgctggcctgcgtgaacagcagcagcaagcccctgatctacagcggcctgggcagacagcccggcaagagagagcccctgagaagcgtgctgagaagagccctgggcgagggcgccgagctgggcgccagaggccagagcctgcccatgggcctgctgtag

SEQ ID NO: 88067 - DNA, 969 bp, Artificial Sequence
  Description of Artificial Sequence: Synthetic coding sequence
atggaccccaccatcagcaccctggacaccgagctgacccccatcaacggcaccgaggagaccctgtgctacaagcagaccctgagcctgaccgtgctgacctgcatcgtgagcctggtgggcctgaccggcaacgccgtggtgctgtggctgctgggctgcagaatgagaagaaacgccttcagcatctacatcctgaacctggccgccgccgacttcctgttcctgagcggcagactgatctacagcctgctgagcttcatcagcatcccccacaccatcagcaagatcctgtaccccgtgatgatgttcagctacttcgccggcctgagcttcctgagcgccgtgagcaccgagagatgcctgagcgtgctgtggcccatctggtacagatgccacagacccacccacctgagcgccgtggtgtgcgtgctgctgtgggccctgagcctgctgagaagcatcctggagtggatgctgtgcggcttcctgttcagcggcgccgacagcgcctggtgccagaccagcgacttcatcaccgtggcctggctgatcttcctgtgcgtggtgctgtgcggcagcagcctggtgctgctgatcagaatcctgtgcggcagcagaaagatccccctgaccagactgtacgtgaccatcctgctgaccgtgctggtgttcctgctgtgcggcctgcccttcggcatccagttcttcctgttcctgtggatccacgtggacagagaggtgctgttctgccacgtgcacctggtgagcatcttcctgagcgccctgaacagcagcgccaaccccatcatctacttcttcgtgggcagcttcagacagagacagaacagacagaacctgaagctggtgctgcagagagccctgcaggacgccagcgaggtggacgagggcggcggccagctgcccgaggagatcctggagctgagcggcagcagactggagcagtag

SEQ ID NO: 88068 - DNA, 993 bp, Artificial Sequence
  Description of Artificial Sequence: Synthetic coding sequence
atggaccccaccacccccgcctggggcaccgagagcaccaccgtgaacggcaacgaccaggccctgctgctgctgtgcggcaaggagaccctgatccccgtgttcctgatcctgttcatcgccctggtgggcctggtgggcaacggcttcgtgctgtggctgctgggcttcagaatgagaagaaacgccttcagcgtgtacgtgctgagcctggccggcgccgacttcctgttcctgtgcttccagatcatcaactgcctggtgtacctgagcaacttcttctgcagcatcagcatcaacttccccagcttcttcaccaccgtgatgacctgcgcctacctggccggcctgagcatgctgagcaccgtgagcaccgagagatgcctgagcgtgctgtggcccatctggtacagatgcagaagacccagacacctgagcgccgtggtgtgcgtgctgctgtgggccctgagcctgctgctgagcatcctggagggcaagttctgcggcttcctgttcagcgacggcgacagcggctggtgccagaccttcgacttcatcaccgccgcctggctgatcttcctgttcatggtgctgtgcggcagcagcctggccctgctggtgagaatcctgtgcggcagcagaggcctgcccctgaccagactgtacctgaccatcctgctgaccgtgctggtgttcctgctgtgcggcctgcccttcggcatccagtggttcctgatcctgtggatctggaaggacagcgacgtgctgttctgccacatccaccccgtgagcgtggtgctgagcagcctgaacagcagcgccaaccccatcatctacttcttcgtgggcagcttcagaaagcagtggagactgcagcagcccatcctgaagctggccctgcagagagccctgcaggacatcgccgaggtggaccacagcgagggctgcttcagacagggcacccccgagatgagcagaagcagcctggtgtag

SEQ ID NO: 88069 - DNA, 969 bp, Artificial Sequence
  Description of Artificial Sequence: Synthetic coding sequence
atggacagcaccatccccgtgctgggcaccgagctgacccccatcaacggcagagaggagaccccctgctacaagcagaccctgagcttcaccggcctgacctgcatcgtgagcctggtggccctgaccggcaacgccgtggtgctgtggctgctgggctgcagaatgagaagaaacgccgtgagcatctacatcctgaacctggtggccgccgacttcctgttcctgagcggccacatcatctgcagccccctgagactgatcaacatcagacaccccatcagcaagatcctgagccccgtgatgaccttcccctacttcatcggcctgagcatgctgagcgccatcagcaccgagagatgcctgagcatcctgtggcccatctggtaccactgcagaagacccagatacctgagcagcgtgatgtgcgtgctgctgtgggccctgagcctgctgagaagcatcctggagtggatgttctgcgacttcctgttcagcggcgccaacagcgtgtggtgcgagaccagcgacttcatcaccatcgcctggctggtgttcctgtgcgtggtgctgtgcggcagcagcctggtgctgctggtgagaatcctgtgcggcagcagaaagatgcccctgaccagactgtacgtgaccatcctgctgaccgtgctggtgttcctgctgtgcggcctgcccttcggcatccagtgggccctgttcagcagaatccacctggactggaaggtgctgttctgccacgtgcacctggtgagcatcttcctgagcgccctgaacagcagcgccaaccccatcatctacttcttcgtgggcagcttcagacagagacagaacagacagaacctgaagctggtgctgcagagagccctgcaggacacccccgaggtggacgagggcggcggctggctgccccaggagaccctggagctgagcggcagcagactggagcagtag

SEQ ID NO: 88070 - DNA, 741 bp, Artificial Sequence
  Description of Artificial Sequence: Synthetic coding sequence
atggacagcaccatccccgtgctgggcaccgagctgacccccatcaacggcagagaggagaccccctgctacaagcagaccctgagcttcaccggcctgacctgcatcgtgagcctggtggccctgaccggcaacgccgtggtgctgtggctgctgggctgcagaatgagaagaaacgccgtgagcatctacatcctgaacctggtggccgccgacttcctgttcctgagcggccacatcatctgcagccccctgagactgatcaacatcagacaccccatcagcaagatcctgagccccgtgatgaccttcccctacttcatcggcctgagcatgctgagcgccatcagcaccgagagatgcctgagcatcctgtggcccatctggtaccactgcagaagacccagatacctgagcagcgtgatgtgcgtgctgctgtgggccctgagcctgctgagaagcatcctggagtggatgttctgcgacttcctgttcagcggcgccaacagcgtgtggtgcgagaccagcgacttcatcaccatcgcctggctggtgttcctgtgcgtggtgctgtgcggcagcagcctggtgctgctggtgagaatcctgtgcggcagcagaaagatgcccctgaccagactgtacgtgaccatcctgctgaccgtgctggtgttcctgctgtgcggcctgcccttcggcatccagtgggccctgttcagcagaatccacctggactggtag

SEQ ID NO: 88071 - DNA, 969 bp, Artificial Sequence
  Description of Artificial Sequence: Synthetic coding sequence
atggaccccaccgtgcccgtgttcggcaccaagctgacccccatcaacggcagagaggagaccccctgctacaaccagaccctgagcttcaccgtgctgacctgcatcatcagcctggtgggcctgaccggcaacgccgtggtgctgtggctgctgggctacagaatgagaagaaacgccgtgagcatctacatcctgaacctggccgccgccgacttcctgttcctgagcttccagatcatcagactgcccctgagactgatcaacatcagccacctgatcagaaagatcctggtgagcgtgatgaccttcccctacttcaccggcctgagcatgctgagcgccatcagcaccgagagatgcctgagcgtgctgtggcccatctggtacagatgcagaagacccacccacctgagcgccgtggtgtgcgtgctgctgtggggcctgagcctgctgttcagcatgctggagtggagattctgcgacttcctgttcagcggcgccgacagcagctggtgcgagaccagcgacttcatccccgtggcctggctgatcttcctgtgcgtggtgctgtgcgtgagcagcctggtgctgctggtgagaatcctgtgcggcagcagaaagatgcccctgaccagactgtacgtgaccatcctgctgaccgtgctggtgttcctgctgtgcggcctgcccttcggcatcctgggcgccctgatctacagaatgcacctgaacctggaggtgctgtactgccacgtgtacctggtgtgcatgagcctgagcagcctgaacagcagcgccaaccccatcatctacttcttcgtgggcagcttcagacagagacagaacagacagaacctgaagctggtgctgcagagagccctgcaggacaagcccgaggtggacaagggcgagggccagctgcccgaggagagcctggagctgagcggcagcagactgggcccctag

SEQ ID NO: 88072 - DNA, 3051 bp, Artificial Sequence
  Description of Artificial Sequence: Synthetic coding sequence
atggtgctgcccacctgccccatggccgagttcgccctgcccagacacagcgccgtgatggagagactgagaagaagaatcgagctgtgcagaagacaccacagcacctgcgaggccagatacgaggccgtgagccccgagagactggagctggagagacagcacaccttcgccctgcaccagagatgcatccaggccaaggccaagagagccggcaagcacagacagccccccgccgccaccgcccccgcccccgccgcccccgcccccagactggacgccgccgacggccccgagcacggcagacccgccacccacctgcacgacaccgtgaagagaaacctggacagcgccaccagcccccagaacggcgaccagcagaacggctacggcgacctgttccccggccacaagaagaccagaagagaggcccccctgggcgtggccatcagcagcaacggcctgccccccgccagccccctgggccagagcgacaagcccagcggcgccgacgccctgcagagcagcggcaagcacagcctgggcctggacagcctgaacaagaagagactggccgacagcagcctgcacctgaacggcggcagcaaccccagcgagagcttccccctgagcctgaacaaggagctgaagcaggagcccgtggaggacctgccctgcatgatcaccggcaccgtgggcagcatcagccagagcaacctgatgcccgacctgaacctgaacgagcaggagtggaaggagctgatcgaggagctgaacagaagcgtgcccgacgaggacatgaaggacctgttcaacgaggacttcgaggagaagaaggaccccgagagcagcggcagcgccacccagacccccctggcccaggacatcaacatcaagaccgagttcagccccgccgccttcgagcaggagcagctgggcagcccccaggtgagagccggcagcgccggccagaccttcctgggccccagcagcgcccccgtgagcaccgacagccccagcctgggcggcagccagaccctgttccacaccagcggccagcccagagccgacaaccccagccccaacctgatgcccgccagcgcccaggcccagaacgcccagagagccctggccggcgtggtgctgcccagccagggccccggcggcgccagcgagctgagcagcgcccaccagctgcagcagatcgccgccaagcagaagagagagcagatgctgcagaacccccagcaggccacccccgcccccgcccccggccagatgagcacctggcagcagaccggccccagccacagcagcctggacgtgccctaccccatggagaagcccgccagccccagcagctacaagcaggacttcaccaacagcaagctgctgatgatgcccagcgtgaacaagagcagccccagacccggcggcccctacctgcagcccagccacgtgaacctgctgagccaccagccccccagcaacctgaaccagaacagcgccaacaaccagggcagcgtgctggactacggcaacaccaagcccctgagccactacaaggccgactgcggccagggcagccccggcagcggccagagcaagcccgccctgatggcctacctgccccagcagctgagccacatcagccacgagcagaacagcctgttcctgatgaagcccaagcccggcaacatgcccttcagaagcctggtgccccccggccaggagcagaaccccagcagcgtgcccgtgcaggcccaggccaccagcgtgggcacccagccccccgccgtgagcgtggccagcagccacaacagcagcccctacctgagcagccagcagcaggccgccgtgatgaagcagcaccagctgctgctggaccagcagaagcagagagagcagcagcagaagcacctgcagcagcagcagttcctgcagagacagcagcacctgctggccgagcaggagaagcagcagttccagagacacctgaccagaccccccccccagtaccaggaccccacccagggcagcttcccccagcaggtgggccagttcaccggcagcagcgccgccgtgcccggcatgaacaccctgggccccagcaacagcagctgccccagagtgttcccccaggccggcaacctgatgcccatgggccccggccacgccagcgtgagcagcctgcccaccaacagcggccagcaggacagaggcgtggcccagttccccggcagccagaacatgccccagagcagcctgtacggcatggccagcggcatcacccagatcgtggcccagccccccccccaggccaccaacggccacgcccacatccccagacagaccaacgtgggccagaacaccagcgtgagcgccgcctacggccagaacagcctgggcagcagcggcctgagccagcagcacaacaagggcaccctgaaccccggcctgaccaagccccccgtgcccagagtgagccccgccatgggcggccagaacagcagctggcagcaccagggcatgcccaacctgagcggccagacccccggcaacagcaacgtgagccccttcaccgccgccagcagcttccacatgcagcagcaggcccacctgaagatgagcagcccccagttcagccaggccgtgcccaacagacccatggcccccatgagcagcgccgccgccgtgggcagcctgctgccccccgtgagcgcccagcagagaaccagcgcccccgcccccgcccccccccccaccgccccccagcagggcctgcccggcctgagccccgccggccccgagctgggcgccttcagccagagccccgccagccagatgggcggcagagccggcctgcactgcacccaggcctaccccgtgagaaccgccggccaggagctgcccttcgcctacagcggccagcccggcggcagcggcctgagcagcgtggccggccacaccgacctgatcgacagcctgctgaagaacagaaccagcgaggagtggatgagcgacctggacgacctgctgggcagccagtag

SEQ ID NO: 88073 - DNA, 2286 bp, Artificial Sequence
  Description of Artificial Sequence: Synthetic coding sequence
agaggcaagcagtggggcagaggcggcggcgagagacccagactggaggtgggcagcaagagaagactgggcgtgggccccagcggcgccggcggcaagcccgccgccgccagagagcccgcccccctgcccagcggcgcctggagaggcagagaggccgagagaggcagcagaggcgagagaagcccccagtgccagcccgcccccagaggccccgcccccggccccgccagagccgccagaggcccctggtgctgcccccccgccccctggagaagcagcagatgcagaggcaccgccagaagctggagcgccttcgccggcgccagcagctgcgccggcgccaccaccgcccccgccagacccgccgcccccgcccccagactggacgccgccgacggccccgagcacggcagacccgccacccacctgcacgacaccgtgaagagaaacctggacagcgccaccagcccccagaacggcgaccagcagaacggctacggcgacctgttccccggccacaagaagaccagaagagaggcccccctgggcgtggccatcagcagcaacggcctgccccccgccagccccctgggccagagcgacaagcccagcggcgccgacgccctgcagagcagcggcaagcacagcctgggcctggacagcctgaacaagaagagactggccgacagcagcctgcacctgaacggcggcagcaaccccagcgagagcttccccctgagcctgaacaaggagctgaagcaggagcccgtggaggacctgccctgcatgatcaccggcaccgtgggcagcatcagccagagcaacctgatgcccgacctgaacctgaacgagcaggagtggaaggagctgatcgaggagctgaacagaagcgtgcccgacgaggacatgaaggacctgttcaacgaggacttcgaggagaagaaggaccccgagagcagcggcagcgccacccagacccccctggcccaggacatcaacatcaagaccgagttcagccccgccgccttcgagcaggagcagctgggcagcccccaggtgagagccggcagcgccggccagaccttcctgggccccagcagcgcccccgtgagcaccgacagccccagcctgggcggcagccagaccctgttccacaccagcggccagcccagagccgacaaccccagccccaacctgatgcccgccagcgcccaggcccagaacgcccagagagccctggccggcgtggtgctgcccagccagggccccggcggcgccagcgagctgagcagcgcccaccagctgcagcagatcgccgccaagcagaagagagagcagatgctgcagaacccccagcaggccacccccgcccccgcccccggccagatgagcacctggcagcagaccggccccagccacagcagcctggacgtgccctaccccatggagaagcccgccagccccagcagctacaagcaggacttcaccaacagcaagctgctgatgatgcccagcgtgaacaagagcagccccagacccggcggcccctacctgcagcccagccacgtgaacctgctgagccaccagccccccagcaacctgaaccagaacagcgccaacaaccagggcagcgtgctggactacggcaacaccaagcccctgagccactacaaggccgactgcggccagggcagccccggcagcggccagagcaagcccgccctgatggcctacctgccccagcagctgagccacatcagccacgagcagaacagcctgttcctgatgaagcccaagcccggcaacatgcccttcagaagcctggtgccccccggccaggagcagaaccccagcagcgtgcccgtgcaggcccaggccaccagcgtgggcacccagccccccgccgtgagcgtggccagcagccacaacagcagcccctacctgagcagccagcagcaggccgccgtgatgaagcagcaccagctgctgctggaccagcagaagcagagagagcagcagcagaagcacctgcagcagcagcagttcctgcagagacagcagcacctgctggccgagcaggagaagcagcagttccagagacacctgaccagaccccccccccagtaccaggaccccacccagggcagcttcccccagcaggtgggccagttcaccgcccagggcctgagctgcgccctgcccatgatccacagcaccgaggtgctgatcagcagcctgtgcaacggcagcgccggcctgagcgccgcccagagaagctggtag

SEQ ID NO: 88074 - DNA, 3471 bp, Artificial Sequence
  Description of Artificial Sequence: Synthetic coding sequence
atgggcgacaccgcccccccccaggcccccgccggcggcctgggcggcgccagcggcgccggcctgctgggcggcggcagcgtgacccccagagtgcacagcgccatcgtggagagactgagagccagaatcgccgtgtgcagacagcaccacctgagctgcgagggcagatacgagagaggcagagccgagagcagcgacagagagagagagagcaccctgcagctgctgagcctggtgcagcacggccagggcgccagaaaggccggcaagcacaccaaggccaccgccaccgccgccaccaccaccgcccccccccccccccccgccgccccccccgccgccagccaggccgccgccaccgccgcccccccccccccccccgactaccaccaccaccaccagcagcacctgctgaacagcagcaacaacggcggcagcggcggcatcaacggcgagcagcagccccccgccagcacccccggcgaccagagaaacagcgccctgatcgccctgcagggcagcctgaagagaaagcaggtggtgaacctgagccccgccaacagcaagagacccaacggcttcgtggacaacagcttcctggacatcaagagaatcagagtgggcgagaacctgagcgccggccagggcggcctgcagatcaacaacggccagagccagatcatgagcggcaccctgcccatgagccaggcccccctgagaaagaccaacaccctgcccagccacacccacagccccggcaacggcctgttcaacatgggcctgaaggaggtgaagaaggagcccggcgagaccctgagctgcagcaagcacatggacggccagatgacccaggagaacatcttccccaacagatacggcgacgaccccggcgagcagctgatggaccccgagctgcaggagctgttcaacgagctgaccaacatcagcgtgccccccatgagcgacctggagctggagaacatgatcaacgccaccatcaagcaggacgaccccttcaacatcgacctgggccagcagagccagagaagcacccccagacccagcctgcccatggagaagatcgtgatcaagagcgagtacagccccggcctgacccagggccccagcggcagcccccagctgagaccccccagcgccggccccgccttcagcatggccaacagcgccctgagcaccagcagccccatccccagcgtgccccagagccaggcccagccccagaccggcagcggcgccagcagagccctgcccagctggcaggaggtgagccacgcccagcagctgaagcagatcgccgccaacagacagcagcacgccagaatgcagcagcaccagcagcagcaccagcccaccaactggagcgccctgcccagcagcgccggccccagccccggccccttcggccaggagaagatccccagccccagcttcggccagcagaccttcagcccccagagcagccccatgcccggcgtggccggcggcagcggccagagcaaggtgatggccaactacatgtacaaggccggccccagcgcccagggcggccacctggacgtgctgatgcagcagaagccccaggacctgagcagaagcttcatcaacaacccccaccccgccatggagcccagacagggcaacaccaagcccctgttccacttcaacagcgaccaggccaaccagcagatgcccagcgtgctgcccagccagaacaagcccagcctgctgcactacacccagcagcagcagcagcagcagcagcagcagcagcagcagcagcagcagcagcagcagcagcagcagcagcagcagcagcagcagcagcagcagcagcagcagagcagcatcagcgcccagcagcagcagcagcagcagagcagcatcagcgcccagcagcagcagcagcagcagcagcagcagcagcagcagcagcagcagcagcagcagcagcagcagcagcagcagcagcagcccagcagccagcccgcccagagcctgcccagccagcccctgctgagaagccccctgcccctgcagcagaagctgctgctgcagcagatgcagaaccagcccatcgccggcatgggctaccaggtgagccagcagcagagacaggaccagcacagcgtggtgggccagaacaccggccccagccccagccccaacccctgcagcaaccccaacaccggcagcggctacatgaacagccagcagagcctgctgaaccagcagctgatgggcaagaagcagaccctgcagagacagatcatggagcagaagcagcagctgctgctgcagcagcagatgctggccgacgccgagaagatcgccccccaggaccagatcaacagacacctgagcagacccccccccgactacaaggaccagagaagaaacgtgggcaacatgcagcccaccgcccagtacagcggcggcagcagcaccatcagcctgaacagcaaccaggccctggccaaccccgtgagcacccacaccatcctgacccccaacagcagcctgctgagcaccagccacggcaccagaatgcccagcctgagcaccgccgtgcagaacatgggcatgtacggcaacctgccctgcaaccagcccaacacctacagcgtgaccagcggcatgaaccagctgacccagcagagaaaccccaagcagctgctggccaaccagaacaaccccatgatgcccagaccccccaccctgggccccagcaacaacaacaacgtggccaccttcggcgccggcagcgtgggcaacagccagcagctgagacccaacctgacccacagcatggccagcatgcccccccagagaaccagcaacgtgatgatcaccagcaacaccaccgcccccaactgggccagccaggagggcaccagcaagcagcaggaggccctgaccagcgccggcgtgagattccccaccggcacccccgccgcctacacccccaaccagagcctgcagcaggccgtgggcagccagcagttcagccagagagccgtggccccccccaaccagctgacccccgccgtgcagatgagacccatgaaccagatgagccagaccctgaacggccagaccatgggccccctgagaggcctgaacctgagacccaaccagctgagcacccagatcctgcccaacctgaaccagagcggcaccggcctgaaccagagcagaaccggcatcaaccagccccccagcctgacccccagcaacttccccagccccaaccagagcagcagagccttccagggcaccgaccacagcagcgacctggccttcgacttcctgagccagcagaacgacaacatgggccccgccctgaacagcgacgccgacttcatcgacagcctgctgaagaccgagcccggcaacgacgactggatgaaggacatcaacctggacgagatcctgggcaacaacagctag

SEQ ID NO: 88075 - DNA, 3471 bp, Artificial Sequence; identical to SEQ ID NO: 88074
  Description of Artificial Sequence: Synthetic coding sequence

SEQ ID NO: 88076 - DNA, 1632 bp, Artificial Sequence
  Description of Artificial Sequence: Synthetic coding sequence
ctgcaggagaccgtgaagagaaagctggagggcgccagaagccccctgaacggcgaccagcagaacggcgcctgcgacggcaacttcagccccaccagcaagagaatcagaaaggacatcagcgccggcatggaggccatcaacaacctgcccagcaacatgcccctgcccagcgccagccccctgcaccagctggacctgaagcccagcctgcccctgcagaacagcggcacccacacccccggcctgctggaggacctgagcaagaacggcagactgcccgagatcaagctgcccgtgaacggctgcagcgacctggaggacagcttcaccatcctgcagagcaaggacctgaagcaggagcccctggacgaccccacctgcatcgacaccagcgagaccagcctgagcaaccagaacaagctgttcagcgacatcaacctgaacgaccaggagtggcaggagctgatcgacgagctggccaacaccgtgcccgaggacgacatccaggacctgttcaacgaggacttcgaggagaagaaggagcccgagttcagccagcccgccaccgagacccccctgagccaggagagcgccagcgtgaagagcgaccccagccacagccccttcgcccacgtgagcatgggcagcccccaggccagacccagcagcagcggcccccccttcagcaccgtgagcaccgccaccagcctgcccagcgtggccagcacccccgccgcccccaaccccgccagcagccccgccaactgcgccgtgcagagcccccagacccccaaccaggcccacacccccggccaggccccccccagacccggcaacggctacctgctgaaccccgccgccgtgaccgtggccggcagcgccagcggccccgtggccgtgcccagcagcgacatgagccccgccgagcagctgaagcagatggccgcccagcagcagcagagagccaagctgatgcagcagaagcagcagcagcagcagcagcagcagcagcagcagcagcagcagcagcagcagcagcagcagcagcagcagcagcagcacagcaaccagaccagcaactggagccccctgggcccccccagcagcccctacggcgccgccttcaccgccgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaacgccgacctgagccagagaatgaccccccccgtggccaaccccaacaagaaccccctgatgccctacatccagcagcagcagcagcagcagcagcagcagcagcagcagcagcagcagcagcagcccccccccccccagctgcaggcccccagagcccacctgagcgaggaccagaagagactgctgctgatgaagcagaagggcgtgatgaaccagcccatggcctacgccgccctgcccagccacggccaggagcagcagcccgtgggctag

SEQ ID NO: 88077 - DNA, 831 bp, Artificial Sequence
  Description of Artificial Sequence: Synthetic coding sequence
atgagccccgccgagcagctgaagcagatggccgcccagcagcagcagagagccaagctgatgcagcagaagcagcagcagcagcagcagcagcagcagcagcagcagcagcagcacagcaaccagaccagcaactggagccccctgggcccccccagcagcccctacggcgccgccttcaccgccgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaacgccgacctgagccagagaatgaccccccccgtggccaaccccaacaagaaccccctgatgccctacatccagcagcagcagcagcagcagcagcagcagcagcagcagcagcagcagcagcagcccccccccccccagctgcaggcccccagagcccacctgagcgaggaccagaagagactgctgctgatgaagcagaagggcgtgatgaaccagcccatggcctacgccgccctgcccagccacggccaggtgagcgtgaaggtgacccacagcagcagcagcagctgcggcgccttcgactgcagatgcgtgatgttctacaagagcaccgtggtgggcagcaactgcctgcagaagaccagcctgcacccccaggtggtggccagattcggcgtgttcttcttccacttcagctag

SEQ ID NO: 88078 - DNA, 3417 bp, Artificial Sequence
  Description of Artificial Sequence: Synthetic coding sequence
atgggcgacttcgccgcccccgccgccgccgccaacggcagcagcatctgcatcaacagcagcctgaacagcagcctgggcggcgccggcatcggcgtgaacaacacccccaacagcacccccgccgcccccagcagcaaccaccccgccgccggcggctgcggcggcagcggcggccccggcggcggcagcgccgccgtgcccaagcacagcaccgtggtggagagactgagacagagaatcgagggctgcagaagacaccacgtgaactgcgagaacagataccagcaggcccaggtggagcagctggagctggagagaagagacaccgtgagcctgtaccagagaaccctggagcagagagccaagaagagcggcgccggcaccggcaagcagcagcaccccagcaagccccagcaggacgccgaggccgccagcgccgagcagagaaaccacaccctgatcatgctgcaggagaccgtgaagagaaagctggagggcgccagaagccccctgaacggcgaccagcagaacggcgcctgcgacggcaacttcagccccaccagcaagagaatcagaaaggacatcagcgccggcatggaggccatcaacaacctgcccagcaacatgcccctgcccagcgccagccccctgcaccagctggacctgaagcccagcctgcccctgcagaacagcggcacccacacccccggcctgctggaggacctgagcaagaacggcagactgcccgagatcaagctgcccgtgaacggctgcagcgacctggaggacagcttcaccatcctgcagagcaaggacctgaagcaggagcccctggacgaccccacctgcatcgacaccagcgagaccagcctgagcaaccagaacaagctgttcagcgacatcaacctgaacgaccaggagtggcaggagctgatcgacgagctggccaacaccgtgcccgaggacgacatccaggacctgttcaacgaggacttcgaggagaagaaggagcccgagttcagccagcccgccaccgagacccccctgagccaggagagcgccagcgtgaagagcgaccccagccacagccccttcgcccacgtgagcatgggcagcccccaggccagacccagcagcagcggcccccccttcagcaccgtgagcaccgccaccagcctgcccagcgtggccagcacccccgccgcccccaaccccgccagcagccccgccaactgcgccgtgcagagcccccagacccccaaccaggcccacacccccggccaggccccccccagacccggcaacggctacctgctgaaccccgccgccgtgaccgtggccggcagcgccagcggccccgtggccgtgcccagcagcgacatgagccccgccgagcagctgaagcagatggccgcccagcagcagcagagagccaagctgatgcagcagaagcagcagcagcagcagcagcagcagcagcagcagcagcagcagcagcagcagcagcagcagcagcagcagcagcagcacagcaaccagaccagcaactggagccccctgggcccccccagcagcccctacggcgccgccttcaccgccgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaacgccgacctgagccagagaatgaccccccccgtggccaaccccaacaagaaccccctgatgccctacatccagcagcagcagcagcagcagcagcagcagcagcagcagcagcagcagcagcagcccccccccccccagctgcaggcccccagagcccacctgagcgaggaccagaagagactgctgctgatgaagcagaagggcgtgatgaaccagcccatggcctacgccgccctgcccagccacggccaggagcagcaccccgtgggcctgcccagaaccaccggccccatgcagagcagcgtgccccccggcagcggcggcatggtgagcggcgccagccccgccggccccggcttcctgggcagccagccccaggccgccatcatgaagcagatgctgatcgaccagagagcccagctgatcgagcagcagaagcagcagttcctgagagagcagagacagcagcagcagcagcagcagcagcagatcctggccgagcagcagctgcagcagagccacctgcccagacagcacctgcagccccagagaaacccctaccccgtgcagcaggtgaaccagttccagggcagcccccaggacatcgccgccgtgagaagccaggccgccctgcagagcatgagaaccagcagactgatggcccagaacgccggcatgatgggcatcggccccagccagaaccccggcaccatggccaccgccgccgcccagagcgagatgggcctggccccctacagcaccacccccaccagccagcccggcatgtacaacatgagcaccggcatgacccagatgctgcagcaccccaaccagagcggcatgagcatcacccacaaccaggcccagggccccagacagcccgccagcggccagggcgtgggcatggtgagcggcttcggccagagcatgctggtgaacagcgccatcacccagcagcacccccagatgaagggccccgtgggccaggccctgcccagaccccaggccccccccagactgcagagcctgatgggcaccgtgcagcagggcgcccagagctggcagcagagaagcctgcagggcatgcccggcagaaccagcggcgagctgggccccttcaacaacggcgccagctaccccctgcaggccggccagcccagactgaccaagcagcacttcccccagggcctgagccagagcgtggtggacgccaacaccggcaccgtgagaaccctgaaccccgccgccatgggcagacagatgatgcccagcctgcccggccagcagggcaccagccaggccagacccatggtgatgagcggcctgagccagggcgtgcccggcatgcccgccttcagccagccccccgcccagcagcagatccccagcggcagcttcgcccccagcagccagagccaggcctacgagagaaacgccccccaggacgtgagctacaactacagcggcgacggcgccggcggcagcttccccggcctgcccgacggcgccgacctggtggacagcatcatcaagggcggccccggcgacgagtggatgcaggagctggacgagctgttcggcaacccctag

SEQ ID NO: 88079 - DNA, 1338 bp, Artificial Sequence
  Description of Artificial Sequence: Synthetic coding sequence
gagcagcaccccgtgggcctgcccagaaccaccggccccatgcagagcagcgtgccccccggcagcggcggcatggtgagcggcgccagccccgccggccccggcttcctgggcagccagccccaggccgccatcatgaagcagatgctgatcgaccagagagcccagctgatcgagcagcagaagcagcagttcctgagagagcagagacagcagcagcagcagcagcagcagcagatcctggccgagcagcagctgcagcagagccacctgcccagacagcacctgcagccccagagaaacccctaccccgtgcagcaggtgaaccagttccagggcagcccccaggacatcgccgccgtgagaagccaggccgccctgcagagcatgagaaccagcagactgatggcccagaacgccggcatgatgggcatcggccccagccagaaccccggcaccatggccaccgccgccgcccagagcgagatgggcctggccccctacagcaccacccccaccagccagcccggcatgtacaacatgagcaccggcatgacccagatgctgcagcaccccaaccagagcggcatgagcatcacccacaaccaggcccagggccccagacagcccgccagcggccagggcgtgggcatggtgagcggcttcggccagagcatgctggtgaacagcgccatcacccagcagcacccccagatgaagggccccgtgggccaggccctgcccagaccccaggccccccccagactgcagagcctgatgggcaccgtgcagcagggcgcccagagctggcagcagagaagcctgcagggcatgcccggcagaaccagcggcgagctgggccccttcaacaacggcgccagctaccccctgcaggccggccagcccagactgaccaagcagcacttcccccagggcctgagccagagcgtggtggacgccaacaccggcaccgtgagaaccctgaaccccgccgccatgggcagacagatgatgcccagcctgcccggccagcagggcaccagccaggccagacccatggtgatgagcggcctgagccagggcgtgcccggcatgcccgccttcagccagccccccgcccagcagcagatccccagcggcagcttcgcccccagcagccagagccaggcctacgagagaaacgccccccaggacgtgagctacaactacagcggcgacggcgccggcggcagcttccccggcctgcccgacggcgccgacctggtggacagcatcatcaagggcggccccggcgacgagtggatgcaggagctggacgagctgttcggcaacccctag

SEQ ID NO: 88080 - DNA, 2325 bp, Artificial Sequence
  Description of Artificial Sequence: Synthetic coding sequence
atggacgactggaagagcagactggtgatcaagagcatgctgccccacttcgccatggtgggcaacagacaggagcccagaaagctgcaggagagcggcaagaagcccagctggatggaggaggaggacctgagcttcctgtacaagagcagccccggcagaaagcaccagggcaccgtgaagagaagacaggaggaggaccacttccagttccccgacatggccgacggcggctaccccaacaagatcaagagaccctgcctggaggacgtgaccctggccatgggccccggcgcccaccccagcaccgcctgcgccgagctgcaggtgccccccctgaccatcaaccccagccccgccgccatgggcgtggccggccagagcctgctgctggagaacaaccccatgaacggcaacatcatgggcagccccttcgtggtgccccagaccaccgaggtgggcctgaagggccccaccgtgccctactacgagaagatcaacagcgtgcccgccgtggaccaggagctgcaggagctgctggaggagctgaccaagatccaggaccccagccccaacgagctggacctggagaagatcctgggcaccaagcccgaggagcccctggtgctggaccacccccaggccaccctgagcaccacccccaagcccagcgtgcagatgagccacctggagagcctggccagcagcaaggagttcgccagcagctgcagccaggtgaccggcatgagcctgcagatccccagcagcagcaccggcatcagctacagcatccccagcaccagcaagcagatcgtgagccccagcagcagcatggcccagagcaagagccaggtgcaggccatgctgcccgtggccctgccccccctgcccgtgccccagtggcaccacgcccaccagctgaaggccctggccgccagcaagcagggcagcgccaccaagcagcagggccccacccccagctggagcggcctgcccccccccggcctgagccccccctacagacccgtgcccagcccccaccccccccccctgcccctgccccccccccccccccccttcagcccccagagcctgatggtgagctgcatgagcagcaacaccctgagcggcagcaccctgagaggcagccccaacgccctgctgagcagcatgaccagcagcagcaacgccgccctgggccccgccatgccctacgcccccgagaagctgcccagccccgccctgacccagcagccccagttcggcccccagagcagcatcctggccaacctgatgagcagcaccatcaagaccccccagggccacctgatgagcgccctgcccgccagcaaccccggccccagccccccctacagacccgagaagctgagcagccccggcctgccccagcagagcttcaccccccagtgcagcctgatcagaagcctgacccccaccagcaacctgctgagccagcagcagcagcagcagcagcagcagcagcaggccaacgtgatcttcaagcccatcagcagcaacagcagcaagaccctgagcatgatcatgcagcagggcatggccagcagcagccccggcgccaccgagcccttcaccttcggcaacaccaagcccctgagccacttcgtgagcgagcccggcccccagaagatgcccagcatgcccaccaccagcagacagcccagcctgctgcactacctgcagcagcccacccccacccaggccagcagcgccaccgccagcagcaccgccaccgccaccctgcagctgcagcagcagcagcagcagcagcagcagcagcccgaccacagcagcttcctgctgcagcagatgatgcagcagccccagagattccagagaagcgtggccagcgacagcatgcccgccctgcccagacagggctgctgccacctgttcgcctggaccagcgccgccagcagcgtgaagccccagcaccagcacggcaacagcttcaccagcagacaggacccccagcccggcgacgtgagccccagcaacatcacccacgtggacaaggcctgcaagctgggcgaggccagacacccccaggtgagcctgggcagacagccccccagctgccaggccctgggcagcgagagcttcctgcccggcagcagcttcgcccacgagctggccagagtgaccagcagctacagcaccagcgaggccgccccctggggcagctgggaccccaaggcctggagacaggtgcccgcccccctgctgcccagctgcgacgccaccgccagaggcaccgagatcagaagctacggcaacgacccctag

SEQ ID NO: 88081 - DNA, 411 bp, Artificial Sequence
  Description of Artificial Sequence: Synthetic coding sequence
atggacgactggaagagcagactggtgatcaagagcatgctgccccacttcgccatggtgggcaacagacaggagcccagaaagctgcaggagagcggcaagaagcccagctggatggaggaggaggacctgagcttcctgtacaagagcagccccggcagaaagcaccagggcaccgtgaagagaagacaggaggaggaccacttccagttccccgacatggccgacggcggctaccccaacaagatcaagagaccctgcctggaggacgtgaccctggccatgggccccggcgcccaccccagcaccgcctgcgccgagctgcaggtgccccccctgaccatcaaccccagccccgccgccatgggcgtggccggccagagcctgctgctggagaacaaccccatgtag

SEQ ID NO: 88082 - DNA, 2325 bp, Artificial Sequence; identical to SEQ ID NO: 88080
  Description of Artificial Sequence: Synthetic coding sequence

SEQ ID NO: 88083 - DNA, 2250 bp, Artificial Sequence
  Description of Artificial Sequence: Synthetic coding sequence
atggacgactggaagagcagactggtgatcaagagcatgctgccccacttcgccatggtgggcaacagacaggagcccagaaagctgcaggagagcggcaccgtgaagagaagacaggaggaggaccacttccagttccccgacatggccgacggcggctaccccaacaagatcaagagaccctgcctggaggacgtgaccctggccatgggccccggcgcccaccccagcaccgcctgcgccgagctgcaggtgccccccctgaccatcaaccccagccccgccgccatgggcgtggccggccagagcctgctgctggagaacaaccccatgaacggcaacatcatgggcagccccttcgtggtgccccagaccaccgaggtgggcctgaagggccccaccgtgccctactacgagaagatcaacagcgtgcccgccgtggaccaggagctgcaggagctgctggaggagctgaccaagatccaggaccccagccccaacgagctggacctggagaagatcctgggcaccaagcccgaggagcccctggtgctggaccacccccaggccaccctgagcaccacccccaagcccagcgtgcagatgagccacctggagagcctggccagcagcaaggagttcgccagcagctgcagccaggtgaccggcatgagcctgcagatccccagcagcagcaccggcatcagctacagcatccccagcaccagcaagcagatcgtgagccccagcagcagcatggcccagagcaagagccaggtgcaggccatgctgcccgtggccctgccccccctgcccgtgccccagtggcaccacgcccaccagctgaaggccctggccgccagcaagcagggcagcgccaccaagcagcagggccccacccccagctggagcggcctgcccccccccggcctgagccccccctacagacccgtgcccagcccccaccccccccccctgcccctgccccccccccccccccccttcagcccccagagcctgatggtgagctgcatgagcagcaacaccctgagcggcagcaccctgagaggcagccccaacgccctgctgagcagcatgaccagcagcagcaacgccgccctgggccccgccatgccctacgcccccgagaagctgcccagccccgccctgacccagcagccccagttcggcccccagagcagcatcctggccaacctgatgagcagcaccatcaagaccccccagggccacctgatgagcgccctgcccgccagcaaccccggccccagccccccctacagacccgagaagctgagcagccccggcctgccccagcagagcttcaccccccagtgcagcctgatcagaagcctgacccccaccagcaacctgctgagccagcagcagcagcagcagcagcagcagcagcaggccaacgtgatcttcaagcccatcagcagcaacagcagcaagaccctgagcatgatcatgcagcagggcatggccagcagcagccccggcgccaccgagcccttcaccttcggcaacaccaagcccctgagccacttcgtgagcgagcccggcccccagaagatgcccagcatgcccaccaccagcagacagcccagcctgctgcactacctgcagcagcccacccccacccaggccagcagcgccaccgccagcagcaccgccaccgccaccctgcagctgcagcagcagcagcagcagcagcagcagcagcccgaccacagcagcttcctgctgcagcagatgatgcagcagccccagagattccagagaagcgtggccagcgacagcatgcccgccctgcccagacagggctgctgccacctgttcgcctggaccagcgccgccagcagcgtgaagccccagcaccagcacggcaacagcttcaccagcagacaggacccccagcccggcgacgtgagccccagcaacatcacccacgtggacaaggcctgcaagctgggcgaggccagacacccccaggtgagcctgggcagacagccccccagctgccaggccctgggcagcgagagcttcctgcccggcagcagcttcgcccacgagctggccagagtgaccagcagctacagcaccagcgaggccgccccctggggcagctgggaccccaaggcctggagacaggtgcccgcccccctgctgcccagctgcgacgccaccgccagaggcaccgagatcagaagctacggcaacgacccctag

SEQ ID NO: 88084 - DNA, 2997 bp, Artificial Sequence
  Description of Artificial Sequence: Synthetic coding sequence
atggacgactggaagagcagactggtgatcaagagcatgctgccccacttcgccatggtgggcaacagacaggagcccagaaagctgcaggagagcggcaccgtgaagagaagacaggaggaggaccacttccagttccccgacatggccgacggcggctaccccaacaagatcaagagaccctgcctggaggacgtgaccctggccatgggccccggcgcccaccccagcaccgcctgcgccgagctgcaggtgccccccctgaccatcaaccccagccccgccgccatgggcgtggccggccagagcctgctgctggagaacaaccccatgaacggcaacatcatgggcagccccttcgtggtgccccagaccaccgaggtgggcctgaagggccccaccgtgccctactacgagaagatcaacagcgtgcccgccgtggaccaggagctgcaggagctgctggaggagctgaccaagatccaggaccccagccccaacgagctggacctggagaagatcctgggcaccaagcccgaggagcccctggtgctggaccacccccaggccaccctgagcaccacccccaagcccagcgtgcagatgagccacctggagagcctggccagcagcaaggagttcgccagcagctgcagccaggtgaccggcatgagcctgcagatccccagcagcagcaccggcatcagctacagcatccccagcaccagcaagcagatcgtgagccccagcagcagcatggcccagagcaagagccaggtgcaggccatgctgcccgtggccctgccccccctgcccgtgccccagtggcaccacgcccaccagctgaaggccctggccgccagcaagcagggcagcgccaccaagcagcagggccccacccccagctggagcggcctgcccccccccggcctgagccccccctacagacccgtgcccagcccccaccccccccccctgcccctgccccccccccccccccccttcagcccccagagcctgatggtgagctgcatgagcagcaacaccctgagcggcagcaccctgagaggcagccccaacgccctgctgagcagcatgaccagcagcagcaacgccgccctgggccccgccatgccctacgcccccgagaagctgcccagccccgccctgacccagcagccccagttcggcccccagagcagcatcctggccaacctgatgagcagcaccatcaagaccccccagggccacctgatgagcgccctgcccgccagcaaccccggccccagccccccctacagacccgagaagctgagcagccccggcctgccccagcagagcttcaccccccagtgcagcctgatcagaagcctgacccccaccagcaacctgctgagccagcagcagcagcagcagcagcagcagcagcaggccaacgtgatcttcaagcccatcagcagcaacagcagcaagaccctgagcatgatcatgcagcagggcatggccagcagcagccccggcgccaccgagcccttcaccttcggcaacaccaagcccctgagccacttcgtgagcgagcccggcccccagaagatgcccagcatgcccaccaccagcagacagcccagcctgctgcactacctgcagcagcccacccccacccaggccagcagcgccaccgccagcagcaccgccaccgccaccctgcagctgcagcagcagcagcagcagcagcagcagcagcccgaccacagcagcttcctgctgcagcagatgatgcagcagccccagagattccagagaagcgtggccagcgacagcatgcccgccctgcccagacagcaggaggagcagagaagcggcctgatggccatgacccccgagagacagaacgcctacatcagccagcagatgagccccttcgaggccgtgcaggagcaggtgaccagcaagtgcagcagaatcaaggccagcccccccagcagcaagcacctgatgccccccagaaccggcctgctgcagaacaacctgagccccggcatgatccccctgaccagacaccagagctgcgagggcatgggcgtgatcagccccaccctgggcaagagacagggcatcttcaccagcagcccccagtgccccatcctgagccacagcggccagacccccctgggcagactggacagcgtgtgccagcacatgcagagccccaaggccaccccccccgaggtgcccctgcccggcttctgccccagcagcctgggcacccagagcctgagcccccaccagctgagaagacccagcgtgcccagaatgcccaccgccttcaacaacgccgcctgggtgaccgccgccgccgccgtgaccaccgccgtgagcggcaagacccccctgagccaggtggacaacagcgtgcagcagcacagccccagcggccaggcctgcctgcagagacccagcgactgggaggcccaggtgcccgccgccatgggcacccaggtgcccctggccaacaaccccagcttcagcctgctgggcagccagagcctgagacagagccccgtgcagggccccgtgcccgtggccaacaccaccaagttcctgcagcagggcatggccagcttcagccccctgagccccatccagggcatcgagccccccagctacgtggccgccgccgccaccgccgccgccgccagcgccgtggccgccagccagttccccggccccttcgacagaaccgacatcccccccgagctgccccccgccgacttcctgagacagccccagccccccctgaacgacctgatcagcagccccgactgcaacgaggtggacttcatcgaggccctgctgaagggcagctgcgtgagccccgacgaggactgggtgtgcaacctgagactgatcgacgacatcctggagcagcacgccgccgcccagaacgccaccgcccagaacagcggccaggtgacccaggacgccggcgccctgtag

SEQ ID NO: 88085 - DNA, 1941 bp, Artificial Sequence
  Description of Artificial Sequence: Synthetic coding sequence
atggaggaggaggacctgagcttcctgtacaagagcagccccggcagaaagcaccagggcaccgtgaagagaagacaggaggaggaccacttccagttccccgacatggccgacggcggctaccccaacaagatcaagagaccctgcctggaggacgtgaccctggccatgggccccggcgcccaccccagcaccgcctgcgccgagctgcaggtgccccccctgaccatcaaccccagccccgccgccatgggcgtggccggccagagcctgctgctggagaacaaccccatgaacggcaacatcatgggcagccccttcgtggtgccccagaccaccgaggtgggcctgaagggccccaccgtgccctactacgagaagatcaacagcgtgcccgccgtggaccaggagctgcaggagctgctggaggagctgaccaagatccaggaccccagccccaacgagctggacctggagaagatcctgggcaccaagcccgaggagcccctggtgctggaccacccccaggccaccctgagcaccacccccaagcccagcgtgcagatgagccacctggagagcctggccagcagcaaggagttcgccagcagctgcagccaggtgaccggcatgagcctgcagatccccagcagcagcaccggcatcagctacagcatccccagcaccagcaagcagatcgtgagccccagcagcagcatggcccagagcaagagccaggtgcaggccatgctgcccgtggccctgccccccctgcccgtgccccagtggcaccacgcccaccagctgaaggccctggccgccagcaagcagggcagcgccaccaagcagcagggccccacccccagctggagcggcctgcccccccccggcctgagccccccctacagacccgtgcccagcccccaccccccccccctgcccctgccccccccccccccccccttcagcccccagagcctgatggtgagctgcatgagcagcaacaccctgagcggcagcaccctgagaggcagccccaacgccctgctgagcagcatgaccagcagcagcaacgccgccctgggccccgccatgccctacgcccccgagaagctgcccagccccgccctgacccagcagccccagttcggcccccagagcagcatcctggccaacctgatgagcagcaccatcaagaccccccagggccacctgatgagcgccctgcccgccagcaaccccggccccagccccccctacagacccgagaagctgagcagccccggcctgccccagcagagcttcaccccccagtgcagcctgctgcactacctgcagcagcccacccccacccaggccagcagcgccaccgccagcagcaccgccaccgccaccctgcagctgcagcagcagcagcagcagcagcagcagcagcccgaccacagcagcttcctgctgcagcagatgatgcagcagccccagagattccagagaagcgtggccagcgacagcatgcccgccctgcccagacagggctgctgccacctgttcgcctggaccagcgccgccagcagcgtgaagccccagcaccagcacggcaacagcttcaccagcagacaggacccccagcccggcgacgtgagccccagcaacatcacccacgtggacaaggcctgcaagctgggcgaggccagacacccccaggtgagcctgggcagacagccccccagctgccaggccctgggcagcgagagcttcctgcccggcagcagcttcgcccacgagctggccagagtgaccagcagctacagcaccagcgaggccgccccctggggcagctgggaccccaaggcctggagacaggtgcccgcccccctgctgcccagctgcgacgccaccgccagaggcaccgagatcagaagctacggcaacgacccctag

SEQ ID NO: 88086 - DNA, 645 bp, Artificial Sequence
  Description of Artificial Sequence: Synthetic coding sequence
atgatcatgcagcagggcatggccagcagcagccccggcgccaccgagcccttcaccttcggcaacaccaagcccctgagccacttcgtgagcgagcccggcccccagaagatgcccagcatgcccaccaccagcagacagcccagcctgctgcactacctgcagcagcccacccccacccaggccagcagcgccaccgccagcagcaccgccaccgccaccctgcagctgcagcagcagcagcagcagcagcagcagcagcccgaccacagcagcttcctgctgcagcagatgatgcagcagccccagagattccagagaagcgtggccagcgacagcatgcccgccctgcccagacagacccacgtggacaaggcctgcaagctgggcgaggccagacacccccaggtgagcctgggcagacagccccccagctgccaggccctgggcagcgagagcttcctgcccggcagcagcttcgcccacgagctggccagagtgaccagcagctacagcaccagcgaggccgccccctggggcagctgggaccccaaggcctggagacaggtgcccgcccccctgctgcccagctgcgacgccaccgccagaggcaccgagatcagaagctacggcaacgacccctag

SEQ ID NO: 88087 - DNA, 1956 bp, Artificial Sequence
  Description of Artificial Sequence: Synthetic coding sequence
atgaaggactacgacgagctgctgaagtactacgagctgcacgagaccatcggcaccggcggcttcgccaaggtgaagctggcctgccacatcctgaccggcgagatggtggccatcaagatcatggacaagaacaccctgggcagcgacctgcccagaatcaagaccgagatcgaggccctgaagaacctgagacaccagcacatctgccagctgtaccacgtgctggagaccgccaacaagatcttcatggtgctggagtactgccccggcggcgagctgttcgactacatcatcagccaggacagactgagcgaggaggagaccagagtggtgttcagacagatcgtgagcgccgtggcctacgtgcacagccagggctacgcccacagagacctgaagcccgagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88088 - DNA, 1743 bp, Artificial Sequence
  Description of Artificial Sequence: Synthetic coding sequence
atgatgaacttcagcaacatcatgaactacatgaagctgctgggccagtactgccccggcggcgagctgttcgactacatcatcagccaggacagactgagcgaggaggagaccagagtggtgttcagacagatcgtgagcgccgtggcctacgtgcacagccagggctacgcccacagagacctgaagcccgagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88089 - DNA, 1812 bp, Artificial Sequence
  Description of Artificial Sequence: Synthetic coding sequence
atgaaggactacgacgagctgctgaagtactacgagctgcacgagaccatcggcaccggcggcttcgccaaggtgaagctggcctgccacatcctgaccggcgagatggtggccatcaagatcatggacaagaacaccctgggcagcgacctgcccagaatcaagaccgagatcgaggccctgaagaacctgagacaccagcacatctgccagctgtaccacgtgctggagaccgccaacaagatcttcatggtgctggaggagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88090 - DNA, 1563 bp, Artificial Sequence
  Description of Artificial Sequence: Synthetic coding sequence
atggtgctggaggagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88091 - DNA, 1374 bp, Artificial Sequence
  Description of Artificial Sequence: Synthetic coding sequence
atgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88092 - DNA, 1833 bp, Artificial Sequence
  Description of Artificial Sequence: Synthetic coding sequence
atgaaggactacgacgagctgctgaagtactacgagctgcacgagaccatcggcaccggcggcttcgccaaggtgaagctggcctgccacatcctgaccggcgagatggtggccatcaagatcatggacaagaacaccctgggcagcgacctgcccagaatcaagaccgagatcgaggccctgaagaacctgagacaccagcacatctgccagctgtaccacgtgctggagaccgccaacaagatcttcatggtgctggagtactgccccggcggcgagctgttcgactacatcatcagccaggacagactgagcgaggaggagaccagagtggtgttcagacagatcgtgagcgccgtggcctacgtgcacagccagggctacgcccacagagacctgaagcccgagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88093 - DNA, 1860 bp, Artificial Sequence
  Description of Artificial Sequence: Synthetic coding sequence
atgatgaacttcagcaacatcatgaactacatgaagctgctgggccagagcgacctgcccagaatcaagaccgagatcgaggccctgaagaacctgagacaccagcacatctgccagctgtaccacgtgctggagaccgccaacaagatcttcatggtgctggagtactgccccggcggcgagctgttcgactacatcatcagccaggacagactgagcgaggaggagaccagagtggtgttcagacagatcgtgagcgccgtggcctacgtgcacagccagggctacgcccacagagacctgaagcccgagaacctgctgttcgacgagtaccacaagctgaagctgatcgacttcggcctgtgcgccaagcccaagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88094 - DNA, 1743 bp, Artificial Sequence
  Description of Artificial Sequence: Synthetic coding sequence
atgaaggactacgacgagctgctgaagtactacgagctgcacgagaccatcggcaccggcggcttcgccaaggtgaagctggcctgccacatcctgaccggcgagatggtggccatcaagatcatggacaagaacaccctgggcagcgacctgcccagaatcaagaccgagatcgaggccctgaagaacctgagacaccagcacatctgccagctgtaccacgtgctggagaccgccaacaagatcttcatggtgctggagggcaacaaggactaccacctgcagacctgctgcggcagcctggcctacgccgcccccgagctgatccagggcaagagctacctgggcagcgaggccgacgtgtggagcatgggcatcctgctgtacgtgctgatgtgcggcttcctgcccttcgacgacgacaacgtgatggccctgtacaagaagatcatgagaggcaagtacgacgtgcccaagtggctgagccccagcagcatcctgctgctgcagcagatgctgcaggtggaccccaagaagagaatcagcatgaagaacctgctgaaccacccctggatcatgcaggactacaactaccccgtggagtggcagagcaagaaccccttcatccacctggacgacgactgcgtgaccgagctgagcgtgcaccacagaaacaacagacagaccatggaggacctgatcagcctgtggcagtacgaccacctgaccgccacctacctgctgctgctggccaagaaggccagaggcaagcccgtgagactgagactgagcagcttcagctgcggccaggccagcgccacccccttcaccgacatcaagagcaacaactggagcctggaggacgtgaccgccagcgacaagaactacgtggccggcctgatcgactacgactggtgcgaggacgacctgagcaccggcgccgccacccccagaaccagccagttcaccaagtactggaccgagagcaacggcgtggagagcaagagcctgacccccgccctgtgcagaacccccgccaacaagctgaagaacaaggagaacgtgtacacccccaagagcgccgtgaagaacgaggagtacttcatgttccccgagcccaagacccccgtgaacaagaaccagcacaagagagagatcctgaccacccccaacagatacaccacccccagcaaggccagaaaccagtgcctgaaggagacccccatcaagatccccgtgaacagcaccggcaccgacaagctgatgaccggcgtgatcagccccgagagaagatgcagaagcgtggagctggacctgaaccaggcccacatggaggagacccccaagagaaagggcgccaaggtgttcggcagcctggagagaggcctggacaaggtgatcaccgtgctgaccagaagcaagagaaagggcagcgccagagacggccccagaagactgaagctgcactacaacgtgaccaccaccagactggtgaaccccgaccagctgctgaacgagatcatgagcatcctgcccaagaagcacgtggacttcgtgcagaagggctacaccctgaagtgccagacccagagcgacttcggcaaggtgaccatgcagttcgagctggaggtgtgccagctgcagaagcccgacgtggtgggcatcagaagacagagactgaagggcgacgcctgggtgtacaagagactggtggaggacatcctgagcagctgcaaggtgtag

SEQ ID NO: 88095 - DNA, 1491 bp, Artificial Sequence
  Description of Artificial Sequence: Synthetic coding sequence
atgagagtgctgagcggcaccagcctgatgctgtgcagcctgctgctgctgctgcaggccctgtgcagccccggcctggccccccagagcagaggccacctgtgcagaaccagacccaccgacctggtgttcgtggtggacagcagcagaagcgtgagacccgtggagttcgagaaggtgaaggtgttcctgagccaggtgatcgagagcctggacgtgggccccaacgccaccagagtgggcatggtgaactacgccagcaccgtgaagcaggagttcagcctgagagcccacgtgagcaaggccgccctgctgcaggccgtgagaagaatccagcccctgagcaccggcaccatgaccggcctggccatccagttcgccatcaccaaggccttcggcgacgccgagggcggcagaagcagaagccccgacatcagcaaggtggtgatcgtggtgaccgacggcagaccccaggacagcgtgcaggacgtgagcgccagagccagagccagcggcgtggagctgttcgccatcggcgtgggcagcgtggacaaggccaccctgagacagatcgccagcgagccccaggacgagcacgtggactacgtggagagctacagcgtgatcgagaagctgagcagaaagttccaggaggccttctgcgtggtgagcgacctgtgcgccaccggcgaccacgactgcgagcaggtgtgcatcagcagccccggcagctacacctgcgcctgccacgagggcttcaccctgaacagcgacggcaagacctgcaacgtgtgcagcggcggcggcggcagcagcgccaccgacctggtgttcctgatcgacggcagcaagagcgtgagacccgagaacttcgagctggtgaagaagttcatcagccagatcgtggacaccctggacgtgagcgacaagctggcccaggtgggcctggtgcagtacagcagcagcgtgagacaggagttccccctgggcagattccacaccaagaaggacatcaaggccgccgtgagaaacatgagctacatggagaagggcaccatgaccggcgccgccctgaagtacctgatcgacaacagcttcaccgtgagcagcggcgccagacccggcgcccagaaggtgggcatcgtgttcaccgacggcagaagccaggactacatcaacgacgccgccaagaaggccaaggacctgggcttcaagatgttcgccgtgggcgtgggcaacgccgtggaggacgagctgagagagatcgccagcgagcccgtggccgagcactacttctacaccgccgacttcaagaccatcaaccagatcggcaagaagctgcagaagaagatctgcgtggaggaggacccctgcgcctgcgagagcctggtgaagttccaggccaaggtggagggcctgctgcaggccctgaccagaaagctggaggccgtgagcaagagactggccatcctggagaacaccgtggtgtag

SEQ ID NO: 88096 - DNA, 2874 bp, Artificial Sequence
  Description of Artificial Sequence: Synthetic coding sequence
atggagaagatgctggccggctgcttcctgctgatcctgggccagatcgtgctgctgcccgccgaggccagagagagaagcagaggcagaagcatcagcagaggcagacacgccagaacccacccccagaccgccctgctggagagcagctgcgagaacaagagagccgacctggtgttcatcatcgacagcagcagaagcgtgaacacccacgactacgccaaggtgaaggagttcatcgtggacatcctgcagttcctggacatcggccccgacgtgaccagagtgggcctgctgcagtacggcagcaccgtgaagaacgagttcagcctgaagaccttcaagagaaagagcgaggtggagagagccgtgaagagaatgagacacctgagcaccggcaccatgaccggcctggccatccagtacgccctgaacatcgccttcagcgaggccgagggcgccagacccctgagagagaacgtgcccagagtgatcatgatcgtgaccgacggcagaccccaggacagcgtggccgaggtggccgccaaggccagagacaccggcatcctgatcttcgccatcggcgtgggccaggtggacttcaacaccctgaagagcatcggcagcgagccccacgaggaccacgtgttcctggtggccaacttcagccagatcgagaccctgaccagcgtgttccagaagaagctgtgcaccgcccacatgtgcagcaccctggagcacaactgcgcccacttctgcatcaacatccccggcagctacgtgtgcagatgcaagcagggctacatcctgaacagcgaccagaccacctgcagaatccaggacctgtgcgccatggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccaagatcgactactgcgccagcagcaaccacggctgccagcacgagtgcgtgaacaccgacgacagctacagctgccactgcctgaagggcttcaccctgaaccccgacaagaagacctgcagaagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgagagcgagcccgtgaccatcaacatccaggacctgctgagctgcagcaacttcgccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagactgctggaggagatgacccagagaatggaggccctggagaacagactgagatacagatag

SEQ ID NO: 88097 - DNA, 2754 bp, Artificial Sequence
  Description of Artificial Sequence: Synthetic coding sequence
atggagaagatgctggccggctgcttcctgctgatcctgggccagatcgtgctgctgcccgccgaggccagagagagaagcagaggcagaagcatcagcagaggcagacacgccagaacccacccccagaccgccctgctggagagcagctgcgagaacaagagagccgacctggtgttcatcatcgacagcagcagaagcgtgaacacccacgactacgccaaggtgaaggagttcatcgtggacatcctgcagttcctggacatcggccccgacgtgaccagagtgggcctgctgcagtacggcagcaccgtgaagaacgagttcagcctgaagaccttcaagagaaagagcgaggtggagagagccgtgaagagaatgagacacctgagcaccggcaccatgaccggcctggccatccagtacgccctgaacatcgccttcagcgaggccgagggcgccagacccctgagagagaacgtgcccagagtgatcatgatcgtgaccgacggcagaccccaggacagcgtggccgaggtggccgccaaggccagagacaccggcatcctgatcttcgccatcggcgtgggccaggtggacttcaacaccctgaagagcatcggcagcgagccccacgaggaccacgtgttcctggtggccaacttcagccagatcgagaccctgaccagcgtgttccagaagaagctgtgcaccgcccacatgtgcagcaccctggagcacaactgcgcccacttctgcatcaacatccccggcagctacgtgtgcagatgcaagcagggctacatcctgaacagcgaccagaccacctgcagaatccaggacctgtgcgccatggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgagagcgagcccgtgaccatcaacatccaggacctgctgagctgcagcaacttcgccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagatacctgctggaggagatgacccagagaatggaggccctggagaacagactgagatacagatag

SEQ ID NO: 88098 - DNA, 348 bp, Artificial Sequence
  Description of Artificial Sequence: Synthetic coding sequence
atggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccaagatcgactactgcgccagcagcaaccacggctgccagcacgagtgcgtgaacaccgacgacagctacagctgccactgcctgaagggcttcaccctgaaccccgacaagaagacctag

SEQ ID NO: 88099 - DNA, 2871 bp, Artificial Sequence
  Description of Artificial Sequence: Synthetic coding sequence
atggagaagatgctggccggctgcttcctgctgatcctgggccagatcgtgctgctgcccgccgaggccagagagagaagcagaggcagaagcatcagcagaggcagacacgccagaacccacccccagaccgccctgctggagagcagctgcgagaacaagagagccgacctggtgttcatcatcgacagcagcagaagcgtgaacacccacgactacgccaaggtgaaggagttcatcgtggacatcctgcagttcctggacatcggccccgacgtgaccagagtgggcctgctgcagtacggcagcaccgtgaagaacgagttcagcctgaagaccttcaagagaaagagcgaggtggagagagccgtgaagagaatgagacacctgagcaccggcaccatgaccggcctggccatccagtacgccctgaacatcgccttcagcgaggccgagggcgccagacccctgagagagaacgtgcccagagtgatcatgatcgtgaccgacggcagaccccaggacagcgtggccgaggtggccgccaaggccagagacaccggcatcctgatcttcgccatcggcgtgggccaggtggacttcaacaccctgaagagcatcggcagcgagccccacgaggaccacgtgttcctggtggccaacttcagccagatcgagaccctgaccagcgtgttccagaagaagctgtgcaccgcccacatgtgcagcaccctggagcacaactgcgcccacttctgcatcaacatccccggcagctacgtgtgcagatgcaagcagggctacatcctgaacagcgaccagaccacctgcagaatccaggacctgtgcgccatggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccaagatcgactactgcgccagcagcaaccacggctgccagcacgagtgcgtgaacaccgacgacagctacagctgccactgcctgaagggcttcaccctgaaccccgacaagaagacctgcagaagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgagagcgagcccgtgaccatcaacatccaggacctgctgagctgcagcaacttcgccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagactggaggagatgacccagagaatggaggccctggagaacagactgagatacagatag

SEQ ID NO: 88100 - DNA, 2814 bp, Artificial Sequence
  Description of Artificial Sequence: Synthetic coding sequence
atggagaagatgctggccggctgcttcctgctgatcctgggccagatcgtgctgctgcccgccgaggccagagagagaagcagaggcagaagcatcagcagaggcagacacgccagaacccacccccagaccgccctgctggagagcagctgcgagaacaagagagccgacctggtgttcatcatcgacagcagcagaagcgtgaacacccacgactacgccaaggtgaaggagttcatcgtggacatcctgcagttcctggacatcggccccgacgtgaccagagtgggcctgctgcagtacggcagcaccgtgaagaacgagttcagcctgaagaccttcaagagaaagagcgaggtggagagagccgtgaagagaatgagacacctgagcaccggcaccatgaccggcctggccatccagtacgccctgaacatcgccttcagcgaggccgagggcgccagacccctgagagagaacgtgcccagagtgatcatgatcgtgaccgacggcagaccccaggacagcgtggccgaggtggccgccaaggccagagacaccggcatcctgatcttcgccatcggcgtgggccaggtggacttcaacaccctgaagagcatcggcagcgagccccacgaggaccacgtgttcctggtggccaacttcagccagatcgagaccctgaccagcgtgttccagaagaagctgtgcaccgcccacatgtgcagcaccctggagcacaactgcgcccacttctgcatcaacatccccggcagctacgtgtgcagatgcaagcagggctacatcctgaacagcgaccagaccacctgcagaatccaggacctgtgcgccatggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccaagatcgactactgcgccagcagcaaccacggctgccagcacgagtgcgtgaacaccgacgacagctacagctgccactgcctgaagggcttcaccctgaaccccgacaagaagacctgcagaagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagactggaggagatgacccagagaatggaggccctggagaacagactgagatacagatag

SEQ ID NO: 88101 - DNA, 2019 bp, Artificial Sequence
  Description of Artificial Sequence: Synthetic coding sequence
atggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccaagatcgactactgcgccagcagcaaccacggctgccagcacgagtgcgtgaacaccgacgacagctacagctgccactgcctgaagggcttcaccctgaaccccgacaagaagacctgcagaagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgagagcgagcccgtgaccatcaacatccaggacctgctgagctgcagcaacttcgccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagactggaggagatgacccagagaatggaggccctggagaacagactgagatacagatag

SEQ ID NO: 88102 - DNA, 2748 bp, Artificial Sequence
  Description of Artificial Sequence: Synthetic coding sequence
atggagaagatgctggccggctgcttcctgctgatcctgggccagatcgtgctgctgcccgccgaggccagagagagaagcagaggcagaagcatcagcagaggcagacacgccagaacccacccccagaccgccctgctggagagcagctgcgagaacaagagagccgacctggtgttcatcatcgacagcagcagaagcgtgaacacccacgactacgccaaggtgaaggagttcatcgtggacatcctgcagttcctggacatcggccccgacgtgaccagagtgggcctgctgcagtacggcagcaccgtgaagaacgagttcagcctgaagaccttcaagagaaagagcgaggtggagagagccgtgaagagaatgagacacctgagcaccggcaccatgaccggcctggccatccagtacgccctgaacatcgccttcagcgaggccgagggcgccagacccctgagagagaacgtgcccagagtgatcatgatcgtgaccgacggcagaccccaggacagcgtggccgaggtggccgccaaggccagagacaccggcatcctgatcttcgccatcggcgtgggccaggtggacttcaacaccctgaagagcatcggcagcgagccccacgaggaccacgtgttcctggtggccaacttcagccagatcgagaccctgaccagcgtgttccagaagaagctgtgcaccgcccacatgtgcagcaccctggagcacaactgcgcccacttctgcatcaacatccccggcagctacgtgtgcagatgcaagcagggctacatcctgaacagcgaccagaccacctgcagaatccaggacctgtgcgccatggaggaccacaactgcgagcagctgtgcgtgaacgtgcccggcagcttcgtgtgccagtgctacagcggctacgccctggccgaggacggcaagagatgcgtggccgtggactactgcgccagcgagaaccacggctgcgagcacgagtgcgtgaacgccgacggcagctacctgtgccagtgccacgagggcttcgccctgaaccccgacaagaagacctgcaccagaatcaactactgcgccctgaacaagcccggctgcgagcacgagtgcgtgaacatggaggagagctactactgcagatgccacagaggctacaccctggaccccaacggcaagacctgcagcagagtggaccactgcgcccagcaggaccacggctgcgagcagctgtgcctgaacaccgaggacagcttcgtgtgccagtgcagcgagggcttcctgatcaacgaggacctgaagacctgcagcagagtggactactgcctgctgagcgaccacggctgcgagtacagctgcgtgaacatggacagaagcttcgcctgccagtgccccgagggccacgtgctgagaagcgacggcaagacctgcgccaagctggacagctgcgccctgggcgaccacggctgcgagcacagctgcgtgagcagcgaggacagcttcgtgtgccagtgcttcgagggctacatcctgagagaggacggcaagacctgcagaagaaaggacgtgtgccaggccatcgaccacggctgcgagcacatctgcgtgaacagcgacgacagctacacctgcgagtgcctggagggcttcagactggccgaggacggcaagagatgcagaagaaaggacgtgtgcaagagcacccaccacggctgcgagcacatctgcgtgaacaacggcaacagctacatctgcaagtgcagcgagggcttcgtgctggccgaggacggcagaagatgcaagaagtgcaccgagggccccatcgacctggtgttcgtgatcgacggcagcaagagcctgggcgaggagaacttcgaggtggtgaagcagttcgtgaccggcatcatcgacagcctgaccatcagccccaaggccgccagagtgggcctgctgcagtacagcacccaggtgcacaccgagttcaccctgagaaacttcaacagcgccaaggacatgaagaaggccgtggcccacatgaagtacatgggcaagggcagcatgaccggcctggccctgaagcacatgttcgagagaagcttcacccagggcgagggcgccagacccctgagcaccagagtgcccagagccgccatcgtgttcaccgacggcagagcccaggacgacgtgagcgagtgggccagcaaggccaaggccaacggcatcaccatgtacgccgtgggcgtgggcaaggccatcgaggaggagctgcaggagatcgccagcgagcccaccaacaagcacctgttctacgccgaggacttcagcaccatggacgagatcagcgagaagctgaagaagggcatctgcgaggccctggaggacagcgacggcagacaggacagccccgccggcgagctgcccaagaccgtgcagcagcccaccgagagcgagcccgtgaccatcaacatccaggacctgctgagctgcagcaacttcgccgtgcagcacagatacctgttcgaggaggacaacctgctgagaagcacccagaagctgagccacagcaccaagcccagcggcagccccctggaggagaagcacgaccagtgcaagtgcgagaacctgatcatgttccagaacctggccaacgaggaggtgagaaagctgacccagagactggaggagatgacccagagaatggaggccctggagaacagactgagatacagatag

SEQ ID NO: 88103 - DNA, 1461 bp, Artificial Sequence
  Description of Artificial Sequence: Synthetic coding sequence
atgcccagacccgcccccgccagaagactgcccggcctgctgctgctgctgtggcccctgctgctgctgcccagcgccgcccccgaccccgtggccagacccggcttcagaagactggagaccagaggccccggcggcagccccggcagaagacccagccccgccgcccccgacggcgcccccgccagcggcaccagcgagcccggcagagccagaggcgccggcgtgtgcaagagcagacccctggacctggtgttcatcatcgacagcagcagaagcgtgagacccctggagttcaccaaggtgaagaccttcgtgagcagaatcatcgacaccctggacatcggccccgccgacaccagagtggccgtggtgaactacgccagcaccgtgaagatcgagttccagctgcaggcctacaccgacaagcagagcctgaagcaggccgtgggcagaatcacccccctgagcaccggcaccatgagcggcctggccatccagaccgccatggacgaggccttcaccgtggaggccggcgccagagagcccagcagcaacatccccaaggtggccatcatcgtgaccgacggcagaccccaggaccaggtgaacgaggtggccgccagagcccaggccagcggcatcgagctgtacgccgtgggcgtggacagagccgacatggccagcctgaagatgatggccagcgagcccctggaggagcacgtgttctacgtggagacctacggcgtgatcgagaagctgagcagcagattccaggagaccttctgcgccctggacccctgcgtgctgggcacccaccagtgccagcacgtgtgcatcagcgacggcgagggcaagcaccactgcgagtgcagccagggctacaccctgaacgccgacaagaagacctgcagcgccctggacagatgcgccctgaacacccacggctgcgagcacatctgcgtgaacgacagaagcggcagctaccactgcgagtgctacgagggctacaccctgaacgaggacagaaagacctgcagcgcccaggacaagtgcgccctgggcacccacggctgccagcacatctgcgtgaacgacagaaccggcagccaccactgcgagtgctacgagggctacaccctgaacgccgacaagaagacctgcagcgtgagagacaagtgcgccctgggcagccacggctgccagcacatctgcgtgagcgacggcgccgccagctaccactgcgactgctaccccggctacaccctgaacgaggacaagaagacctgcagcgccaccgaggaggccagaagactggtgagcaccgaggacgcctgcggctgcgaggccaccctggccttccaggacaaggtgagcagctacctgcagagactgaacaccaagctggacgacatcctggagaagctgaagatcaacgagtacggccagatccacagatag

SEQ ID NO: 88104 - DNA, 1335 bp, Artificial Sequence
  Description of Artificial Sequence: Synthetic coding sequence
atgcccagacccgcccccgccagaagactgcccggcctgctgctgctgctgtggcccctgctgctgctgcccagcgccgcccccgaccccgtggccagacccggcttcagaagactggagaccagaggccccggcggcagccccggcagaagacccagccccgccgcccccgacggcgcccccgccagcggcaccagcgagcccggcagagccagaggcgccggcgtgtgcaagagcagacccctggacctggtgttcatcatcgacagcagcagaagcgtgagacccctggagttcaccaaggtgaagaccttcgtgagcagaatcatcgacaccctggacatcggccccgccgacaccagagtggccgtggtgaactacgccagcaccgtgaagatcgagttccagctgcaggcctacaccgacaagcagagcctgaagcaggccgtgggcagaatcacccccctgagcaccggcaccatgagcggcctggccatccagaccgccatggacgaggccttcaccgtggaggccggcgccagagagcccagcagcaacatccccaaggtggccatcatcgtgaccgacggcagaccccaggaccaggtgaacgaggtggccgccagagcccaggccagcggcatcgagctgtacgccgtgggcgtggacagagccgacatggccagcctgaagatgatggccagcgagcccctggaggagcacgtgttctacgtggagacctacggcgtgatcgagaagctgagcagcagattccaggagaccttctgcgccctggacagatgcgccctgaacacccacggctgcgagcacatctgcgtgaacgacagaagcggcagctaccactgcgagtgctacgagggctacaccctgaacgaggacagaaagacctgcagcgcccaggacaagtgcgccctgggcacccacggctgccagcacatctgcgtgaacgacagaaccggcagccaccactgcgagtgctacgagggctacaccctgaacgccgacaagaagacctgcagcgtgagagacaagtgcgccctgggcagccacggctgccagcacatctgcgtgagcgacggcgccgccagctaccactgcgactgctaccccggctacaccctgaacgaggacaagaagacctgcagcgccaccgaggaggccagaagactggtgagcaccgaggacgcctgcggctgcgaggccaccctggccttccaggacaaggtgagcagctacctgcagagactgaacaccaagctggacgacatcctggagaagctgaagatcaacgagtacggccagatccacagatag

SEQ ID NO: 88105 - DNA, 1869 bp, Artificial Sequence
  Description of Artificial Sequence: Synthetic coding sequence
atgagaggcctgctgtgctggcccgtgctgctgctgctgctgcagccctgggagacccagctgcagctgaccggccccagatgccacaccggccccctggacctggtgttcgtgatcgacagcagcagaagcgtgagacccttcgagttcgagaccatgagacagttcctgatgggcctgctgagaggcctgaacgtgggccccaacgccaccagagtgggcgtgatccagtacagcagccaggtgcagagcgtgttccccctgagagccttcagcagaagagaggacatggagagagccatcagagacctggtgcccctggcccagggcaccatgaccggcctggccatccagtacgccatgaacgtggccttcagcgtggccgagggcgccagaccccccgaggagagagtgcccagagtggccgtgatcgtgaccgacggcagaccccaggacagagtggccgaggtggccgcccaggccagagccagaggcatcgagatctacgccgtgggcgtgcagagagccgacgtgggcagcctgagagccatggccagcccccccctggacgagcacgtgttcctggtggagagcttcgacctgatccaggagttcggcctgcagttccagagcagactgtgcggcaaggaccagtgcgccgagggcggccacggctgccagcaccagtgcgtgaacgcctgggccatgttccactgcacctgcaaccccggctacaagctggccgccgacaacaagagctgcctggccatcgacctgtgcgccgagggcacccacggctgcgagcaccactgcgtgaacagccccggcagctacttctgccactgccaggtgggcttcgtgctgcagcaggaccagagaagctgcagagccatcgactactgcagcttcggcaaccacagctgccagcacgagtgcgtgagcacccccggcggccccagatgccactgcagagagggccacgacctgcagcccgacggcagaagctgccaggtgagagacctgtgcaacggcgtggaccacggctgcgagttccagtgcgtgagcgagggcctgagctacagatgcctgtgccccgagggcagacagctgcaggccgacggcaagagctgcaacagatgcagagagggccacgtggacctggtgctgctggtggacggcagcaagagcgtgagaccccagaacttcgagctggtgaagagattcgtgaaccagatcgtggacttcctggacgtgagccccgagggcaccagagtgggcctggtgcagttcagcagcagagtgagaaccgagttccccctgggcagatacggcaccgccgccgaggtgaagcaggccgtgctggccgtggagtacatggagagaggcaccatgaccggcctggccctgagacacatggtggagcacagcttcagcgaggcccagggcgccagacccagagccctgaacgtgcccagagtgggcctggtgttcaccgacggcagaagccaggacgacatcagcgtgtgggccgccagagccaaggaggagggcatcgtgatgtacgccgtgggcgtgggcaaggccgtggaggccgagctgagagagatcgccagcgagcccgccgagctgcacgtgagctacgcccccgacttcggcaccatgacccacctgctggagaacctgagaggcagcatctgccccgaggagggcatcagcgccggcaccgagctgagaagcccctgcgagtgcgagagcctggtggagttccagggcagaaccctgggcgccctggagagcctgaccctgaacctggcccagctgaccgccagactggaggacctggagaaccagctggccaaccagaagtag

SEQ ID NO: 88106 - DNA, 1746 bp, Artificial Sequence
  Description of Artificial Sequence: Synthetic coding sequence
atgagaggcctgctgtgctggcccgtgctgctgctgctgctgcagccctgggagacccagctgcagctgaccggccccagatgccacaccggccccctggacctggtgttcgtgatcgacagcagcagaagcgtgagacccttcgagttcgagaccatgagacagttcctgatgggcctgctgagaggcctgaacgtgggccccaacgccaccagagtgggcgtgatccagtacagcagccaggtgcagagcgtgttccccctgagagccttcagcagaagagaggacatggagagagccatcagagacctggtgcccctggcccagggcaccatgaccggcctggccatccagtacgccatgaacgtggccttcagcgtggccgagggcgccagaccccccgaggagagagtgcccagagtggccgtgatcgtgaccgacggcagaccccaggacagagtggccgaggtggccgcccaggccagagccagaggcatcgagatctacgccgtgggcgtgcagagagccgacgtgggcagcctgagagccatggccagcccccccctggacgagcacgtgttcctggtggagagcttcgacctgatccaggagttcggcctgcagttccagagcagactgtgcgccatcgacctgtgcgccgagggcacccacggctgcgagcaccactgcgtgaacagccccggcagctacttctgccactgccaggtgggcttcgtgctgcagcaggaccagagaagctgcagagccatcgactactgcagcttcggcaaccacagctgccagcacgagtgcgtgagcacccccggcggccccagatgccactgcagagagggccacgacctgcagcccgacggcagaagctgccaggtgagagacctgtgcaacggcgtggaccacggctgcgagttccagtgcgtgagcgagggcctgagctacagatgcctgtgccccgagggcagacagctgcaggccgacggcaagagctgcaacagatgcagagagggccacgtggacctggtgctgctggtggacggcagcaagagcgtgagaccccagaacttcgagctggtgaagagattcgtgaaccagatcgtggacttcctggacgtgagccccgagggcaccagagtgggcctggtgcagttcagcagcagagtgagaaccgagttccccctgggcagatacggcaccgccgccgaggtgaagcaggccgtgctggccgtggagtacatggagagaggcaccatgaccggcctggccctgagacacatggtggagcacagcttcagcgaggcccagggcgccagacccagagccctgaacgtgcccagagtgggcctggtgttcaccgacggcagaagccaggacgacatcagcgtgtgggccgccagagccaaggaggagggcatcgtgatgtacgccgtgggcgtgggcaaggccgtggaggccgagctgagagagatcgccagcgagcccgccgagctgcacgtgagctacgcccccgacttcggcaccatgacccacctgctggagaacctgagaggcagcatctgccccgaggagggcatcagcgccggcaccgagctgagaagcccctgcgagtgcgagagcctggtggagttccagggcagaaccctgggcgccctggagagcctgaccctgaacctggcccagctgaccgccagactggaggacctggagaaccagctggccaaccagaagtag

SEQ ID NO: 88107 - DNA, 1500 bp, Artificial Sequence
  Description of Artificial Sequence: Synthetic coding sequence
atgagaggcctgctgtgctggcccgtgctgctgctgctgctgcagccctgggagacccagctgcagctgaccggccccagatgccacaccggccccctggacctggtgttcgtgatcgacagcagcagaagcgtgagacccttcgagttcgagaccatgagacagttcctgatgggcctgctgagaggcctgaacgtgggccccaacgccaccagagtgggcgtgatccagtacagcagccaggtgcagagcgtgttccccctgagagccttcagcagaagagaggacatggagagagccatcagagacctggtgcccctggcccagggcaccatgaccggcctggccatccagtacgccatgaacgtggccttcagcgtggccgagggcgccagaccccccgaggagagagtgcccagagtggccgtgatcgtgaccgacggcagaccccaggacagagtggccgaggtggccgcccaggccagagccagaggcatcgagatctacgccgtgggcgtgcagagagccgacgtgggcagcctgagagccatggccagcccccccctggacgagcacgtgttcctggtggagagcttcgacctgatccaggagttcggcctgcagttccagagcagactgtgcgtgagagacctgtgcaacggcgtggaccacggctgcgagttccagtgcgtgagcgagggcctgagctacagatgcctgtgccccgagggcagacagctgcaggccgacggcaagagctgcaacagatgcagagagggccacgtggacctggtgctgctggtggacggcagcaagagcgtgagaccccagaacttcgagctggtgaagagattcgtgaaccagatcgtggacttcctggacgtgagccccgagggcaccagagtgggcctggtgcagttcagcagcagagtgagaaccgagttccccctgggcagatacggcaccgccgccgaggtgaagcaggccgtgctggccgtggagtacatggagagaggcaccatgaccggcctggccctgagacacatggtggagcacagcttcagcgaggcccagggcgccagacccagagccctgaacgtgcccagagtgggcctggtgttcaccgacggcagaagccaggacgacatcagcgtgtgggccgccagagccaaggaggagggcatcgtgatgtacgccgtgggcgtgggcaaggccgtggaggccgagctgagagagatcgccagcgagcccgccgagctgcacgtgagctacgcccccgacttcggcaccatgacccacctgctggagaacctgagaggcagcatctgccccgaggagggcatcagcgccggcaccgagctgagaagcccctgcgagtgcgagagcctggtggagttccagggcagaaccctgggcgccctggagagcctgaccctgaacctggcccagctgaccgccagactggaggacctggagaaccagctggccaaccagaagtag

SEQ ID NO: 88108 - DNA, 1623 bp, Artificial Sequence
  Description of Artificial Sequence: Synthetic coding sequence
atgagaggcctgctgtgctggcccgtgctgctgctgctgctgcagccctgggagacccagctgcagctgaccggccccagatgccacaccggccccctggacctggtgttcgtgatcgacagcagcagaagcgtgagacccttcgagttcgagaccatgagacagttcctgatgggcctgctgagaggcctgaacgtgggccccaacgccaccagagtgggcgtgatccagtacagcagccaggtgcagagcgtgttccccctgagagccttcagcagaagagaggacatggagagagccatcagagacctggtgcccctggcccagggcaccatgaccggcctggccatccagtacgccatgaacgtggccttcagcgtggccgagggcgccagaccccccgaggagagagtgcccagagtggccgtgatcgtgaccgacggcagaccccaggacagagtggccgaggtggccgcccaggccagagccagaggcatcgagatctacgccgtgggcgtgcagagagccgacgtgggcagcctgagagccatggccagcccccccctggacgagcacgtgttcctggtggagagcttcgacctgatccaggagttcggcctgcagttccagagcagactgtgcgccatcgactactgcagcttcggcaaccacagctgccagcacgagtgcgtgagcacccccggcggccccagatgccactgcagagagggccacgacctgcagcccgacggcagaagctgccaggtgagagacctgtgcaacggcgtggaccacggctgcgagttccagtgcgtgagcgagggcctgagctacagatgcctgtgccccgagggcagacagctgcaggccgacggcaagagctgcaacagatgcagagagggccacgtggacctggtgctgctggtggacggcagcaagagcgtgagaccccagaacttcgagctggtgaagagattcgtgaaccagatcgtggacttcctggacgtgagccccgagggcaccagagtgggcctggtgcagttcagcagcagagtgagaaccgagttccccctgggcagatacggcaccgccgccgaggtgaagcaggccgtgctggccgtggagtacatggagagaggcaccatgaccggcctggccctgagacacatggtggagcacagcttcagcgaggcccagggcgccagacccagagccctgaacgtgcccagagtgggcctggtgttcaccgacggcagaagccaggacgacatcagcgtgtgggccgccagagccaaggaggagggcatcgtgatgtacgccgtgggcgtgggcaaggccgtggaggccgagctgagagagatcgccagcgagcccgccgagctgcacgtgagctacgcccccgacttcggcaccatgacccacctgctggagaacctgagaggcagcatctgccccgaggagggcatcagcgccggcaccgagctgagaagcccctgcgagtgcgagagcctggtggagttccagggcagaaccctgggcgccctggagagcctgaccctgaacctggcccagctgaccgccagactggaggacctggagaaccagctggccaaccagaagtag

SEQ ID NO: 88109 - DNA, 1299 bp, Artificial Sequence
  Description of Artificial Sequence: Synthetic coding sequence
atgagaggcctgctgtgctggcccgtgctgctgctgctgctgcagccctgggagacccagctgcagctgaccggcaaggaccagtgcgccgagggcggccacggctgccagcaccagtgcgtgaacgcctgggccatgttccactgcacctgcaaccccggctacaagctggccgccgacaacaagagctgcctggccatcgacctgtgcgccgagggcacccacggctgcgagcaccactgcgtgaacagccccggcagctacttctgccactgccaggtgggcttcgtgctgcagcaggaccagagaagctgcagagccatcgactactgcagcttcggcaaccacagctgccagcacgagtgcgtgagcacccccggcggccccagatgccactgcagagagggccacgacctgcagcccgacggcagaagctgccaggtgagagacctgtgcaacggcgtggaccacggctgcgagttccagtgcgtgagcgagggcctgagctacagatgcctgtgccccgagggcagacagctgcaggccgacggcaagagctgcaacagatgcagagagggccacgtggacctggtgctgctggtggacggcagcaagagcgtgagaccccagaacttcgagctggtgaagagattcgtgaaccagatcgtggacttcctggacgtgagccccgagggcaccagagtgggcctggtgcagttcagcagcagagtgagaaccgagttccccctgggcagatacggcaccgccgccgaggtgaagcaggccgtgctggccgtggagtacatggagagaggcaccatgaccggcctggccctgagacacatggtggagcacagcttcagcgaggcccagggcgccagacccagagccctgaacgtgcccagagtgggcctggtgttcaccgacggcagaagccaggacgacatcagcgtgtgggccgccagagccaaggaggagggcatcgtgatgtacgccgtgggcgtgggcaaggccgtggaggccgagctgagagagatcgccagcgagcccgccgagctgcacgtgagctacgcccccgacttcggcaccatgacccacctgctggagaacctgagaggcagcatctgccccgaggagggcatcagcgccggcaccgagctgagaagcccctgcgagtgcgagagcctggtggagttccagggcagaaccctgggcgccctggagagcctgaccctgaacctggcccagctgaccgccagactggaggacctggagaaccagctggccaaccagaagtag

SEQ ID NO: 88110 - DNA, 1299 bp, Artificial Sequence; identical to SEQ ID NO: 88109
  Description of Artificial Sequence: Synthetic coding sequence

SEQ ID NO: 88111 - DNA, 1869 bp, Artificial Sequence; identical to SEQ ID NO: 88105
  Description of Artificial Sequence: Synthetic coding sequence

SEQ ID NO: 88112 - DNA, 1746 bp, Artificial Sequence; identical to SEQ ID NO: 88106
  Description of Artificial Sequence: Synthetic coding sequence

SEQ ID NO: 88113 - DNA, 852 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgctgctggagagcgaggacgagctgctggtggacgaggaggaggccgccgccctgctggagagcggcagcagcgtgggcgacgagaccgacctggccaacctgggcgacgtggccagcgacggcaagaaggagcccagcgacaaggccgtgaagaaggacggcagcgccagcgccgccgccaagaagaagctgaagaagagaagattccccggcagcatggagggcttcgtgaccctggacgaggtgggcgacgaggaggacagcgagctgcagaagctgagaaagagcggcatggccttcaagagcggcgacaagaacgacgacggcctggtggagatcaaggtggacaagatcgaggagctggaccaggagaacgaggccgccctggagaacggcatcaagaacgaggagaacaccgagcccggcgccgagagcagcgagaacgccgacgaccccaacaaggacaccagcgagaacgccgacggccagagcgacgagaacaaggacgactacaccatccccgacgagtacagaatcggcccctaccagcccaacgtgcccgtgggcatcgactacgtgatccccaagaccggcttctactgcaagctgtgcagcctgttctacaccaacgaggaggtggccaagaacacccactgcagcagcctgccccactaccagaagctgaagaagttcctgaacaagctggccgaggagagaagacagaagaaggagacctag

SEQ ID NO: 88114 - DNA, 2544 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttcaacatcggcagcagaggccccctgcccctgagcagccagcacagaggcgacgccgaccaggccagcaacatcctggccagcttcggcctgagcgccagagacctggacgagctgagcagataccccgaggacaagatcacccccgagaacctgccccagatcctgctgcagctgaagagaagaagaaccgaggagggccccaccctgagctacggcagagacggcagaagcgccaccagagagcccccctacagagtgcccagagacgactgggaggagaagagacacttcagaagagacagcttcgacgacagaggccccagcctgaaccccgtgctggactacgaccacggcagcagaagccaggagagcggctactacgacagaatggactacgaggacgacagactgagagacggcgagagatgcagagacgacagcttcttcggcgagaccagccacaactaccacaagttcgacagcgagtacgagagaatgggcagaggccccggccccctgcaggagagaagcctgttcgagaagaagagaggcgccccccccagcagcaacatcgaggacttccacggcctgctgcccaagggctacccccacctgtgcagcatctgcgacctgcccgtgcacagcaacaaggagtggagccagcacatcaacggcgccagccacagcagaagatgccagctgctgctggagatctaccccgagtggaaccccgacaacgacaccggccacaccatgggcgaccccttcatgctgcagcagagcaccaaccccgcccccggcatcctgggcccccccccccccagcttccacctgggcggccccgccgtgggccccagaggcaacctgggcgccggcaacggcaacctgcagggccccagacacatgcagaagggcagagtggagaccagcagagtggtgcacatcatggacttccagagaggcaagaacctgagataccagctgctgcagctggtggagcccttcggcgtgatcagcaaccacctgatcctgaacaagatcaacgaggccttcatcgagatggccaccaccgaggacgcccaggccgccgtggactactacaccaccacccccgccctggtgttcggcaagcccgtgagagtgcacctgagccagaagtacaagagaatcaagaagcccgagggcaagcccgaccagaagttcgaccagaagcaggagctgggcagagtgatccacctgagcaacctgccccacagcggctacagcgacagcgccgtgctgaagctggccgagccctacggcaagatcaagaactacatcctgatgagaatgaagagccaggccttcatcgagatggagaccagagaggacgccatggccatggtggaccactgcctgaagaaggccctgtggttccagggcagatgcgtgaaggtggacctgagcgagaagtacaagaagctggtgctgagaatccccaacagaggcatcgacctgctgaagaaggacaagagcagaaagagaagctacagccccgacggcaaggagagccccagcgacaagaagagcaagaccgacggcagccagaagaccgagagcagcaccgagggcaaggagcaggaggagaagagcggcgaggacggcgagaaggacaccaaggacgaccagaccgagcaggagcccaacatgctgctggagagcgaggacgagctgctggtggacgaggaggaggccgccgccctgctggagagcggcagcagcgtgggcgacgagaccgacctggccaacctgggcgacgtggccagcgacggcaagaaggagcccagcgacaaggccgtgaagaaggacggcagcgccagcgccgccgccaagaagaagctgaagaaggtggacaagatcgaggagctggaccaggagaacgaggccgccctggagaacggcatcaagaacgaggagaacaccgagcccggcgccgagagcagcgagaacgccgacgaccccaacaaggacaccagcgagaacgccgacggccagagcgacgagaacaaggacgactacaccatccccgacgagtacagaatcggcccctaccagcccaacgtgcccgtgggcatcgactacgtgatccccaagaccggcttctactgcaagctgtgcagcctgttctacaccaacgaggaggtggccaagaacacccactgcagcagcctgccccactaccagaagctgaagaagttcctgaacaagctggccgaggagagaagacagaagaaggagacctag

SEQ ID NO: 88115 - DNA, 2544 bp, Artificial Sequence; identical to SEQ ID NO: 88114
  Description of Artificial Sequence: Synthetic coding sequence

SEQ ID NO: 88116 - DNA, 300 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttcaacatcggcagcagaggccccctgcccctgagcagctag

SEQ ID NO: 88117 - DNA, 1530 bp, Artificial Sequence
  Description of Artificial Sequence: Synthetic coding sequence
atgggcgaccccttcatgctgcagcagagcaccaaccccgcccccggcatcctgggcccccccccccccagcttccacctgggcggccccgccgtgggccccagaggcaacctgggcgccggcaacggcaacctgcagggccccagacacatgcagaagggcagagtggagaccagcagagtggtgcacatcatggacttccagagaggcaagaacctgagataccagctgctgcagctggtggagcccttcggcgtgatcagcaaccacctgatcctgaacaagatcaacgaggccttcatcgagatggccaccaccgaggacgcccaggccgccgtggactactacaccaccacccccgccctggtgttcggcaagcccgtgagagtgcacctgagccagaagtacaagagaatcaagaagcccgagggcaagcccgaccagaagttcgaccagaagcaggagctgggcagagtgatccacctgagcaacctgccccacagcggctacagcgacagcgccgtgctgaagctggccgagccctacggcaagatcaagaactacatcctgatgagaatgaagagccaggccttcatcgagatggagaccagagaggacgccatggccatggtggaccactgcctgaagaaggccctgtggttccagggcagatgcgtgaaggtggacctgagcgagaagtacaagaagctggtgctgagaatccccaacagaggcatcgacctgctgaagaaggacaagagcagaaagagaagctacagccccgacggcaaggagagccccagcgacaagaagagcaagaccgacggcagccagaagaccgagagcagcaccgagggcaaggagcaggaggagaagagcggcgaggacggcgagaaggacaccaaggacgaccagaccgagcaggagcccaacatgctgctggagagcgaggacgagctgctggtggacgaggaggaggccgccgccctgctggagagcggcagcagcgtgggcgacgagaccgacctggccaacctgggcgacgtggccagcgacggcaagaaggagcccagcgacaaggccgtgaagaaggacggcagcgccagcgccgccgccaagaagaagctgaagaaggtggacaagatcgaggagctggaccaggagaacgaggccgccctggagaacggcatcaagaacgaggagaacaccgagcccggcgccgagagcagcgagaacgccgacgaccccaacaaggacaccagcgagaacgccgacggccagagcgacgagaacaaggacgactacaccatccccgacgagtacagaatcggcccctaccagcccaacgtgcccgtgggcatcgactacgtgatccccaagaccggcttctactgcaagctgtgcagcctgttctacaccaacgaggaggtggccaagaacacccactgcagcagcctgccccactaccagaagctgaagaagttcctgaacaagctggccgaggagagaagacagaagaaggagacctag

SEQ ID NO: 88118 - DNA, 264 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttctag

SEQ ID NO: 88119 - DNA, 1680 bp, Artificial Sequence
  Description of Artificial Sequence: Synthetic coding sequence
atgctgggcgcccagtggagaagaaaccagcccagcagagccgccgaggagtggagccagcacatcaacggcgccagccacagcagaagatgccagctgctgctggagatctaccccgagtggaaccccgacaacgacaccggccacaccatgggcgaccccttcatgctgcagcagagcaccaaccccgcccccggcatcctgggcccccccccccccagcttccacctgggcggccccgccgtgggccccagaggcaacctgggcgccggcaacggcaacctgcagggccccagacacatgcagaagggcagagtggagaccagcagagtggtgcacatcatggacttccagagaggcaagaacctgagataccagctgctgcagctggtggagcccttcggcgtgatcagcaaccacctgatcctgaacaagatcaacgaggccttcatcgagatggccaccaccgaggacgcccaggccgccgtggactactacaccaccacccccgccctggtgttcggcaagcccgtgagagtgcacctgagccagaagtacaagagaatcaagaagcccgagggcaagcccgaccagaagttcgaccagaagcaggagctgggcagagtgatccacctgagcaacctgccccacagcggctacagcgacagcgccgtgctgaagctggccgagccctacggcaagatcaagaactacatcctgatgagaatgaagagccaggccttcatcgagatggagaccagagaggacgccatggccatggtggaccactgcctgaagaaggccctgtggttccagggcagatgcgtgaaggtggacctgagcgagaagtacaagaagctggtgctgagaatccccaacagaggcatcgacctgctgaagaaggacaagagcagaaagagaagctacagccccgacggcaaggagagccccagcgacaagaagagcaagaccgacggcagccagaagaccgagagcagcaccgagggcaaggagcaggaggagaagagcggcgaggacggcgagaaggacaccaaggacgaccagaccgagcaggagcccaacatgctgctggagagcgaggacgagctgctggtggacgaggaggaggccgccgccctgctggagagcggcagcagcgtgggcgacgagaccgacctggccaacctgggcgacgtggccagcgacggcaagaaggagcccagcgacaaggccgtgaagaaggacggcagcgccagcgccgccgccaagaagaagctgaagaaggtggacaagatcgaggagctggaccaggagaacgaggccgccctggagaacggcatcaagaacgaggagaacaccgagcccggcgccgagagcagcgagaacgccgacgaccccaacaaggacaccagcgagaacgccgacggccagagcgacgagaacaaggacgactacaccatccccgacgagtacagaatcggcccctaccagcccaacgtgcccgtgggcatcgactacgtgatccccaagaccggcttctactgcaagctgtgcagcctgttctacaccaacgaggaggtggccaagaacacccactgcagcagcctgccccactaccagaagctgaagaagttcctgaacaagctggccgaggagagaagacagaagaaggagacctag

SEQ ID NO: 88120 - DNA, 237 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcacctag

SEQ ID NO: 88121 - DNA, 1302 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttcaacatcggcagcagaggccccctgcccctgagcagccagcacagaggcgacgccgaccaggccagcaacatcctggccagcttcggcctgagcgccagagacctggacgagctgagcagataccccgaggacaagatcacccccgagaacctgccccagatcctgctgcagctgaagagaagaagaaccgaggagggccccaccctgagctacggcagagacggcagaagcgccaccagagagcccccctacagagtgcccagagacgactgggaggagaagagacacttcagaagagacagcttcgacgacagaggccccagcctgaaccccgtgctggactacgaccacggcagcagaagccaggagagcggctactacgacagaatggactacgaggacgacagactgagagacggcgagagatgcagagacgacagcttcttcggcgagaccagccacaactaccacaagttcgacagcgagtacgagagaatgggcagaggccccggccccctgcaggagagaagcctgttcgagaagaagagaggcgccccccccagcagcaacatcgaggacttccacggcctgctgcccaagggctacccccacctgtgcagcatctgcgacctgcccgtgcacagcaacaaggagtggagccagcacatcaacggcgccagccacagcagaagatgccagctgctgctggagatctaccccgagtggaaccccgacaacgacaccggccacaccatgggcgaccccttcatgctgcagcagagcaccaaccccgcccccggcatcctgggcccccccccccccagcttccacctgggcggccccgccgtgggccccagaggcaacctgggcgccggcaacggcaacctgcagggccccagacacatgcagaagggcagagtggagaccagcagagtggtgcacatcatggacttccagagaggcaagaacctgagataccagctgctgcagctggtggagcccttcggcgtgatcagcaaccacctgatcctgaacaagtag

SEQ ID NO: 88122 - DNA, 1530 bp, Artificial Sequence; identical to SEQ ID NO: 88117
  Description of Artificial Sequence: Synthetic coding sequence

SEQ ID NO: 88123 - DNA, 144 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagtag

SEQ ID NO: 88124 - DNA, 237 bp, Artificial Sequence; identical to SEQ ID NO: 88120
  Description of Artificial Sequence: Synthetic coding sequence

SEQ ID NO: 88125 - DNA, 2544 bp, Artificial Sequence; identical to SEQ ID NO: 88114
  Description of Artificial Sequence: Synthetic coding sequence

SEQ ID NO: 88126 - DNA, 30 bp, Artificial Sequence
  Description of Artificial Sequence: Synthetic coding sequence
atgagcaagagcttccagcagagcagctag

SEQ ID NO: 88127 - DNA, 303 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttcaacatcggcagcagaggccccctgcccctgagcagccagtag

SEQ ID NO: 88128 - DNA, 324 bp, Artificial Sequence
  Description of Artificial Sequence: Synthetic coding sequence
atgagcaagagcttccagcagagcagcctgagcagagacagccagggccacggcagagacctgagcgccgccggcatcggcctgctggccgccgccacccagagcctgagcatgcccgccagcctgggcagaatgaaccagggcaccgccagactggccagcctgatgaacctgggcatgagcagcagcctgaaccagcagggcgcccacagcgccctgagcagcgccagcaccagcagccacaacctgcagagcatcttcaacatcggcagcagaggccccctgcccctgagcagccagcacagaggcgacgccgaccagtag

SEQ ID NO: 88129 - DNA, 1578 bp, Artificial Sequence
  Description of Artificial Sequence: Synthetic coding sequence
atgagagtgttctgcgtgggcctgctgctgttcagcgtgacctgggccgcccccaccttccagccccagaccgagaagaccaagcagagctgcgtggaggagcagagacaggaggagaagaacaaggacaacatcggcttccaccacctgggcaagagaatcaaccaggagctgagcagcaaggagaacatcgtgcaggagagaaagaaggacctgagcctgagcgaggccagcgagaacaagggcagcagcaagagccagaactacttcaccaacagacagagactgaacaaggagtacagcatcagcaacaaggagaacacccacaacggcctgagaatgagcatctaccccaagagcaccggcaacaagggcttcgaggacggcgacgacgccatcagcaagctgcacgaccaggaggagtacggcgccgccctgatcagaaacaacatgcagcacatcatgggccccgtgaccgccatcaagctgctgggcgaggagaacaaggagaacacccccagaaacgtgctgaacatcatccccgccagcatgaactacgccaaggcccacagcaaggacaagaagaagccccagagagacagccaggcccagaagagccccgtgaagagcaagagcacccacagaatccagcacaacatcgactacctgaagcacctgagcaaggtgaagaagatccccagcgacttcgagggcagcggctacaccgacctgcaggagagaggcgacaacgacatcagccccttcagcggcgacggccagcccttcaaggacatccccggcaagggcgaggccaccggccccgacctggagggcaaggacatccagaccggcttcgccggccccagcgaggccgagagcacccacctggacaccaagaagcccggctacaacgagatccccgagagagaggagaacggcggcaacaccatcggcaccagagacgagaccgccaaggaggccgacgccgtggacgtgagcctggtggagggcagcaacgacatcatgggcagcaccaacttcaaggagctgcccggcagagagggcaacagagtggacgccggcagccagaacgcccaccagggcaaggtggagttccactacccccccgcccccagcaaggagaagagaaaggagggcagcagcgacgccgccgagagcaccaactacaacgagatccccaagaacggcaagggcagcaccagaaagggcgtggaccacagcaacagaaaccaggccaccctgaacgagaagcagagattccccagcaagggcaagagccagggcctgcccatccccagcagaggcctggacaacgagatcaagaacgagatggacagcttcaacggccccagccacgagaacatcatcacccacggcagaaagtaccactacgtgccccacagacagaacaacagcaccagaaacaagggcatgccccagggcaagggcagctggggcagacagccccacagcaacagaagattcagcagcagaagaagagacgacagcagcgagagcagcgacagcggcagcagcagcgagagcgacggcgactag

SEQ ID NO: 88130 - DNA, 1578 bp, Artificial Sequence; identical to SEQ ID NO: 88129
  Description of Artificial Sequence: Synthetic coding sequence

SEQ ID NO: 88131 - DNA, 828 bp, Artificial Sequence
  Description of Artificial Sequence: Synthetic coding sequence
atgagagtgttctgcgtgggcctgctgctgttcagcgtgacctgggccgcccccaccttccagccccagaccgagaagaccaagcagagctgcgtggaggagcagagacaggaggagaagaacaaggacaacatcggcttccaccacctgggcaagagaatcaaccaggagctgagcagcaaggagaacatcgtgcaggagagaaagaaggacctgagcctgagcgaggccagcgagaacaagggcagcagcaagagccagaactacttcaccaacagacagagactgaacaaggagtacagcatcagcaacaaggagaacacccacaacggcctgagaatgagcatctaccccaagagcaccggcaacaagggcttcgaggacggcgacgacgccatcagcaagctgcacgaccaggaggagtacggcgccgccctgatcagaaacaacatgcagcacatcatgggccccgtgaccgccatcaagctgctgggcgaggagaacaaggagaacacccccagaaacgtgctgaacatcatccccgccagcatgaactacgccaaggcccacagcaaggacaagaagaagccccagagagacagccaggcccagaagagccccgtgaagagcaagagcacccacagaatccagcacaacatcgactacctgaagcacctgagcaaggtgaagaagatccccagcgacttcgagggcagcggctacaccgacctgcaggagagaggcgacaacgacatcagccccttcagcggcaccgccaacctgctgagaaccttcctggtgaaggagaagctgctggtgctgacctag

SEQ ID NO: 88132 - DNA, 1239 bp, Artificial Sequence
  Description of Artificial Sequence: Synthetic coding sequence
atgagcatctaccccaagagcaccggcaacaagggcttcgaggacggcgacgacgccatcagcaagctgcacgaccaggaggagtacggcgccgccctgatcagaaacaacatgcagcacatcatgggccccgtgaccgccatcaagctgctgggcgaggagaacaaggagaacacccccagaaacgtgctgaacatcatccccgccagcatgaactacgccaaggcccacagcaaggacaagaagaagccccagagagacagccaggcccagaagagccccgtgaagagcaagagcacccacagaatccagcacaacatcgactacctgaagcacctgagcaaggtgaagaagatccccagcgacttcgagggcagcggctacaccgacctgcaggagagaggcgacaacgacatcagccccttcagcggcgacggccagcccttcaaggacatccccggcaagggcgaggccaccggccccgacctggagggcaaggacatccagaccggcttcgccggccccagcgaggccgagagcacccacctggacaccaagaagcccggctacaacgagatccccgagagagaggagaacggcggcaacaccatcggcaccagagacgagaccgccaaggaggccgacgccgtggacgtgagcctggtggagggcagcaacgacatcatgggcagcaccaacttcaaggagctgcccggcagagagggcaacagagtggacgccggcagccagaacgcccaccagggcaaggtggagttccactacccccccgcccccagcaaggagaagagaaaggagggcagcagcgacgccgccgagagcaccaactacaacgagatccccaagaacggcaagggcagcaccagaaagggcgtggaccacagcaacagaaaccaggccaccctgaacgagaagcagagattccccagcaagggcaagagccagggcctgcccatccccagcagaggcctggacaacgagatcaagaacgagatggacagcttcaacggccccagccacgagaacatcatcacccacggcagaaagtaccactacgtgccccacagacagaacaacagcaccagaaacaagggcatgccccagggcaagggcagctggggcagacagccccacagcaacagaagattcagcagcagaagaagagacgacagcagcgagagcagcgacagcggcagcagcagcgagagcgacggcgactag

SEQ ID NO: 88133 - DNA, 1239 bp, Artificial Sequence; identical to SEQ ID NO: 88132
  Description of Artificial Sequence: Synthetic coding sequence

SEQ ID NO: 88134 - DNA, 312 bp, Artificial Sequence
  Description of Artificial Sequence: Synthetic coding sequence
atgaagagcctgatcctgctggccatcctggccgccctggccgtggtgaccctgtgctacgagagccacgagagcatggagagctacgagctgaaccccttcatcaacagaagaaacgccaacaccttcatcagcccccagcagagatggagagccaaggtgcaggagagaatcagagagagaagcaagcccgtgcacgagctgaacagagaggcctgcgacgactacagactgtgcgagagatacgccatggtgtacggctacaacgccgcctacaacagatacttcagaaagagaagaggcaccaagtag

SEQ ID NO: 88135 - DNA, 945 bp, Artificial Sequence
  Description of Artificial Sequence: Synthetic coding sequence
atgggccccctgatcaacagatgcaagaagatcctgctgcccaccaccgtgccccccgccaccatgagaatctggctgctgggcggcctgctgcccttcctgctgctgctgagcggcctgcagagacccaccgagggcagcgaggtggccatcaagatcgacttcgacttcgcccccggcagcttcgacgaccagtaccagggctgcagcaagcaggtgatggagaagctgacccagggcgactacttcaccaaggacatcgaggcccagaagaactacttcagaatgtggcagaaggcccacctggcctggctgaaccagggcaaggtgctgccccagaacatgaccaccacccacgccgtggccatcctgttctacaccctgaacagcaacgtgcacagcgacttcaccagagccatggccagcgtggccagaaccccccagcagtacgagagaagcttccacttcaagtacctgcactactacctgaccagcgccatccagctgctgagaaaggacagcatcatggagaacggcaccctgtgctacgaggtgcactacagaaccaaggacgtgcacttcaacgcctacaccggcgccaccatcagattcggccagttcctgagcaccagcctgctgaaggaggaggcccaggagttcggcaaccagaccctgttcaccatcttcacctgcctgggcgcccccgtgcagtacttcagcctgaagaaggaggtgctgatccccccctacgagctgttcaaggtgatcaacatgagctaccaccccagaggcgactggctgcagctgagaagcaccggcaacctgagcacctacaactgccagctgctgaaggccagcagcaagaagtgcatccccgaccccatcgccatcgccagcctgagcttcctgaccagcgtgatcatcttcagcaagagcagagtgtag

SEQ ID NO: 88136 - DNA, 1749 bp, Artificial Sequence
  Description of Artificial Sequence: Synthetic coding sequence
atgagcatcgagaccctgctggaggccgccagattcctggagtggcaggcccagcagcagcagagagccagagaggagcaggagagactgagactggagcaggagagagagcaggagcagaagaaggccaacagcctggccagactggcccacaccctgcccgtggaggagcccagaatggaggccccccccctgcccctgagcccccccgcccccccccccgccccccccccccccctggccacccccgcccccctgaccgtgatccccatccccgtggtgaccaacagcccccagcccctgcccccccccccccccctgcccgccgccgcccagcccctgcccctggcccccagacagcccgccctggtgggcgcccccggcctgagcatcaaggagcccgcccccctgcccagcagaccccaggtgcccacccccgcccccctgctgcccgacagcaaggccaccatcccccccaacggcagccccaagcccctgcagcccctgcccacccccgtgctgaccatcgccccccaccccggcgtgcagccccagctggccccccagcagccccccccccccaccctgggcaccctgaagctggcccccgccgaggaggtgaagagcagcgagcagaagaagagacccggcggcatcggcaccagagaggtgcacaacaagctggagaagaacagaagagcccacctgaaggagtgcttcgagaccctgaagagaaacatccccaacgtggacgacaagaagaccagcaacctgagcgtgctgagaaccgccctgagatacatccagagcctgaagagaaaggagaaggagtacgagcacgagatggagagactggccagagagaagatcgccacccagcagagactggccgagctgaagcacgagctgagccagtggatggacgtgctggagatcgacagagtgctgagacagaccggccagcccgaggacgaccaggccagcaccagcaccgccagcgagggcgaggacaacatcgacgaggacatggaggaggacagagccggcctgggcccccccaagctgagccacagaccccagcccgagctgctgaagagcaccctgcccccccccagcaccacccccgcccccctgcccccccacccccacccccacccccacagcgtggccctgccccccgcccacctgcccgtgcagcagcagcagccccagcagaagacccccctgcccgcccccccccccccccccgccgcccccgcccagaccctggtgcccgcccccgcccacctggtggccaccgccggcggcggcagcaccgtgatcgcccacaccgccaccacccacgccagcgtgatccagaccgtgaaccacgtgctgcagggccccggcggcaagcacatcgcccacatcgcccccagcgcccccagccccgccgtgcagctggcccccgccaccccccccatcggccacatcaccgtgcaccccgccaccctgaaccacgtggcccacctgggcagccagctgcccctgtacccccagcccgtggccgtgagccacatcgcccacaccctgagccaccagcaggtgaacggcaccgccggcctgggcccccccgccaccgtgatggccaagcccgccgtgggcgcccaggtggtgcaccacccccagctggtgggccagaccgtgctgaaccccgtgaccatggtgaccatgcccagcttccccgtgagcaccctgaagctggcctag

SEQ ID NO: 88137 - DNA, 1749 bp, Artificial Sequence; identical to SEQ ID NO: 88136
  Description of Artificial Sequence: Synthetic coding sequence

SEQ ID NO: 88138 - DNA, 594 bp, Artificial Sequence
  Description of Artificial Sequence: Synthetic coding sequence
atggagcccctggccagcaacatccaggtgctgctgcaggccgccgagttcctggagagaagagagagagaggccgagcacggctacgccagcctgtgcccccacagaagccccggccccatccacagaagaaagaagagacccccccaggcccccggcgcccaggacagcggcagatggagagcccagctgaagagatgcctggagagactgaagcagcagatgcccctgggcgccgactgcgccagatacaccaccctgagcctgctgagaagagccagaatgcacatccagaagctggaggaccaggagcagagagccagacagctgaaggagagactgagaagcaagcagcagagcctgcagagacagctggagcagctgagaggcctggccggcgccgccgagagagagagactgagagccgacagcctggacagcagcggcctgagcagcgagagaagcgacagcgaccaggaggagctggaggtggacgtggagagcctggtgttcggcggcgaggccgagctgctgagaggcttcgtggccggccaggagcacagctacagccacggcggcggcgcctggctgtag

SEQ ID NO: 88139 - DNA, 1167 bp, Artificial Sequence
  Description of Artificial Sequence: Synthetic coding sequence
atggagcccctggccagcaacatccaggtgctgctgcaggccgccgagttcctggagagaagagagagagaggccgagcacggctacgccagcctgtgcccccacagaagccccggccccatccacagaagaaagaagagacccccccaggcccccggcgcccaggacagcggcagaagcgtgcacaacgagctggagaagagaagaagagcccagctgaagagatgcctggagagactgaagcagcagatgcccctgggcgccgactgcgccagatacaccaccctgagcctgctgagaagagccagaatgcacatccagaagctggaggaccaggagcagagagccagacagctgaaggagagactgagaagcaagcagcagagcctgcagagacagctggagcagctgagaggcctggccggcgccgccgagagagagagactgagagccgacagcctggacagcagcggcctgagcagcgagagaagcgacagcgaccagggcgagtgccccgaggccgagggcctgtgcggccccagaggcgagcccggcctgctgaccggccccctgcccgcccagagaagctggagatggatgtggagagcctggtgcctgggcgtgagacccagctgctgcggcgccagcagccccgccagaagcaccgccaccagaaccgccgccgcccccggctacgacgtgccccaccccggcagagccagcgccctgtacagctgccaggcccacctgcccggcagaagccccccccaggccttcagagccgccagaagccacctgctggagtggaccaagagaaccctggtgtgggagcaggtgctgcccaagcaccccgccgccggctgccaggccggccccctggagggcaagggccaggacagcagcggccccccctggacccccgccggccaggccgcctgggccagagcccaggccttcggcagcgccgcccccaagggcaccggcagcctgctgggcctgttccccagctggaccagaccccccgccttcgccagccacaagctgtacagcatcttcatcaagagcctgttccacaacttccccagcatcgtgctgcccaacgagaacggcggcacccccaaccacagacccaccggcagaggcaacaacatcagcagccaccactag

SEQ ID NO: 88140 - DNA, 582 bp, Artificial Sequence
  Description of Artificial Sequence: Synthetic coding sequence
atggagcccctggccagcaacatccaggtgctgctgcaggccgccgagttcctggagagaagagagagagaggccgagcacggctacgccagcctgtgcccccacagaagccccggccccatccacagaagaaagaagagacccccccaggcccccggcgcccaggacagcggcagaagcgtgcacaacgagctggagaagagaagaagagcccagctgaagagatgcctggagagactgaagcagcagatgcccctgggcgccgactgcgccagatacaccaccctgagcctgctgagaagagccagaatgcacatccagaagctggaggaccaggagcagagagccagacagctgaaggagagactgagaagcaagcagcagagcctgcagagacagctggagcagctgagaggcctggccggcgccgccgagagagagagactgagagccgacagcctggacagcagcggcctgagcagcgagagaagcgacagcgaccaggtgctgcccaacgagaacggcggcacccccaaccacagacccaccggcagaggcaacaacatcagcagccaccactag

SEQ ID NO: 88141 - DNA, 621 bp, Artificial Sequence
  Description of Artificial Sequence: Synthetic coding sequence
atggagcccctggccagcaacatccaggtgctgctgcaggccgccgagttcctggagagaagagagagagaggccgagcacggctacgccagcctgtgcccccacagaagccccggccccatccacagaagaaagaagagacccccccaggcccccggcgcccaggacagcggcagaagcgtgcacaacgagctggagaagagaagaagagcccagctgaagagatgcctggagagactgaagcagcagatgcccctgggcgccgactgcgccagatacaccaccctgagcctgctgagaagagccagaatgcacatccagaagctggaggaccaggagcagagagccagacagctgaaggagagactgagaagcaagcagcagagcctgcagagacagctggagcagctgagaggcctggccggcgccgccgagagagagagactgagagccgacagcctggacagcagcggcctgagcagcgagagaagcgacagcgaccaggaggagctggaggtggacgtggagagcctggtgttcggcggcgaggccgagctgctgagaggcttcgtggccggccaggagcacagctacagccacggcggcggcgcctggctgtag

SEQ ID NO: 88142 - DNA, 621 bp, Artificial Sequence; identical to SEQ ID NO: 88141
  Description of Artificial Sequence: Synthetic coding sequence

SEQ ID NO: 88143 - DNA, 768 bp, Artificial Sequence
  Description of Artificial Sequence: Synthetic coding sequence
atgatccaggccatccaggtgctgagattccacctgctggagctggagaaggtgcacgagctgtgcgacaacttctgccacagatacatcagctgcctgaagggcaagatgcccatcgacctggtgatcgacgagagagacggcagcagcaagagcgaccacgaggagctgagcggcagcagcaccaacctggccgaccacaaccccagcagctggagagaccacgacgacgccaccagcacccacagcgccggcacccccggccccagcagcggcggccacgccagccagagcggcgacaacagcagcgagcagggcgacggcctggacaacagcgtggccagccccggcaccggcgacgacgacgaccccgacaaggacaagaagagacagaagaagagaggcatcttccccaaggtggccaccaacatcatgagagcctggctgttccagcacctgacccacccctaccccagcgaggagcagaagaagcagctggcccaggacaccggcctgaccatcctgcaggtgaacaactggttcatcaacgccagaagaagaatcgtgcagcccatgatcgaccagagcaacagagccggcttcctgctggaccccagcgtgagccagggcgccgcctacagccccgagggccagcccatgggcagcttcgtgctggacggccagcagcacatgggcatcagacccgccggccccatgagcggcatgggcatgaacatgggcatggacggccagtggcactacatgtag

SEQ ID NO: 88144 - DNA, 9081 bp, Artificial Sequence
  Description of Artificial Sequence: Synthetic coding sequence
atggaggagaagcagcagatcatcctggccaaccaggacggcggcaccgtggccggcgccgcccccaccttcttcgtgatcctgaagcagcccggcaacggcaagaccgaccagggcatcctggtgaccaaccaggacgcctgcgccctggccagcagcgtgagcagccccgtgaagagcaagggcaagatctgcctgcccgccgactgcaccgtgggcggcatcaccgtgaccctggacaacaacagcatgtggaacgagttctaccacagaagcaccgagatgatcctgaccaagcagggcagaagaatgttcccctactgcagatactggatcaccggcctggacagcaacctgaagtacatcctggtgatggacatcagccccgtggacaaccacagatacaagtggaacggcagatggtgggagcccagcggcaaggccgagccccacgtgctgggcagagtgttcatccaccccgagagccccagcaccggccactactggatgcaccagcccgtgagcttctacaagctgaagctgaccaacaacaccctggaccaggagggccacatcatcctgcacagcatgcacagatacctgcccagactgcacctggtgcccgccgagaaggccgtggaggtgatccagctgaacggccccggcgtgcacaccttcaccttcccccagaccgagttcttcgccgtgaccgcctaccagaacatccagatcacccagctgaagatcgactacaaccccttcgccaagggcttcagagacgacggcctgaacaacaagccccagagagacggcaagcagaagaacagcagcgaccaggagggcaacaacatcagcagcagcagcggccacagagtgagactgaccgagggccagggcagcgagatccagcccggcgacctggaccccctgagcagaggccacgagaccagcggcaagggcctggagaagaccagcctgaacatcaagagagacttcctgggcttcatggacaccgacagcgccctgagcgaggtgccccagctgaagcaggagatcagcgagtgcctgatcgccagcagcttcgaggacgacagcagagtggccagccccctggaccagaacggcagcttcaacgtggtgatcaaggaggagcccctggacgactacgactacgagctgggcgagtgccccgagggcgtgaccgtgaagcaggaggagaccgacgaggagaccgacgtgtacagcaacagcgacgacgaccccatcctggagaagcagctgaagagacacaacaaggtggacaaccccgaggccgaccacctgagcagcaagtggctgcccagcagccccagcggcgtggccaaggccaagatgttcaagctggacaccggcaagatgcccgtggtgtacctggagccctgcgccgtgaccagaagcaccgtgaagatcagcgagctgcccgacaacatgctgagcaccagcagaaaggacaagagcagcatgctggccgagctggagtacctgcccacctacatcgagaacagcaacgagaccgccttctgcctgggcaaggagagcgagaacggcctgagaaagcacagccccgacctgagagtggtgcagaagtaccccctgctgaaggagccccagtggaagtaccccgacatcagcgacagcatcagcaccgagagaatcctggacgacagcaaggacagcgtgggcgacagcctgagcggcaaggaggacctgggcagaaagagaaccaccatgctgaagatcgccaccgccgccaaggtggtgaacgccaaccagaacgccagccccaacgtgcccggcaagagaggcagacccagaaagctgaagctgtgcaaggccggcagaccccccaagaacaccggcaagagcctgatcagcaccaagaacacccccgtgagccccggcagcaccttccccgacgtgaagcccgacctggaggacgtggacggcgtgctgttcgtgagcttcgagagcaaggaggccctggacatccacgccgtggacggcaccaccgaggagagcagcagcctgcaggccagcaccaccaacgacagcggctacagagccagaatcagccagctggagaaggagctgatcgaggacctgaagaccctgagacacaagcaggtgatccaccccggcctgcaggaggtgggcctgaagctgaacagcgtggaccccaccatgagcatcgacctgaagtacctgggcgtgcagctgcccctggcccccgccaccagcttccccttctggaacctgaccggcaccaaccccgccagccccgacgccggcttccccttcgtgagcagaaccggcaagaccaacgacttcaccaagatcaagggctggagaggcaagttccacagcgccagcgccagcagaaacgagggcggcaacagcgagagcagcctgaagaacagaagcgccttctgcagcgacaagctggacgagtacctggagaacgagggcaagctgatggagaccagcatgggcttcagcagcaacgcccccaccagccccgtggtgtaccagctgcccaccaagagcaccagctacgtgagaaccctggacagcgtgctgaagaagcagagcaccatcagccccagcaccagctacagcctgaagccccacagcgtgccccccgtgagcagaaaggccaagagccagaacagacaggccaccttcagcggcagaaccaagagcagctacaagagcatcctgccctaccccgtgagccccaagcagaagtacagccacgtgatcctgggcgacaaggtgaccaagaacagcagcggcatcatcagcgagaaccaggccaacaacttcgtggtgcccaccctggacgagaacatcttccccaagcagatcagcctgagacaggcccagcagcagcagcagcagcagcagggcagcagaccccccggcctgagcaagagccaggtgaagctgatggacctggaggactgcgccctgtgggagggcaagcccagaacctacatcaccgaggagagagccgacgtgagcctgaccaccctgctgaccgcccaggccagcctgaagaccaagcccatccacaccatcatcagaaagagagcccccccctgcaacaacgacttctgcagactgggctgcgtgtgcagcagcctggccctggagaagagacagcccgcccactgcagaagacccgactgcatgttcggctgcacctgcctgaagagaaaggtggtgctggtgaagggcggcagcaagaccaagcacttccagagaaaggccgcccacagagaccccgtgttctacgacaccctgggcgaggaggccagagaggaggaggagggcatcagagaggaggaggagcagctgaaggagaagaagaagagaaagaagctggagtacaccatctgcgagaccgagcccgagcagcccgtgagacactaccccctgtgggtgaaggtggagggcgaggtggaccccgagcccgtgtacatccccacccccagcgtgatcgagcccatgaagcccctgctgctgccccagcccgaggtgctgagccccaccgtgaagggcaagctgctgaccggcatcaagagccccagaagctacacccccaagcccaaccccgtgatcagagaggaggacaaggaccccgtgtacctgtacttcgagagcatgatgacctgcgccagagtgagagtgtacgagagaaagaaggaggaccagagacagcccagcagcagcagcagccccagccccagcttccagcagcagaccagctgccacagcagccccgagaaccacaacaacgccaaggagcccgacagcgagcagcagcccctgaagcagctgacctgcgacctggaggacgacagcgacaagctgcaggagaagagctggaagagcagctgcaacgagggcgagagcagcagcaccagctacatgcaccagagaagccccggcggccccaccaagctgatcgagatcatcagcgactgcaactgggaggaggacagaaacaagatcctgagcatcctgagccagcacatcaacagcaacatgccccagagcctgaaggtgggcagcttcatcatcgagctggccagccagagaaagagcagaggcgagaagaacccccccgtgtacagcagcagagtgaagatcagcatgcccagctgccaggaccaggacgacatggccgagaagagcggcagcgagacccccgacggccccctgagccccggcaagatggaggacatcagccccgtgcagaccgacgccctggacagcgtgagagagagactgcacggcggcaagggcctgcccttctacgccggcctgagccccgccggcaagctggtggcctacaagagaaagcccagcagcagcaccagcggcctgatccaggtggccagcaacgccaaggtggccgccagcagaaagcccagaaccctgctgcccagcaccagcaacagcaagatggccagcagcagcggcaccgccaccaacagacccggcaagaacctgaaggccttcgtgcccgccaagagacccatcgccgccagacccagccccggcggcgtgttcacccagttcgtgatgagcaaggtgggcgccctgcagcagaagatccccggcgtgagcaccccccagaccctggccggcacccagaagttcagcatcagacccagccccgtgatggtggtgacccccgtggtgagcagcgagcccgtgcaggtgtgcagccccgtgaccgccgccgtgaccaccaccaccccccaggtgttcctggagaacaccaccgccgtgacccccatgaccgccatcagcgacgtggagaccaaggagaccacctacagcagcggcgccaccaccaccggcgtggtggaggtgagcgagaccaacaccagcaccagcgtgaccagcacccagagcaccgccaccgtgaacctgaccaagaccaccggcatcaccacccccgtggccagcgtggccttccccaagagcctggtggccagccccagcaccatcaccctgcccgtggccagcaccgccagcaccagcctggtggtggtgaccgccgccgccagcagcagcatggtgaccacccccaccagcagcctgggcagcgtgcccatcatcctgagcggcatcaacggcagcccccccgtgagccagagacccgagaacgccgcccagatccccgtggccaccccccaggtgagccccaacaccgtgaagagagccggccccagactgctgcaccccaacggccagatcgtgcagctgctgcccctgcaccagctgagaggcagcaacacccagcccaacctgcagcccgtgatgttcagaaaccccggcagcgtgatgggcatcagactgcccgcccccagcaagcccagcgagaccccccccagcagcaccagcagcagcgccttcagcgtgatgaaccccgtgatccaggccgtgggcagcagcagcgccgtgaacgtgatcacccaggcccccagcctgctgagcagcggcgccagcttcgtgagccaggccggcaccctgaccctgagaatcagcccccccgagccccagagcttcgccagcaagaccggcagcgagaccaagatcacctacagcagcggcggccagcccgtgggcaccgccagcctgatccccctgcagagcggcagcttcgccctgctgcagctgcccggccagaagcccgtgcccagcagcatcctgcagcacgtggccagcctgcagatgaagagagagagccagaaccccgaccagaaggacgagaccaacagcatcaagagagagcaggagaccaagaaggtgctgcagagcgagggcgaggccgtggaccccgaggccaacgtgatcaagcagaacagcggcgccgccaccagcgaggagaccctgaacgacagcctggaggacagaggcgaccacctggacgaggagtgcctgcccgaggagggctgcgccaccgtgaagcccagcgagcacagctgcatcaccggcagccacaccgaccaggactacaaggacgtgaacgaggagtacggcgccagaaacagaaagagcagcaaggagaaggtggccgtgctggaggtgagaaccatcagcgagaaggccagcaacaagaccgtgcagaacctgagcaaggtgcagcaccagaagctgggcgacgtgaaggtggagcagcagaagggcttcgacaaccccgaggagaacagcagcgagttccccgtgaccttcaaggaggagagcaagttcgagctgagcggcagcaaggtgatggagcagcagagcaacctgcagcccgaggccaaggagaaggagtgcggcgacagcctggagaaggacagagagagatggagaaagcacctgaagggccccctgaccagaaagtgcgtgggcgccagccaggagtgcaagaaggaggccgacgagcagctgatcaaggagaccaagacctgccaggagaacagcgacgtgttccagcaggagcagggcatcagcgacctgctgggcaagagcggcatcaccgaggacgccagagtgctgaagaccgagtgcgacagctggagcagaatcagcaaccccagcgccttcagcatcgtgcccagaagagccgccaagagcagcagaggcaacggccacttccagggccacctgctgctgcccggcgagcagatccagcccaagcaggagaagaagggcggcagaagcagcgccgacttcaccgtgctggacctggaggaggacgacgaggacgacaacgagaagaccgacgacagcatcgacgagatcgtggacgtggtgagcgactaccagagcgaggaggtggacgacgtggagaagaacaactgcgtggagtacatcgaggacgacgaggagcacgtggacatcgagaccgtggaggagctgagcgaggagatcaacgtggcccacctgaagaccaccgccgcccacacccagagcttcaagcagcccagctgcacccacatcagcgccgacgagaaggccgccgagagaagcagaaaggccccccccatccccctgaagctgaagcccgactactggagcgacaagctgcagaaggaggccgaggccttcgcctactacagaagaacccacaccgccaacgagagaagaagaagaggcgagatgagagacctgttcgagaagctgaagatcaccctgggcctgctgcacagcagcaaggtgagcaagagcctgatcctgaccagagccttcagcgagatccagggcctgaccgaccaggccgacaagctgatcggccagaagaacctgctgaccagaaagagaaacatcctgatcagaaaggtgagcagcctgagcggcaagaccgaggaggtggtgctgaagaagctggagtacatctacgccaagcagcaggccctggaggcccagaagagaaagaagaagatgggcagcgacgagttcgacatcagccccagaatcagcaagcagcaggagggcagcagcgccagcagcgtggacctgggccagatgttcatcaacaacagaagaggcaagcccctgatcctgagcagaaagaaggaccaggccaccgagaacaccagccccctgaacaccccccacaccagcgccaacctggtgatgaccccccagggccagctgctgaccctgaagggccccctgttcagcggccccgtggtggccgtgagccccgacctgctggagagcgacctgaagccccaggtggccggcagcgccgtggccctgcccgagaacgacgacctgttcatgatgcccagaatcgtgaacgtgaccagcctggccaccgagggcggcctggtggacatgggcggcagcaagtacccccacgaggtgcccgacagcaagcccagcgaccacctgaaggacaccgtgagaaacgaggacaacagcctggaggacaagggcagaatcagcagcagaggcaacagagacggcagagtgaccctgggccccacccaggtgttcctggccaacaaggacagcggctacccccagatcgtggacgtgagcaacatgcagaaggcccaggagttcctgcccaagaagatcagcggcgacatgagaggcatccagtacaagtggaaggagagcgagagcagaggcgagagagtgaagagcaaggacagcagcttccacaagctgaagatgaaggacctgaaggacagcagcatcgagatggagctgagaaaggtgaccagcgccatcgaggaggccgccctggacagcagcgagctgctgaccaacatggaggacgaggacgacaccgacgagaccctgaccagcctgctgaacgagatcgccttcctgaaccagcagctgaacgacgacagcgtgggcctggccgagctgcccagcagcatggacaccgagttccccggcgacgccagaagagccttcatcagcaaggtgccccccggcagcagagccaccttccaggtggagcacctgggcaccggcctgaaggagctgcccgacgtgcagggcgagagcgacagcatcagccccctgctgctgcacctggaggacgacgacttcagcgagaacgagaagcagctggccgagcccgccagcgagcccgacgtgctgaagatcgtgatcgacagcgagatcaaggacagcctgctgagcaacaagaaggccatcgacggcggcaagaacaccagcggcctgcccgccgagcccgagagcgtgagcagcccccccaccctgcacatgaagaccggcctggagaacagcaacagcaccgacaccctgtggagacccatgcccaagctggcccccctgggcctgaaggtggccaaccccagcagcgacgccgacggccagagcctgaaggtgatgccctgcctggcccccatcgccgccaaggtgggcagcgtgggccacaagatgaacctgaccggcaacgaccaggagggcagagagagcaaggtgatgcccaccctggcccccgtggtggccaagctgggcaacagcggcgccagccccagcagcgccggcaagtag

SEQ ID NO: 88145 - DNA, 8571 bp, Artificial Sequence
  Description of Artificial Sequence: Synthetic coding sequence
atggaggagaagcagcagatcatcctggccaaccaggacggcggcaccgtggccggcgccgcccccaccttcttcgtgatcctgaagcagcccggcaacggcaagaccgaccagggcatcctggtgaccaaccaggacgcctgcgccctggccagcagcgtgagcagccccgtgaagagcaagggcaagatctgcctgcccgccgactgcaccgtgggcggcatcaccgtgaccctggacaacaacagcatgtggaacgagttctaccacagaagcaccgagatgatcctgaccaagcagggcagaagaatgttcccctactgcagatactggatcaccggcctggacagcaacctgaagtacatcctggtgatggacatcagccccgtggacaaccacagatacaagtggaacggcagatggtgggagcccagcggcaaggccgagccccacgtgctgggcagagtgttcatccaccccgagagccccagcaccggccactactggatgcaccagcccgtgagcttctacaagctgaagctgaccaacaacaccctggaccaggagggccacatcatcctgcacagcatgcacagatacctgcccagactgcacctggtgcccgccgagaaggccgtggaggtgatccagctgaacggccccggcgtgcacaccttcaccttcccccagaccgagttcttcgccgtgaccgcctaccagaacatccagatcacccagctgaagatcgactacaaccccttcgccaagggcttcagagacgacggcctgaacaacaagccccagagagacggcaagcagaagaacagcagcgaccaggagggcaacaacatcagcagcagcagcggccacagagtgagactgaccgagggccagggcagcgagatccagcccggcgacctggaccccctgagcagaggccacgagaccagcggcaagggcctggagaagaccagcctgaacatcaagagagacttcctgggcttcatggacaccgacagcgccctgagcgaggtgccccagctgaagcaggagatcagcgagtgcctgatcgccagcagcttcgaggacgacagcagagtggccagccccctggaccagaacggcagcttcaacgtggtgatcaaggaggagcccctggacgactacgactacgagctgggcgagtgccccgagggcgtgaccgtgaagcaggaggagaccgacgaggagaccgacgtgtacagcaacagcgacgacgaccccatcctggagaagcagctgaagagacacaacaaggtggacaaccccgaggccgaccacctgagcagcaagtggctgcccagcagccccagcggcgtggccaaggccaagatgttcaagctggacaccggcaagatgcccgtggtgtacctggagccctgcgccgtgaccagaagcaccgtgaagatcagcgagctgcccgacaacatgctgagcaccagcagaaaggacaagagcagcatgctggccgagctggagtacctgcccacctacatcgagaacagcaacgagaccgccttctgcctgggcaaggagagcgagaacggcctgagaaagcacagccccgacctgagagtggtgcagaagtaccccctgctgaaggagccccagtggaagtaccccgacatcagcgacagcatcagcaccgagagaatcctggacgacagcaaggacagcgtgggcgacagcctgagcggcaaggaggacctgggcagaaagagaaccaccatgctgaagatcgccaccgccgccaaggtggtgaacgccaaccagaacgccagccccaacgtgcccggcaagagaggcagacccagaaagctgaagctgtgcaaggccggcagaccccccaagaacaccggcaagagcctgatcagcaccaagaacacccccgtgagccccggcagcaccttccccgacgtgaagcccgacctggaggacgtggacggcgtgctgttcgtgagcttcgagagcaaggaggccctggacatccacgccgtggacggcaccaccgaggagagcagcagcctgcaggccagcaccaccaacgacagcggctacagagccagaatcagccagctggagaaggagctgatcgaggacctgaagaccctgagacacaagcaggtgatccaccccggcctgcaggaggtgggcctgaagctgaacagcgtggaccccaccatgagcatcgacctgaagtacctgggcgtgcagctgcccctggcccccgccaccagcttccccttctggaacctgaccggcaccaaccccgccagccccgacgccggcttccccttcgtgagcagaaccggcaagaccaacgacttcaccaagatcaagggctggagaggcaagttccacagcgccagcgccagcagaaacgagggcggcaacagcgagagcagcctgaagaacagaagcgccttctgcagcgacaagctggacgagtacctggagaacgagggcaagctgatggagaccagcatgggcttcagcagcaacgcccccaccagccccgtggtgtaccagctgcccaccaagagcaccagctacgtgagaaccctggacagcgtgctgaagaagcagagcaccatcagccccagcaccagctacagcctgaagccccacagcgtgccccccgtgagcagaaaggccaagagccagaacagacaggccaccttcagcggcagaaccaagagcagctacaagagcatcctgccctaccccgtgagccccaagcagaagtacagccacgtgatcctgggcgacaaggtgaccaagaacagcagcggcatcatcagcgagaaccaggccaacaacttcgtggtgcccaccctggacgagaacatcttccccaagcagatcagcctgagacaggcccagcagcagcagcagcagcagcagggcagcagaccccccggcctgagcaagagccaggtgaagctgatggacctggaggactgcgccctgtgggagggcaagcccagaacctacatcaccgaggagagagccgacgtgagcctgaccaccctgctgaccgcccaggccagcctgaagaccaagcccatccacaccatcatcagaaagagagcccccccctgcaacaacgacttctgcagactgggctgcgtgtgcagcagcctggccctggagaagagacagcccgcccactgcagaagacccgactgcatgttcggctgcacctgcctgaagagaaaggtggtgctggtgaagggcggcagcaagaccaagcacttccagagaaaggccgcccacagagaccccgtgttctacgacaccctgggcgaggaggccagagaggaggaggagggcatcagagaggaggaggagcagctgaaggagaagaagaagagaaagaagctggagtacaccatctgcgagaccgagcccgagcagcccgtgagacactaccccctgtgggtgaaggtggagggcgaggtggaccccgagcccgtgtacatccccacccccagcgtgatcgagcccatgaagcccctgctgctgccccagcccgaggtgctgagccccaccgtgaagggcaagctgctgaccggcatcaagagccccagaagctacacccccaagcccaaccccgtgatcagagaggaggacaaggaccccgtgtacctgtacttcgagagcatgatgacctgcgccagagtgagagtgtacgagagaaagaaggaggaccagagacagcccagcagcagcagcagccccagccccagcttccagcagcagaccagctgccacagcagccccgagaaccacaacaacgccaaggagcccgacagcgagcagcagcccctgaagcagctgacctgcgacctggaggacgacagcgacaagctgcaggagaagagctggaagagcagctgcaacgagggcgagagcagcagcaccagctacatgcaccagagaagccccggcggccccaccaagctgatcgagatcatcagcgactgcaactgggaggaggacagaaacaagatcctgagcatcctgagccagcacatcaacagcaacatgccccagagcctgaaggtgggcagcttcatcatcgagctggccagccagagaaagagcagaggcgagaagaacccccccgtgtacagcagcagagtgaagatcagcatgcccagctgccaggaccaggacgacatggccgagaagagcggcagcgagacccccgacggccccctgagccccggcaagatggaggacatcagccccgtgcagaccgacgccctggacagcgtgagagagagactgcacggcggcaagggcctgcccttctacgccggcctgagccccgccggcaagctggtggcctacaagagaaagcccagcagcagcaccagcggcctgatccaggtggccagcaacgccaaggtggccgccagcagaaagcccagaaccctgctgcccagcaccagcaacagcaagatggccagcagcagcggcaccgccaccaacagacccggcaagaacctgaaggccttcgtgcccgccaagagacccatcgagaacgccgcccagatccccgtggccaccccccaggtgagccccaacaccgtgaagagagccggccccagactgctgctgatccccgtgcagcagggcagccccaccctgagacccgtgagcaacacccagctgcagggccacagaatggtgctgcagcccgtgagaagccccagcggcatgaacctgttcagacaccccaacggccagatcgtgcagctgctgcccctgcaccagctgagaggcagcaacacccagcccaacctgcagcccgtgatgttcagaaaccccggcagcgtgatgggcatcagactgcccgcccccagcaagcccagcgagaccccccccagcagcaccagcagcagcgccttcagcgtgatgaaccccgtgatccaggccgtgggcagcagcagcgccgtgaacgtgatcacccaggcccccagcctgctgagcagcggcgccagcttcgtgagccaggccggcaccctgaccctgagaatcagcccccccgagccccagagcttcgccagcaagaccggcagcgagaccaagatcacctacagcagcggcggccagcccgtgggcaccgccagcctgatccccctgcagagcggcagcttcgccctgctgcagctgcccggccagaagcccgtgcccagcagcatcctgcagcacgtggccagcctgcagatgaagagagagagccagaaccccgaccagaaggacgagaccaacagcatcaagagagagcaggagaccaagaaggtgctgcagagcgagggcgaggccgtggaccccgaggccaacgtgatcaagcagaacagcggcgccgccaccagcgaggagaccctgaacgacagcctggaggacagaggcgaccacctggacgaggagtgcctgcccgaggagggctgcgccaccgtgaagcccagcgagcacagctgcatcaccggcagccacaccgaccaggactacaaggacgtgaacgaggagtacggcgccagaaacagaaagagcagcaaggagaaggtggccgtgctggaggtgagaaccatcagcgagaaggccagcaacaagaccgtgcagaacctgagcaaggtgcagcaccagaagctgggcgacgtgaaggtggagcagcagaagggcttcgacaaccccgaggagaacagcagcgagttccccgtgaccttcaaggaggagagcaagttcgagctgagcggcagcaaggtgatggagcagcagagcaacctgcagcccgaggccaaggagaaggagtgcggcgacagcctggagaaggacagagagagatggagaaagcacctgaagggccccctgaccagaaagtgcgtgggcgccagccaggagtgcaagaaggaggccgacgagcagctgatcaaggagaccaagacctgccaggagaacagcgacgtgttccagcaggagcagggcatcagcgacctgctgggcaagagcggcatcaccgaggacgccagagtgctgaagaccgagtgcgacagctggagcagaatcagcaaccccagcgccttcagcatcgtgcccagaagagccgccaagagcagcagaggcaacggccacttccagggccacctgctgctgcccggcgagcagatccagcccaagcaggagaagaagggcggcagaagcagcgccgacttcaccgtgctggacctggaggaggacgacgaggacgacaacgagaagaccgacgacagcatcgacgagatcgtggacgtggtgagcgactaccagagcgaggaggtggacgacgtggagaagaacaactgcgtggagtacatcgaggacgacgaggagcacgtggacatcgagaccgtggaggagctgagcgaggagatcaacgtggcccacctgaagaccaccgccgcccacacccagagcttcaagcagcccagctgcacccacatcagcgccgacgagaaggccgccgagagaagcagaaaggccccccccatccccctgaagctgaagcccgactactggagcgacaagctgcagaaggaggccgaggccttcgcctactacagaagaacccacaccgccaacgagagaagaagaagaggcgagatgagagacctgttcgagaagctgaagatcaccctgggcctgctgcacagcagcaaggtgagcaagagcctgatcctgaccagagccttcagcgagatccagggcctgaccgaccaggccgacaagctgatcggccagaagaacctgctgaccagaaagagaaacatcctgatcagaaaggtgagcagcctgagcggcaagaccgaggaggtggtgctgaagaagctggagtacatctacgccaagcagcaggccctggaggcccagaagagaaagaagaagatgggcagcgacgagttcgacatcagccccagaatcagcaagcagcaggagggcagcagcgccagcagcgtggacctgggccagatgttcatcaacaacagaagaggcaagcccctgatcctgagcagaaagaaggaccaggccaccgagaacaccagccccctgaacaccccccacaccagcgccaacctggtgatgaccccccagggccagctgctgaccctgaagggccccctgttcagcggccccgtggtggccgtgagccccgacctgctggagagcgacctgaagccccaggtggccggcagcgccgtggccctgcccgagaacgacgacctgttcatgatgcccagaatcgtgaacgtgaccagcctggccaccgagggcggcctggtggacatgggcggcagcaagtacccccacgaggtgcccgacagcaagcccagcgaccacctgaaggacaccgtgagaaacgaggacaacagcctggaggacaagggcagaatcagcagcagaggcaacagagacggcagagtgaccctgggccccacccaggtgttcctggccaacaaggacagcggctacccccagatcgtggacgtgagcaacatgcagaaggcccaggagttcctgcccaagaagatcagcggcgacatgagaggcatccagtacaagtggaaggagagcgagagcagaggcgagagagtgaagagcaaggacagcagcttccacaagctgaagatgaaggacctgaaggacagcagcatcgagatggagctgagaaaggtgaccagcgccatcgaggaggccgccctggacagcagcgagctgctgaccaacatggaggacgaggacgacaccgacgagaccctgaccagcctgctgaacgagatcgccttcctgaaccagcagctgaacgacgacagcgtgggcctggccgagctgcccagcagcatggacaccgagttccccggcgacgccagaagagccttcatcagcaaggtgccccccggcagcagagccaccttccaggtggagcacctgggcaccggcctgaaggagctgcccgacgtgcagggcgagagcgacagcatcagccccctgctgctgcacctggaggacgacgacttcagcgagaacgagaagcagctggccgagcccgccagcgagcccgacgtgctgaagatcgtgatcgacagcgagatcaaggacagcctgctgagcaacaagaaggccatcgacggcggcaagaacaccagcggcctgcccgccgagcccgagagcgtgagcagcccccccaccctgcacatgaagaccggcctggagaacagcaacagcaccgacaccctgtggagacccatgcccaagctggcccccctgggcctgaaggtggccaaccccagcagcgacgccgacggccagagcctgaaggtgatgccctgcctggcccccatcgccgccaaggtgggcagcgtgggccacaagatgaacctgaccggcaacgaccaggagggcagagagagcaaggtgatgcccaccctggcccccgtggtggccaagctgggcaacagcggcgccagccccagcagcgccggcaagtag

SEQ ID NO: 88146 - DNA, 687 bp, Artificial Sequence
  Description of Artificial Sequence: Synthetic coding sequence
atggagagagtgaagatgatcaacgtgcagagactgctggaggccgccgagttcctggagagaagagagagagagtgcgagcacggctacgccagcagcttccccagcatgcccagccccagactgcagcacagcaagccccccagaagactgagcagagcccagaagcacagcagcggcagcagcaacaccagcaccgccaacagaagcacccacaacgagctggagaagaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagaagcgacagcgagagagaggagatcgaggtggacgtggagagcaccgagttcagccacggcgaggtggacaacatcagcaccaccagcatcagcgacatcgacgaccacagcagcctgcccagcatcggcagcgacgagggctacagcagcgccagcgtgaagctgagcttcaccagctag

SEQ ID NO: 88147 - DNA, 888 bp, Artificial Sequence
  Description of Artificial Sequence: Synthetic coding sequence
atgggcaagagaggcagacccagaaaggaggccagatgcgagggcgccggcctggcccccgccgccccccccgccgtgccccccgccgtggccgccccccagccccccgccctgcccgaggaccccgccggcgccaagcccagatgccccttcagcgacatcttcaacaccagcgagaacagcatggagaagcacatcaacaccttcctgcagaacgtgcagatcctgctggaggccgccagctacctggagcagatcgagaaggagaacaagaagtgcgagcacggctacgccagcagcttccccagcatgcccagccccagactgcagcacagcaagccccccagaagactgagcagagcccagaagcacagcagcggcagcagcaacaccagcaccgccaacagaagcacccacaacgagctggagaagaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagaagcgacagcgagagagaggagatcgaggtggacgtggagagcaccgagttcagccacggcgaggtggacaacatcagcaccaccagcatcagcgacatcgacgaccacagcagcctgcccagcatcggcagcgacgagggctacagcagcgccagcgtgaagctgagcttcaccagctag

SEQ ID NO: 88148 - DNA, 549 bp, Artificial Sequence
  Description of Artificial Sequence: Synthetic coding sequence
atgcccagccccagactgcagcacagcaagccccccagaagactgagcagagcccagaagcacagcagcggcagcagcaacaccagcaccgccaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagaagcgacagcgagagagaggagatcgaggtggacgtggagagcaccgagttcagccacggcgaggtggacaacatcagcaccaccagcatcagcgacatcgacgaccacagcagcctgcccagcatcggcagcgacgagggctacagcagcgccagcgtgaagctgagcttcaccagctag

SEQ ID NO: 88149 - DNA, 579 bp, Artificial Sequence
  Description of Artificial Sequence: Synthetic coding sequence
atgcccagccccagactgcagcacagcaagccccccagaagactgagcagagcccagaagcacagcagcggcagcagcaacaccagcaccgccaacagaagcacccacaacgagctggagaagaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagaagcgacagcgagagagaggagatcgaggtggacgtggagagcaccgagttcagccacggcgaggtggacaacatcagcaccaccagcatcagcgacatcgacgaccacagcagcctgcccagcatcggcagcgacgagggctacagcagcgccagcgtgaagctgagcttcaccagctag

SEQ ID NO: 88150 - DNA, 579 bp, Artificial Sequence; identical to SEQ ID NO: 88149
  Description of Artificial Sequence: Synthetic coding sequence

SEQ ID NO: 88151 - DNA, 579 bp, Artificial Sequence; identical to SEQ ID NO: 88149
  Description of Artificial Sequence: Synthetic coding sequence

SEQ ID NO: 88152 - DNA, 657 bp, Artificial Sequence
  Description of Artificial Sequence: Synthetic coding sequence
atggagagagtgaagatgatcaacgtgcagagactgctggaggccgccgagttcctggagagaagagagagagagtgcgagcacggctacgccagcagcttccccagcatgcccagccccagactgcagcacagcaagccccccagaagactgagcagagcccagaagcacagcagcggcagcagcaacaccagcaccgccaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagaagcgacagcgagagagaggagatcgaggtggacgtggagagcaccgagttcagccacggcgaggtggacaacatcagcaccaccagcatcagcgacatcgacgaccacagcagcctgcccagcatcggcagcgacgagggctacagcagcgccagcgtgaagctgagcttcaccagctag

SEQ ID NO: 88153 - DNA, 657 bp, Artificial Sequence; identical to SEQ ID NO: 88152
  Description of Artificial Sequence: Synthetic coding sequence

SEQ ID NO: 88154 - DNA, 357 bp, Artificial Sequence
  Description of Artificial Sequence: Synthetic coding sequence
atgcccagccccagactgcagcacagcaagccccccagaagactgagcagagcccagaagcacagcagcggcagcagcaacaccagcaccgccaacagaagcacccacaacgagctggagaagaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagtag

SEQ ID NO: 88155 - DNA, 681 bp, Artificial Sequence
  Description of Artificial Sequence: Synthetic coding sequence
atgggcaagagaggcagacccagaaaggaggccagatgcgagggcgccggcctggcccccgccgccccccccgccgtgccccccgccgtggccgccccccagccccccgccctgcccgaggaccccgccggcgccaagcccagatgccccttcagcgacatcttcaacaccagcgagaacagcatggagaagcacatcaacaccttcctgcagaacgtgcagatcctgctggaggccgccagctacctggagcagatcgagaaggagaacaagaagtgcgagcacggctacgccagcagcttccccagcatgcccagccccagactgcagcacagcaagccccccagaagactgagcagagcccagaagcacagcagcggcagcagcaacaccagcaccgccaacagaagagcccacctgagactgtgcctggagagactgaaggtgctgatccccctgggccccgactgcaccagacacaccaccctgggcctgctgaacaaggccaaggcccacatcaagaagctggaggaggccgagagaaagagccagcaccagctggagaacctggagagagagcagagattcctgaagtggagactggagcagctgcagggcccccaggagatggagagaatcagaatggacagcatcggcagcaccatcagcagcgacagatag

SEQ ID NO: 88156 - DNA, 897 bp, Artificial Sequence
  Description of Artificial Sequence: Synthetic coding sequence
atgaccgagcccggcgccagccccgaggacccctgggtgaaggccagccccgtgggcgcccacgccggcgagggcagagccggcagagccagagccagaagaggcgccggcagaagaggcgccagcctgctgagccccaagagccccaccctgagcgtgcccagaggctgcagagaggacagcagccaccccgcctgcgccaaggtggagtacgcctacagcgacaacagcctggaccccggcctgttcgtggagagcaccagaaagggcagcgtggtgagcagagccaacagcatcggcagcaccagcgccagcagcgtgcccaacaccgacgacgaggacagcgactaccaccaggaggcctacaaggagagctacaaggacagaagaagaagagcccacacccaggccgagcagaagagaagagacgccatcaagagaggctacgacgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgagcaccctgagaaaggacgtgaccgccctgaagatcatgaaggtgaactacgagcagatcgtgaaggcccaccaggacaacccccacgagggcgaggaccaggtgagcgaccaggtgaagttcaacgtgttccagggcatcatggacagcctgttccagagcttcaacgccagcatcagcgtggccagcttccaggagctgagcgcctgcgtgttcagctggatcgaggagcactgcaagccccagaccctgagagagatcgtgatcggcgtgctgcaccagctgaagaaccagctgtactag

SEQ ID NO: 88157 - DNA, 645 bp, Artificial Sequence
  Description of Artificial Sequence: Synthetic coding sequence
atgaccgagcccggcgccagccccgaggacccctgggtgaaggtggagtacgcctacagcgacaacagcctggaccccgacgacgaggacagcgactaccaccaggaggcctacaaggagagctacaaggacagaagaagaagagcccacacccaggccgagcagaagagaagagacgccatcaagagaggctacgacgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgagcaccctgagaaaggacgtgaccgccctgaagatcatgaaggtgaactacgagcagatcgtgaaggcccaccaggacaacccccacgagggcgaggaccaggtgagcgaccaggtgaagttcaacgtgttccagggcatcatggacagcctgttccagagcttcaacgccagcatcagcgtggccagcttccaggagctgagcgcctgcgtgttcagctggatcgaggagcactgcaagccccagaccctgagagagatcgtgatcggcgtgctgcaccagctgaagaaccagctgtactag

SEQ ID NO: 88158 - DNA, 735 bp, Artificial Sequence
  Description of Artificial Sequence: Synthetic coding sequence
atgaccgagcccggcgccagccccgaggacccctgggtgaaggtggagtacgcctacagcgacaacagcctggaccccggcctgttcgtggagagcaccagaaagggcagcgtggtgagcagagccaacagcatcggcagcaccagcgccagcagcgtgcccaacaccgacgacgaggacagcgactaccaccaggaggcctacaaggagagctacaaggacagaagaagaagagcccacacccaggccgagcagaagagaagagacgccatcaagagaggctacgacgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgagcaccctgagaaaggacgtgaccgccctgaagatcatgaaggtgaactacgagcagatcgtgaaggcccaccaggacaacccccacgagggcgaggaccaggtgagcgaccaggtgaagttcaacgtgttccagggcatcatggacagcctgttccagagcttcaacgccagcatcagcgtggccagcttccaggagctgagcgcctgcgtgttcagctggatcgaggagcactgcaagccccagaccctgagagagatcgtgatcggcgtgctgcaccagctgaagaaccagctgtactag

SEQ ID NO: 88159 - DNA, 2826 bp, Artificial Sequence
  Description of Artificial Sequence: Synthetic coding sequence
atggccgaggccaaccccagaagaggcaagatgagattcagaagaaacgccgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcaggtgggcgtgggctacagcttcttccaggcctgcaagctgttcagcaagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88160 - DNA, 2583 bp, Artificial Sequence
  Description of Artificial Sequence: Synthetic coding sequence
atggccgaggccaaccccagaagaggcaagatgagattcagaagaaacgccgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgaggacctgtgcagaagatggctgagctacatcgacgaggccaccatgagcaacggcaagtag

SEQ ID NO: 88161 - DNA, 2778 bp, Artificial Sequence
  Description of Artificial Sequence: Synthetic coding sequence
atggccgaggccaaccccagaagaggcaagatgagattcagaagaaacgccgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88162 - DNA, 3213 bp, Artificial Sequence
  Description of Artificial Sequence: Synthetic coding sequence
atgccccaggccgccgccagcgccccctggaccagcgtgagctgcggcagaatccccggcctgccccagaaccccgacggctgcaccttcatgcccatcgcccaggccatccccctgcaggtggacatggccatggccctgcagagagtgagaatcgccgagaagtacggcaagaactacctgtgcctgctgcaggccgtgttcgtggccgagaccgacctgctgctgagaatcaaggacatcagccacttcctgatgcaggacatcgccttcctgagcggcggcagaggcaaggacaacgcctggatcatcaccttccccgagaactgcaacttcagatgcatccccgaggaggtgatcgccaaggtgctgacctacctgaccagcatcgccagacagaacggcagcgacagcagattcaccatcatcctggacagaagactggacacctggagcagcctgaagatcagcctgcagaagatcagcgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88163 - DNA, 2958 bp, Artificial Sequence
  Description of Artificial Sequence: Synthetic coding sequence
atgcaggacatcgccttcctgagcggcggcagaggcaaggacaacgcctggatcatcaccttccccgagaactgcaacttcagatgcatccccgaggaggtgatcgccaaggtgctgacctacctgaccagcatcgccagacagaacggcagcgacagcagattcaccatcatcctggacagaagactggacacctggagcagcctgaagatcagcctgcagaagatcagcgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88164 - DNA, 1290 bp, Artificial Sequence
  Description of Artificial Sequence: Synthetic coding sequence
tgacacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88165 - DNA, 1587 bp, Artificial Sequence
  Description of Artificial Sequence: Synthetic coding sequence
gtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88166 - DNA, 3006 bp, Artificial Sequence
  Description of Artificial Sequence: Synthetic coding sequence
atgcaggacatcgccttcctgagcggcggcagaggcaaggacaacgcctggatcatcaccttccccgagaactgcaacttcagatgcatccccgaggaggtgatcgccaaggtgctgacctacctgaccagcatcgccagacagaacggcagcgacagcagattcaccatcatcctggacagaagactggacacctggagcagcctgaagatcagcctgcagaagatcagcgccagcttccccggcaacctgcacctggtgctggtgctgagacccaccagcttcctgcagagaaccttcaccgacatcggcttctggttcagccaggaggacttcatgctgaagctgcccgtggtgatgctgagcagcgtgagcgacctgctgacctacatcgacgacaagcagctgacccccgagctgggcggcaccctgcagtactgccacagcgagtggatcatcttcagaaacgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcaggtgggcgtgggctacagcttcttccaggcctgcaagctgttcagcaagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgagaagcagcagggcgccttcatcagcaccgaggagaccgagctggagcacaccagcaccgtggtggaggtgtgcgaggccatcgccagcgtgcaggccgaggccaacaccgtgtggaccgaggccagccagagcgccgagatcagcgaggagcccgccgagtggagcagcaactacttctaccccacctacgacgagaacgaggaggagaacagacccctgatgagacccgtgagcgagatggccctgctgtactag

SEQ ID NO: 88167 - DNA, 2958 bp, Artificial Sequence; identical to SEQ ID NO: 88163
  Description of Artificial Sequence: Synthetic coding sequence

SEQ ID NO: 88168 - DNA, 2466 bp, Artificial Sequence
  Description of Artificial Sequence: Synthetic coding sequence
atggccgaggccaaccccagaagaggcaagatgagattcagaagaaacgccgccagcttccccggcaacctgcacctggtgctggtgctgagacccaccagcttcctgcagagaaccttcaccgacatcggcttctggttcagccaggaggacttcatgctgaagctgcccgccatcgagaacttcgccctgaccgtgaaggagatggcccagatgctgcagagcttcggcaccgagctggccgagaccgagctgcccgacgacatccccagcatcgaggagatcctggccatcagagccgagagataccacctgctgaagaacgacatcaccgccgtgaccaaggagggcaagatcctgctgaccaacctggaggtgcccgacaccgagggcgccgtgagcagcagactggagtgccacagacagatcagcggcgactggcagaccatcaacaagctgctgacccaggtgcacgacatggagaccgccttcgacggcttctgggagaagcaccagctgaagatggagcagtacctgcagctgtggaagttcgagcaggacttccagcagctggtgaccgaggtggagttcctgctgaaccagcaggccgagctggccgacgtgaccggcaccatcgcccaggtgaagcagaagatcaagaagctggagaacctggacgagaacagccaggagctgctgagcaaggcccagttcgtgatcctgcacggccacaagctggccgccaaccaccactacgccctggacctgatctgccagagatgcaacgagctgagatacctgagcgacatcctggtgaacgagatcaaggccaagagaatccagctgagcagaaccttcaagatgcacaagctgctgcagcaggccagacagtgctgcgacgagggcgagtgcctgctggccaaccaggagatcgacaagttccagagcaaggaggacgcccagaaggccctgcaggacatcgagaacttcctggagatggccctgcccttcatcaactacgagcccgagaccctgcagtacgagttcgacgtgatcctgagccccgagctgaaggtgcagatgaagaccatccagctgaagctggagaacatcagaagcatcttcgagaaccagcaggccggcttcagaaacctggccgacaagcacgtgagacccatccagttcgtggtgcccacccccgagaacctggtgaccagcggcacccccttcttcagcagcaagcagggcaagaagacctggagacagaaccagagcaacctgaagatcgaggtggtgcccgactgccaggagaagagaagcagcggccccagcagcagcctggacaacggcaacagcctggacgtgctgaagaaccacgtgctgaacgagctgatccagaccgagagagtgtacgtgagagagctgtacaccgtgctgctgggctacagagccgagatggacaaccccgagatgttcgacctgatgccccccctgctgagaaacaagaaggacatcctgttcggcaacatggccgagatctacgagttccacaacgacatcttcctgagcagcctggagaactgcgcccacgcccccgagagagtgggcccctgcttcctggagagaaaggacgacttccagatgtacgccaagtactgccagaacaagcccagaagcgagaccatctggagaaagtacagcgagtgcgccttcttccaggagtgccagagaaagctgaagcacagactgagactggacagctacctgctgaagcccgtgcagagaatcaccaagtaccagctgctgctgaaggagctgctgaagtacagcaaggactgcgagggcagcgccctgctgaagaaggccctggacgccatgctggacctgctgaagagcgtgaacgacagcatgcaccagatcgccatcaacggctacatcggcaacctgaacgagctgggcaagatgatcatgcagggcggcttcagcgtgtggatcggccacaagaagggcgccaccaagatgaaggacctggccagattcaagcccatgcagagacacctgttcctgtacgagaaggccatcgtgttctgcaagagaagagtggagagcggcgagggcagcgacagataccccagctacagcttcaagcactgctggaagatggacgaggtgggcatcaccgagtacgtgaagggcgacaacagaaagttcgagatctggtacggcgagaaggaggaggtgtacatcgtgcaggccagcaacgtggacgtgaagatgacctggctgaaggagatcagaaacatcctgctgaagcagcaggagctgctgaccgtgaagaagagaaagcagcaggaccagctgaccgagagagacaagttccagatcagcctgcagcagaacgacgaggacctgtgcagaagatggctgagctacatcgacgaggccaccatgagcaacggcaagtag

SEQ ID NO: 88169 - DNA, 2955 bp, Artificial Sequence
  Description of Artificial Sequence: Synthetic coding sequence
atgaccgtgagaagactgagcctgctgtgcagagacctgtgggccctgtggctgctgctgaaggccggcgccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaaggagccctag

SEQ ID NO: 88170 - DNA, 3390 bp, Artificial Sequence
  Description of Artificial Sequence: Synthetic coding sequence
atggccgagaagggcgccagcagaggcaccctgagaagactgtggagcctgcccagaagaagaagaggcaccgccggcagaagcagacccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcgagagcagccccggcagcgccgtgctgagcaacagcagcagctgcagcgagggcggccaggcccccttcagcgacctgcagggctag

SEQ ID NO: 88171 - DNA, 3549 bp, Artificial Sequence
  Description of Artificial Sequence: Synthetic coding sequence
atggccagagtggagagccccgtgcccgccgccagagccagcctgaccggcagctgcgtgctgggccaggccatgcccctgagaggcggcgccggccccagccccgccagccacggccccacccacggccccagcgaccccagaacctgcctgcccggcagaggcgccggcggcatgagaccccacggcagaggcgccctgggctgctgcggcctgtgcagcttctacacctgccacggcgccgccggcgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcgagagcagccccggcagcgccgtgctgagcaacagcagcagctgcagcgagggcggccaggcccccttcagcgacctgcagggctag

SEQ ID NO: 88172 - DNA, 3414 bp, Artificial Sequence
  Description of Artificial Sequence: Synthetic coding sequence
atgttcgactgctggagattcatcctgtgcaagagacccggcagcaacagctacagcagcccccagagacccaacgaggccaagaaggaggagaccgaccaccagatcgacgtgagcgacgtgatcagactggtgcaggacacccccgaggccaccgccatggccaccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcggcaaggcccacgtgcccagagcccacccctag

SEQ ID NO: 88173 - DNA, 2382 bp, Artificial Sequence
  Description of Artificial Sequence: Synthetic coding sequence
tgaagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaaggccagccccaccagccccgacaagaaggccaagagacacgaggtgaagagcgaccccacccccttcggcgtgagaggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcggcaaggcccacgtgcccagagcccacccctag

SEQ ID NO: 88174 - DNA, 3291 bp, Artificial Sequence
  Description of Artificial Sequence: Synthetic coding sequence
atgcccctgagaggcggcgccggccccagccccgccagccacggccccacccacggccccagcgaccccagaacctgcctgcccggcagaggcgccggcggcatgagaccccacggcagaggcgccctgggctgctgcggcctgtgcagcttctacacctgccacggcgccgccggcgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtag

SEQ ID NO: 88175 - DNA, 411 bp, Artificial Sequence
  Description of Artificial Sequence: Synthetic coding sequence
atgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatctag

SEQ ID NO: 88176 - DNA, 3372 bp, Artificial Sequence
  Description of Artificial Sequence: Synthetic coding sequence
atgaccgtgagaagactgagcctgctgtgcagagacctgtgggccctgtggctgctgctgaaggccggcgccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcgagagcagccccggcagcgccgtgctgagcaacagcagcagctgcagcgagggcggccaggcccccttcagcgacctgcagggctag

SEQ ID NO: 88177 - DNA, 741 bp, Artificial Sequence
  Description of Artificial Sequence: Synthetic coding sequence
atgagattctggctgagaaccgaggagatggccctggaggagatggtgcagagactgaacgccgtgagcaagcacaccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagtag

SEQ ID NO: 88178 - DNA, 3342 bp, Artificial Sequence
  Description of Artificial Sequence: Synthetic coding sequence
atgggcgacggcaaggccgtgagaatcagcgtggccgagatgaagagctactacctgtacagcgagtggtgcagctggctgctgagcgtggccgaggacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcggcaaggcccacgtgcccagagcccacccctag

SEQ ID NO: 88179 - DNA, 2712 bp, Artificial Sequence
  Description of Artificial Sequence: Synthetic coding sequence
ctgaagatgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtag

SEQ ID NO: 88180 - DNA, 3414 bp, Artificial Sequence; identical to SEQ ID NO: 88172
  Description of Artificial Sequence: Synthetic coding sequence

SEQ ID NO: 88181 - DNA, 3378 bp, Artificial Sequence
  Description of Artificial Sequence: Synthetic coding sequence
atgagattctggctgagaaccgaggagatggccctggaggagatggtgcagagactgaacgccgtgagcaagcacaccgacgagatcatgcaccaggacatcgtgcccctgtgcgccgccgacatccaggaccagctgaagaagagattcgcctacctgagcggcggcagaggccaggacggcagccccgtgatcaccttccccgactaccccgccttcagcgagatccccgacaaggagttccagaacgtgatgacctacctgaccagcatccccagcctgcaggacgccggcatcggcttcatcctggtgatcgacagaagaagagacaagtggaccagcgtgaaggccagcgtgctgagaatcgccgccagcttccccgccaacctgcagctggtgctggtgctgagacccaccggcttcttccagagaaccctgagcgacatcgccttcaagttcaacagagacgacttcaagatgaaggtgcccgtgatcatgctgagcagcgtgcccgacctgcacggctacatcgacaagagccagctgaccgaggacctgggcggcaccctggactactgccacagcagatggctgtgccagagaaccgccatcgagagcttcgccctgatggtgaagcagaccgcccagatgctgcagagcttcggcaccgagctggccgagaccgagctgcccaacgacgtgcagagcaccagcagcgtgctgtgcgcccacaccgagaagaaggacaaggccaaggaggacctgagactggccctgaaggagggccacagcgtgctggagagcctgagagagctgcaggccgagggcagcgagcccagcgtgaaccaggaccagctggacaaccaggccaccgtgcagagactgctggcccagctgaacgagaccgaggccgccttcgacgagttctgggccaagcaccagcagaagctggagcagtgcctgcagctgagacacttcgagcagggcttcagagaggtgaaggccatcctggacgccgccagccagaagatcgccaccttcaccgacatcggcaacagcctggcccacgtggagcacctgctgagagacctggccagcttcgaggagaagagcggcgtggccgtggagagagccagagccctgagcctggacggcgagcagctgatcggcaacaagcactacgccgtggacagcatcagacccaagtgccaggagctgagacacctgtgcgaccagttcagcgccgagatcgccagaagaagaggcctgctgagcaagagcctggagctgcacagaagactggagaccagcatgaagtggtgcgacgagggcatctacctgctggccagccagcccgtggacaagtgccagagccaggacggcgccgaggccgccctgcaggagatcgagaagttcctggagaccggcgccgagaacaagatccaggagctgaacgccatctacaaggagtacgagagcatcctgaaccaggacctgatggagcacgtgagaaaggtgttccagaagcaggccagcatggaggaggtgttccacagaagacaggccagcctgaagaagctggccgccagacagaccagacccgtgcagcccgtggcccccagacccgaggccctggccaagagcccctgccccagccccggcatcagaagaggcagcgagaacagcagcagcgagggcggcgccctgagaagaggcccctacagaagagccaagagcgagatgagcgagagcagacagggcagaggcagcgccggcgaggaggaggagagcctggccatcctgagaagacacgtgatgagcgagctgctggacaccgagagagcctacgtggaggagctgctgtgcgtgctggagggctacgccgccgagatggacaaccccctgatggcccacctgctgagcaccggcctgcacaacaagaaggacgtgctgttcggcaacatggaggagatctaccacttccacaacagaatcttcctgagagagctggagaactacaccgactgccccgagctggtgggcagatgcttcctggagagaatggaggacttccagatctacgagaagtactgccagaacaagcccagaagcgagagcctgtggagacagtgcagcgactgccccttcttccaggagtgccagagaaagctggaccacaagctgagcctggacagctacctgctgaagcccgtgcagagaatcaccaagtaccagctgctgctgaaggagatgctgaagtacagcagaaactgcgagggcgccgaggacctgcaggaggccctgagcagcatcctgggcatcctgaaggccgtgaacgacagcatgcacctgatcgccatcaccggctacgacggcaacctgggcgacctgggcaagctgctgatgcagggcagcttcagcgtgtggaccgaccacaagagaggccacaccaaggtgaaggagctggccagattcaagcccatgcagagacacctgttcctgcacgagaaggccgtgctgttctgcaagaagagagaggagaacggcgagggctacgagaaggcccccagctacagctacaagcagagcctgaacatggccgccgtgggcatcaccgagaacgtgaagggcgacgccaagaagttcgagatctggtacaacgccagagaggaggtgtacatcgtgcaggcccccacccccgagatcaaggccgcctgggtgaacgagatcagaaaggtgctgaccagccagctgcaggcctgcagagaggccagccagcacagagccctggagcagagccagagcctgcccctgcccgcccccaccagcaccagccccagcagaggcaacagcagaaacatcaagaagctggaggagagaaagaccgaccccctgagcctggagggctacgtgagcagcgcccccctgaccaagccccccgagaagggcaagggctggagcaagaccagccacagcctggaggcccccgaggacgacggcggctggagcagcgccgaggagcagatcaacagcagcgacgccgaggaggacggcggcctgggccccaagaagctggtgcccggcaagtacaccgtggtggccgaccacgagaagggcggccccgacgccctgagagtgagaagcggcgacgtggtggagctggtgcaggagggcgacgagggcctgtggtacgtgagagaccccaccaccggcaaggagggctgggtgcccgccagcagcctgagcgtgagactgggccccagcggcagcgcccagtgcctgagcagcagcgagagcagccccggcagcgccgtgctgagcaacagcagcagctgcagcgagggcggccaggcccccttcagcgacctgcagggctag

SEQ ID NO: 88182 - DNA, 1713 bp, Artificial Sequence
  Description of Artificial Sequence: Synthetic coding sequence
atgagcagactggaggccaagaagcccagcctgtgcaagagcgagcccctgaccaccgagagagtgagaaccaccctgagcgtgctgaagagaatcgtgaccagctgctacggccccagcggcagactgaagcagctgcacaacggcttcggcggctacgtgtgcaccaccagccagagcagcgccctgctgagccacctgctggtgacccaccccatcctgaagatcctgaccgccagcatccagaaccacgtgagcagcttcagcgactgcggcctgttcaccgccatcctgtgctgcaacctgatcgagaacgtgcagagactgggcctgacccccaccaccgtgatcagactgaacaagcacctgctgagcctgtgcatcagctacctgaagagcgagacctgcggctgcagaatccccgtggacttcagcagcacccagatcctgctgtgcctggtgagaagcatcctgaccagcaagcccgcctgcatgctgaccagaaaggagaccgagcacgtgagcgccctgatcctgagagccttcctgctgaccatccccgagaacgccgagggccacatcatcctgggcaagagcctgatcgtgcccctgaagggccagagagtgatcgacagcaccgtgctgcccggcatcctgatcgagatgagcgaggtgcagctgatgagactgctgcccatcaagaagagcaccgccctgaaggtggccctgttctgcaccaccctgagcggcgacaccagcgacaccggcgagggcaccgtggtggtgagctacggcgtgagcctggagaacgccgtgctggaccagctgctgaacctgggcagacagctgatcagcgaccacgtggacctggtgctgtgccagaaggtgatccaccccagcctgaagcagttcctgaacatgcacagaatcatcgccatcgacagaatcggcgtgaccctgatggagcccctgaccaagatgaccggcacccagcccatcggcagcctgggcagcatctgccccaacagctacggcagcgtgaaggacgtgtgcaccgccaagttcggcagcaagcacttcttccacctgatccccaacgaggccaccatctgcagcctgctgctgtgcaacagaaacgacaccgcctgggacgagctgaagctgacctgccagaccgccctgcacgtgctgcagctgaccctgaaggagccctgggccctgctgggcggcggctgcaccgagacccacctggccgcctacatcagacacaagacccacaacgaccccgagagcatcctgaaggacgacgagtgcacccagaccgagctgcagctgatcgccgaggccttctgcagcgccctggagagcgtggtgggcagcctggagcacgacggcggcgagatcctgaccgacatgaagtacggccacctgtggagcgtgcaggccgacagcccctgcgtggccaactggcccgacctgctgagccagtgcggctgcggcctgtacaacagccaggaggagctgaactggagcttcctgagaagcaccagaagacccttcgtgccccagagctgcctgccccacgaggccgtgggcagcgccagcaacctgaccctggactgcctgaccgccaagctgagcggcctgcaggtggccgtggagaccgccaacctgatcctggacctgagctacgtgatcgaggacaagaactag

SEQ ID NO: 88183 - DNA, 1713 bp, Artificial Sequence; identical to SEQ ID NO: 88182
  Description of Artificial Sequence: Synthetic coding sequence

SEQ ID NO: 88184 - DNA, 2145 bp, Artificial Sequence
  Description of Artificial Sequence: Synthetic coding sequence
atgcccgtgagattcaagggcctgagcgagtaccagagaaacttcctgtggaagaagagctacctgagcgagagctgcaacagcagcgtgggcagaaagtacccctgggccggcctgagaagcgaccagctgggcatcaccaaggagcccagcttcatcagcaagagaagagtgccctaccacgacccccagatcagcaagagcctggagtggaacggcgccatcagcgagagcaacgtggtggccagccccgagcccgaggcccccgagacccccaagagccaggaggccgagcagaaggacgtgacccaggagagagtgcacagcctggaggccagcagagtgcccaagagaaccagaagccacagcgccgacagcagagccgagggcgccagcgacgtggagaacaacgagggcgtgaccaaccacacccccgtgaacgagaacgtggagctggagcacagcaccaaggtgctgagcgagaacgtggacaacggcctggacagactgctgagaaagaaggccggcctgaccgtggtgcccagctacaacgccctgagaaacagcgagtaccagagacagttcgtgtggaagaccagcaaggagaccgcccccgccttcgccgccaaccaggtgttccacaacaagagccagttcgtgccccccttcaagggcaacagcgtgatccacgagaccgagtacaagagaaacttcaagggcctgagccccgtgaaggagcccaagctgagaaacgacctgagagagaacagaaacctggagaccgtgagccccgagagaaagagcaacaagatcgacgacagactgaagctggaggccgagatggagctgaaggacctgcaccagcccaagagaaagctgaccccctggaagcaccagagactgggcaaggtgaacagcgagtacagagccaagttcctgagccccgcccagtacctgtacaaggccggcgcctggacccacgtgaagggcaacatgcccaaccaggtgaaggagctgagagagaaggccgagttctacagaaagagagtgcagggcacccacttcagcagagaccacctgaaccagatcctgagcgacagcaactgctgctgggacgtgagcagcaccaccagcagcgagggcaccgtgagcagcaacatcagagccctggacctggccggcgaccccaccagccacaagaccctgcagaagtgccccagcaccgagcccgaggagaagggcaacatcgtggaggagcagccccagaagaacaccaccgagaagctgggcgtgagcgcccccaccatccccgtgagaagaagactggcctgggacaccgagaacaccagcgaggacgtgcagaagcagcccggcgagaaggaggaggaggacgacaacgaggaggagggcgacagaaagaccggcaagcaggccttcatgggcgagcaggagaagctggacgtgagagagaagagcaaggccgacaagatgaaggagggcagcgacagcagcgtgagcagcgagaagggcggcagactgcccacccccaagctgagagagctgggcggcatccagagaacccaccacgacctgaccacccccgccgtgggcggcgccgtgctggtgagccccagcaagatgaagccccccgcccccgagcagagaaagagaatgaccagccaggactgcctggagaccagcaagaacgacttcaccaagaaggagagcagagccgtgagcctgctgaccagccccgccgccggcatcaagaccgtggaccccctgcccctgagagaggacagcgaggacaacatccacaagttcgccgaggccaccctgcccgtgagcaagatccccaagtaccccaccaacccccccggccagctgcccagccccccccacgtgcccagctactggcaccccagcagaagaatccagggcagcctgagagaccccgagttccagcacaacgtgggcaaggccagaatgaacaacctgcagctgccccagcacgaggccttcaacgacgaggacgaggacagactgagcgagatcagcgccagaagcgccgccagcagcctgagagccttccagaccctggccagagccaagaagagaaaggagaacttctggggcaagacctag

SEQ ID NO: 88185 - DNA, 210 bp, Artificial Sequence
  Description of Artificial Sequence: Synthetic coding sequence
atgcccgtgagattcaagggcctgagcgagtaccagagaaacttcctgtggaagaagagctacctgagcgagagctgcaacagcagcgtgggcagaaagtacccctgggccggcctgagaagcgaccagctgggcaaccagggcagatgcagaaccaagatccagcacagcgacatcagcagcctgctgatcctggtgtgcagcacctag

SEQ ID NO: 88186 - DNA, 669 bp, Artificial Sequence
  Description of Artificial Sequence: Synthetic coding sequence
atgcccgtgagattcaagggcctgagcgagtaccagagaaacttcctgtggaagaagagctacctgagcgagagctgcaacagcagcgtgggcagaaagtacccctgggccggcctgagaagcgaccagctgggcatcaccaaggagcccagcttcatcagcaagagaagagtgccctaccacgacccccagatcagcaagagcctggagtggaacggcgccatcagcgagagcaacgtggtggccagccccgagcccgaggcccccgagacccccaagagccaggaggccgagcagaaggacgtgacccaggagagagtgcacagcctggaggccagcagagtgcccaagagaaccagaagccacagcgccgacagcagagccgagggcgccagcgacgtggagaacaacgagggcgtgaccaaccacacccccgtgaacgagaacgtggagctggagcacagcaccaaggtgctgagcgagaacgtggacaacggcgtgggcatcttcaccgccttcctgttcaagagcatcgagttcttcatcggcttcatcgtgatcagcgtgatcctgcacttcgtgttccagaacttccccctgctgttcagctgcctgatgagcatcagaatcgtggacaacagactgctgaccctggtgatcgtgaactag

SEQ ID NO: 88187 - DNA, 2040 bp, Artificial Sequence
  Description of Artificial Sequence: Synthetic coding sequence
atgcccgtgagattcaagggcctgagcgagtaccagagaaacttcctgtggaagaagagctacctgagcgagagctgcaacagcagcgtgggcagaaagtacccctgggccggcctgagaagcgaccagctgggcatcaccaaggagcccagcttcatcagcaagagaagagtgccctaccacgacccccagatcagcaagagcctggagtggaacggcgccatcagcgagagcaacgtggtggccagccccgagcccgaggcccccgagacccccaagagccaggaggccgagcagaaggacgtgacccaggagagagtgcacagcctggaggccagcagagtgcccaagagaaccagaagccacagcgccgacagcagagccgagggcgccagcgacgtggagaacaacgagggcgtgaccaaccacacccccgtgaacgagaacgtggagctggagcacagcaccaaggtgctgagcgagaacgtggacaacggcgtgttccacaacaagagccagttcgtgccccccttcaagggcaacagcgtgatccacgagaccgagtacaagagaaacttcaagggcctgagccccgtgaaggagcccaagctgagaaacgacctgagagagaacagaaacctggagaccgtgagccccgagagaaagagcaacaagatcgacgacagactgaagctggaggccgagatggagctgaaggacctgcaccagcccaagagaaagctgaccccctggaagcaccagagactgggcaaggtgaacagcgagtacagagccaagttcctgagccccgcccagtacctgtacaaggccggcgcctggacccacgtgaagggcaacatgcccaaccagggcagcctgaacgccatgtggtacgccgaggtgaaggagctgagagagaaggccgagttctacagaaagagagtgcagggcacccacttcagcagagaccacctgaaccagatcctgagcgacagcaactgctgctgggacgtgagcagcaccaccagcagcgagggcaccgtgagcagcaacatcagagccctggacctggccggcgaccccaccagccacaagaccctgcagaagtgccccagcaccgagcccgaggagaagggcaacatcgtggaggagcagccccagaagaacaccaccgagaagctgggcgtgagcgcccccaccatccccgtgagaagaagactggcctgggacaccgagaacaccagcgaggacgtgcagaagcagcccggcgagaaggaggaggaggacgacaacgaggaggagggcgacagaaagaccggcaagcaggccttcatgggcgagcaggagaagctggacgtgagagagaagagcaaggccgacaagatgaaggagggcagcgacagcagcgtgagcagcgagaagggcggcagactgcccacccccaagctgagagagctgggcggcatccagagaacccaccacgacctgaccacccccgccgtgggcggcgccgtgctggtgagccccagcaagatgaagccccccgcccccgagcagagaaagagaatgaccagccaggactgcctggagaccagcaagaacgacttcaccaagaaggagagcagagccgtgagcctgctgaccagccccgccgccggcatcaagaccgtggaccccctgcccctgagagaggacagcgaggacaacatccacaagttcgccgaggccaccctgcccgtgagcaagatccccaagtaccccaccaacccccccggccagctgcccagccccccccacgtgcccagctactggcaccccagcagaagaatccagggcagcctgagagaccccgagttccagcacaacgtgggcaaggccagaatgaacaacctgcagctgccccagcacgaggccttcaacgacgaggacgaggacagactgagcgagatcagcgccagaagcgccgccagcagcctgagagccttccagaccctggccagagccaagaagagaaaggagaacttctggggcaagacctag

SEQ ID NO: 88188 - DNA, 2715 bp, Artificial Sequence
  Description of Artificial Sequence: Synthetic coding sequence
atggacagatacctgctgctggtgatctggggcgagggcaagttccccagcgccgccagcagagaggccgagcacggccccgaggtgagcagcggcgagggcaccgagaaccagcccgacttcaccgccgccaacgtgtaccacctgctgaagagaagcatcagcgccagcatcaaccccgaggacagcaccttccccgcctgcagcgtgggcggcatccccggcagcaagaagtggttcttcgccgtgcaggccatctacggcttctaccagttctgcagcagcgactggcaggagatccacttcgacaccgagaaggacaagatcgaggacgtgctgcagaccaacatcgaggagtgcctgggcgccgtggagtgcttcgaggaggaggacagcaacagcagagagagcctgagcctggccgacctgtacgaggaggccgccgagaacctgcaccagctgagcgacaagctgcccgcccccggcagagccatggtggacatcatcctgctgctgagcgacaaggacccccccaagctgaaggactacctgcccaccgtgggcgccctgaagcacctgagagagtggtacagcgccaagatcaccatcgccggcaaccactgcgagatcaactgccagaagatcgccgagtacctgagcgccaacgtggtgagcctggaggacctgagaaacgtgatcgacagcaaggagctgtggagaggcaagatccagatctgggagagaaagttcggcttcgagatcagcttccccgagttctgcctgaagggcgtgaccctgaagaacttcagcaccagcaacctgaacaccgacttcctggccaagaagatcatccccagcaaggacaagaacatcctgcccaaggtgttccactactacggccccgccctggagttcgtgcagatgatcaagctgagcgacctgcccagctgctacatgagcgacatcgagttcgagctgggcctgaccaacagcaccaagcagaacagcgtgctgctgctggagcagatcagcagcctgtgcagcaaggtgggcgccctgttcgtgctgccctgcaccatcagcaacatcctgatccccccccccaaccagctgagcagcagaaagtggaaggagtacatcgccaagaagcccaagaccatcagcgtgcccgacgtggaggtgaagggcgagtgcagcagctactacctgctgctgcagggcaacggcaacagaagatgcaaggccaccctgatccacagcgccaaccagatcaacggcagcttcgccctgaacctgatccacggcaagatgaagaccaagaccgaggaggccaagctgagcttccccttcgacctgctgagcctgccccacttcagcggcgagcagatcgtgcagagagagaagcagctggccaacgtgcaggtgctggccctggaggagtgcctgaagagaagaaagctggccaagcagcccgagaccgtgagcgtggccgagctgaagagcctgctggtgctgaccagaaagcacttcctggactacttcgacgccgtgatccccaagatgatcctgagaaagatggacaagatcaagaccttcaacatcctgaacgacttcagccccgtggagcccaacagcagcagcctgatggagaccaaccccctggagtggcccgagagacacgtgctgcagaacctggagaccttcgagaagaccaagcagaagatgagaaccggcagcctgccccacagcagcgagcagctgctgggccacaaggagggccccagagacagcatcaccctgctggacgccaaggagctgctgaagtacttcaccagcgacggcctgcccatcggcgacctgcagcccctgcccatccagaagggcgagaagaccttcgtgctgacccccgagctgagccccggcaagctgcaggtgctgcccttcgagaaggccagcgtgtgccactaccacggcatcgagtactgcctggacgacagaaaggccctggagagagacggcggcttcagcgagctgcagagcagactgatcagatacgagacccagaccacctgcaccagagagagcttccccgtgcccaccgtgctgagccccctgcccagccccgtggtgagcagcgaccccggcagcgtgcccgacggcgaggtgctgcagaacgagctgagaaccgaggtgagcagactgaagagaagaagcaaggacctgaactgcctgtaccccagaaagagactggtgaagagcgagagcagcgagagcctgctgagccagaccaccggcaacagcaaccactaccaccaccacgtgaccagcagaaagccccagaccgagagaagcctgcccgtgacctgccccctggtgcccatccccagctgcgagacccccaagctggccaccaagaccagcagcggccagaagagcatgcacgagagcaagaccagcagacagatcaaggagagcagaagccagaagcacaccagaatcctgaaggaggtggtgaccgagaccctgaagaagcacagcatcaccgagacccacgagtgcttcaccgcctgcagccagagactgttcgagatcagcaagttctacctgaaggacctgaagaccagcagaggcctgttcgaggagatgaagaagaccgccaacaacaacgccgtgcaggtgatcgactgggtgctggagaagaccagcaagaagtag

SEQ ID NO: 88189 - DNA, 1374 bp, Artificial Sequence
  Description of Artificial Sequence: Synthetic coding sequence
tgaatggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggccccagctggaacagagcccccttcagaaagggctgcggcgtgtgctggaccgtgtggaagggcagcgccagcagagtgcccttcaccatgtgctag

SEQ ID NO: 88190 - DNA, 1566 bp, Artificial Sequence
  Description of Artificial Sequence: Synthetic coding sequence
atggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaaggccctgctgagcagcagcaagaccaaggagggcagaaaggtggacggcgagagagtgctgaacccccagcccgtgagcctgagcctgttccccggcaagccccacagcaccgcctggggcctgctgagactgagatacgagctgttcctgagcaagtag

SEQ ID NO: 88191 - DNA, 1680 bp, Artificial Sequence
  Description of Artificial Sequence: Synthetic coding sequence
atggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88192 - DNA, 1563 bp, Artificial Sequence
  Description of Artificial Sequence: Synthetic coding sequence
atggccgagaccgtgtggagcaccgacaccggcgaggccgtgtacagaagcagagaccccgtgagaaacctgagactgagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcctgagcagcagcaagaccaaggagggcagaaaggtggacggcgagagagtgctgaacccccagcccgtgagcctgagcctgttccccggcaagccccacagcaccgcctggggcctgctgagactgagatacgagctgttcctgagcaagtag

SEQ ID NO: 88193 - DNA, 1650 bp, Artificial Sequence
  Description of Artificial Sequence: Synthetic coding sequence
atggccgtgcccgtgagcagcttcgcccagagaaccagaagcagattcagagtgcacctgcagagaatcaccagcagcaacttcctgcactaccagcccgccgccgagctgggcaaggacctgatcgacctggccaccttcagaccccagcccaccgccagcggccacagacccgaggaggacgaggaggaggagatcgtgatcggctggcaggagaagctgttcagccagttcgaggtggacctgtaccagaacgagaccgcctgccagagccccctggactaccagtacagacaggagatcctgaagctggagaacagcggcggcaagaagaacagaagaatcttcacctacaccgacagcgacagatacaccaacctggaggagcactgccagagaatgaccaccgccgccagcgaggtgcccagcttcctggtggagagaatggccaacgtgagaagaagaagacaggacagaagaggcatggagggcggcatcctgaagagcagaatcgtgacctgggagcccagcgaggagttcgtgagaaacaaccacgtgatcaacacccccctgcagaccatgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88194 - DNA, 1071 bp, Artificial Sequence
  Description of Artificial Sequence: Synthetic coding sequence
atgcacatcatggccgacctgggcccctacaagaagctgggctacaagaagtacgagcacgtgctgtgcaccctgaaggtggacagcaacggcgtgatcaccgtgaagcccgacttcaccggcctgaagggcccctacagaatcgagaccgagggcgagaagcaggagctgtggaagtacaccatcgacaacgtgagcccccacgcccagcccgaggaggaggagagagagagaagagtgttcaaggacctgtacggcagacacaaggagtacctgagcagcctggtgggcaccgacttcgagatgaccgtgcccggcgccctgagactgttcgtgaacggcgaggtggtgagcgcccagggctacgagtacgacaacctgtacgtgcacttcttcgtggagctgcccaccgcccactggagcagccccgccttccagcagctgagcggcgtgacccagacctgcaccaccaagagcctggccatggacaaggtggcccacttcagctaccccttcaccttcgaggccttcttcctgcacgaggacgagagcagcgacgccctgcccgagtggcccgtgctgtactgcgaggtgctgagcctggacttctggcagagatacagagtggagggctacggcgccgtggtgctgcccgccacccccggcagccacaccctgaccgtgagcacctggagacccgtggagctgggcaccgtggccgagctgagaagattcttcatcggcggcagcctggagctggaggacctgagctacgtgagaatccccggcagcttcaagggcgagagactgagcagattcggcctgagaaccgagaccaccggcaccgtgaccttcagactgcactgcctgcagcagagcagagccttcatggagagcagcagcctgcagaagagaatgagaagcgtgctggacagactggagggcttcagccagcagagcagcatccacaacgtgctggaggccttcagaagagccagaagaagaatgcaggaggccagagagagcctgccccaggacctggtgagccccagcggcaccctggtgagctag

SEQ ID NO: 88195 - DNA, 4746 bp, Artificial Sequence
  Description of Artificial Sequence: Synthetic coding sequence
atgaaggcccagggcgagaccgaggagagcgagaagctgagcaagatgagcagcctgctggagagactgcacgccaagttcaaccagaacagaccctggagcgagaccatcaagctggtgagacaggtgatggagaagagagtggtgatgagcagcggcggccaccagcacctggtgagctgcctggagaccctgcagaaggccctgaaggtgaccagcctgcccgccatgaccgacagactggagagcatcgccagacagaacggcctgggcagccacctgagcgccagcggcaccgagtgctacatcaccagcgacatgttctacgtggaggtgcagctggaccccgccggccagctgtgcgacgtgaaggtggcccaccacggcgagaaccccgtgagctgccccgagctggtgcagcagctgagagagaagaacttcgacgagttcagcaagcacctgaagggcctggtgaacctgtacaacctgcccggcgacaacaagctgaagaccaagatgtacctggccctgcagagcctggagcaggacctgagcaagatggccatcatgtactggaaggccaccaacgccggccccctggacaagatcctgcacggcagcgtgggctacctgacccccagaagcggcggccacctgatgaacctgaagtactacgtgagccccagcgacctgctggacgacaagaccgccagccccatcatcctgcacgagaacaacgtgagcagaagcctgggcatgaacgccagcgtgaccatcgagggcaccagcgccgtgtacaagctgcccatcgcccccctgatcatgggcagccaccccgtggacaacaagtggacccccagcttcagcagcatcaccagcgccaacagcgtggacctgcccgcctgcttcttcctgaagttcccccagcccatccccgtgagcagagccttcgtgcagaagctgcagaactgcaccggcatccccctgttcgagacccagcccacctacgcccccctgtacgagctgatcacccagttcgagctgagcaaggaccccgaccccatccccctgaaccacaacatgagattctacgccgccctgcccggccagcagcactgctacttcctgaacaaggacgcccccctgcccgacggcagaagcctgcagggcaccctggtgagcaagatcaccttccagcaccccggcagagtgcccctgatcctgaacctgatcagacaccaggtggcctacaacaccctgatcggcagctgcgtgaagagaaccatcctgaaggaggacagccccggcctgctgcagttcgaggtgtgccccctgagcgagagcagattcagcgtgagcttccagcaccccgtgaacgacagcctggtgtgcgtggtgatggacgtgcaggacagcacccacgtgagctgcaagctgtacaagggcctgagcgacgccctgatctgcaccgacgacttcatcgccaaggtggtgcagagatgcatgagcatccccgtgaccatgagagccatcagaagaaaggccgagaccatccaggccgacacccccgccctgagcctgatcgccgagaccgtggaggacatggtgaagaagaacctgccccccgccagcagccccggctacggcatgaccaccggcaacaaccccatgagcggcaccaccacccccaccaacaccttccccggcggccccatcaccaccctgttcaacatgagcatgagcatcaaggacagacacgagagcgtgggccacggcgaggacttcagcaaggtgagccagaaccccatcctgaccagcctgctgcagatcaccggcaacggcggcagcaccatcggcagcagccccacccccccccaccacacccccccccccgtgagcagcatggccggcaacaccaagaaccaccccatgctgatgaacctgctgaaggacaaccccgcccaggacttcagcaccctgtacggcagcagccccctggagagacagaacagcagcagcggcagccccagaatggagatctgcagcggcagcaacaagaccaagaagaagaagagcagcagactgccccccgagaagcccaagcaccagaccgaggacgacttccagagagagctgttcagcatggacgtggacagccagaaccccatcttcgacgtgaacatgaccgccgacaccctggacaccccccacatcacccccgcccccagccagtgcagcaccccccccaccacctacccccagcccgtgccccacccccagcccagcatccagagaatggtgagactgagcagcagcgacagcatcggccccgacgtgaccgacatcctgagcgacatcgccgaggaggccagcaagctgcccagcaccagcgacgactgccccgccatcggcacccccctgagagacagcagcagcagcggccacagccagagcaccctgttcgacagcgacgtgttccagaccaacaacaacgagaacccctacaccgaccccgccgacctgatcgccgacgccgccggcagccccagcagcgacagccccaccaaccacttcttccacgacggcgtggacttcaaccccgacctgctgaacagccagagccagagcggcttcggcgaggagtacttcgacgagagcagccagagcggcgacaacgacgacttcaagggcttcgccagccaggccctgaacaccctgggcgtgcccatgctgggcggcgacaacggcgagaccaagttcaagggcaacaaccaggccgacaccgtggacttcagcatcatcagcgtggccggcaaggccctggcccccgccgacctgatggagcaccacagcggcagccagggccccctgctgaccaccggcgacctgggcaaggagaagacccagaagagagtgaaggagggcaacggcaccagcaacagcaccctgagcggccccggcctggacagcaagcccggcaagagaagcagaacccccagcaacgacggcaagagcaaggacaagccccccaagagaaagaaggccgacaccgagggcaagagccccagccacagcagcagcaacagacccttcaccccccccaccagcaccggcggcagcaagagccccggcagcgccggcagaagccagaccccccccggcgtggccaccccccccatccccaagatcaccatccagatccccaagggcaccgtgatggtgggcaagcccagcagccacagccagtacaccagcagcggcagcgtgagcagcagcggcagcaagagccaccacagccacagcagcagcagcagcagcagcgccagcaccagcggcaagatgaagagcagcaagagcgagggcagcagcagcagcaagctgagcagcagcatgtacagcagccagggcagcagcggcagcagccagagcaagaacagcagccagagcggcggcaagcccggcagcagccccatcaccaagcacggcctgagcagcggcagcagcagcaccaagatgaagccccagggcaagcccagcagcctgatgaaccccagcctgagcaagcccaacatcagccccagccacagcagaccccccggcggcagcgacaagctggccagccccatgaagcccgtgcccggcaccccccccagcagcaaggccaagagccccatcagcagcggcagcggcggcagccacatgagcggcaccagcagcagcagcggcatgaagagcagcagcggcctgggcagcagcggcagcctgagccagaagaccccccccagcagcaacagctgcaccgccagcagcagcagcttcagcagcagcggcagcagcatgagcagcagccagaaccagcacggcagcagcaagggcaagagccccagcagaaacaagaagcccagcctgaccgccgtgatcgacaagctgaagcacggcgtggtgaccagcggccccggcggcgaggaccccctggacggccagatgggcgtgagcaccaacagcagcagccaccccatgagcagcaagcacaacatgagcggcggcgagttccagggcaagagagagaagagcgacaaggacaagagcaaggtgagcaccagcggcagcagcgtggacagcagcaagaagaccagcgagagcaagaacgtgggcagcaccggcgtggccaagatcatcatcagcaagcacgacggcggcagccccagcatcaaggccaaggtgaccctgcagaagcccggcgagagcagcggcgagggcctgagaccccagatggccagcagcaagaactacggcagccccctgatcagcggcagcacccccaagcacgagagaggcagccccagccacagcaagagccccgcctacaccccccagaacctggacagcgagagcgagagcggcagcagcatcgccgagaagagctaccagaacagccccagcagcgacgacggcatcagacccctgcccgagtacagcaccgagaagcacaagaagcacaagaaggagaagaagaaggtgaaggacaaggacagagacagagacagagacaaggacagagacaagaagaagagccacagcatcaagcccgagagctggagcaagagccccatcagcagcgaccagagcctgagcatgaccagcaacaccatcctgagcgccgacagacccagcagactgagccccgacttcatgatcggcgaggaggacgacgacctgatggacgtggccctgatcggcaactag

SEQ ID NO: 88196 - DNA, 1671 bp, Artificial Sequence
  Description of Artificial Sequence: Synthetic coding sequence
atgaaggcccagggcgagaccgaggagagcgagaagctgagcaagatgagcagcctgctggagagactgcacgccaagttcaaccagaacagaccctggagcgagaccatcaagctggtgagacaggtgatggagaagagagtggtgatgagcagcggcggccaccagcacctggtgagctgcctggagaccctgcagaaggccctgaaggtgaccagcctgcccgccatgaccgacagactggagagcatcgccagacagaacggcctgggcagccacctgagcgccagcggcaccgagtgctacatcaccagcgacatgttctacgtggaggtgcagctggaccccgccggccagctgtgcgacgtgaaggtggcccaccacggcgagaaccccgtgagctgccccgagctggtgcagcagctgagagagaagaacttcgacgagttcagcaagcacctgaagggcctggtgaacctgtacaacctgcccggcgacaacaagctgaagaccaagatgtacctggccctgcagagcctggagcaggacctgagcaagatggccatcatgtactggaaggccaccaacgccggccccctggacaagatcctgcacggcagcgtgggctacctgacccccagaagcggcggccacctgatgaacctgaagtactacgtgagccccagcgacctgctggacgacaagaccgccagccccatcatcctgcacgagaacaacgtgagcagaagcctgggcatgaacgccagcgtgaccatcgagggcaccagcgccgtgtacaagctgcccatcgcccccctgatcatgggcagccaccccgtggacaacaagtggacccccagcttcagcagcatcaccagcgccaacagcgtggacctgcccgcctgcttcttcctgaagttcccccagcccatccccgtgagcagagccttcgtgcagaagctgcagaactgcaccggcatccccctgttcgagacccagcccacctacgcccccctgtacgagctgatcacccagttcgagctgagcaaggaccccgaccccatccccctgaaccacaacatgagattctacgccgccctgcccggccagcagcactgctacttcctgaacaaggacgcccccctgcccgacggcagaagcctgcagggcaccctggtgagcaagatcaccttccagcaccccggcagagtgcccctgatcctgaacctgatcagacaccaggtggcctacaacaccctgatcggcagctgcgtgaagagaaccatcctgaaggaggacagccccggcctgctgcagttcgaggtgtgccccctgagcgagagcagattcagcgtgagcttccagcaccccgtgaacgacagcctggtgtgcgtggtgatggacgtgcaggacagcacccacgtgagctgcaagctgtacaagggcctgagcgacgccctgatctgcaccgacgacttcatcgccaaggtggtgcagagatgcatgagcatccccgtgaccatgagagccatcagaagaaaggccgagaccatccaggccgacacccccgccctgagcctgatcgccgagaccgtggaggacatggtgaagaagaacctgccccccgccagcagccccggcagcaagaaccccgagctgggcagcggctag

SEQ ID NO: 88197 - DNA, 408 bp, Artificial Sequence
  Description of Artificial Sequence: Synthetic coding sequence
atggccgagaagttcgaccacctggaggagcacctggagaagttcgtggagaacatcagacagctgggcatcatcgtgagcgacttccagcccagcagccaggccggcctgaaccagaagctgaacttcatcgtgaccggcctgcaggacatcgacaagtgcagacagcagctgcacgacatcaccgtgcccctggaggtgttcgagtacatcgaccagggcagaaacccccagctgtacaccaaggagtgcctggagagagccctggccaagaacgagcaggtgaagggcaagatcgacaccatgaagaagttcaagagcctgctgatccaggagctgagcaaggtgttccccgaggacatggccaagtacagaagcatcagaggcgaggaccacccccccagctag

SEQ ID NO: 88198 - DNA, 354 bp, Artificial Sequence
  Description of Artificial Sequence: Synthetic coding sequence
atggccacctacagcctggccaacgagagactgagagccctggaggacatcgagagagagatcggcgccatcctgcagaacgccggcaccgtgatcctggagctgagcaaggagaagaccaacgagagactgctggacagacaggccgccgccttcaccgccagcgtgcagcacgtggaggccgagctgagcgcccagatcagatacctgacccaggtggccaccggccagccccacgagggcagcagctacagcagcagaaaggactgccagatggccctgaagagagtggactacgccagactgaagctgagcgacgtggccagaacctgcgagcagatgctggagaactag

SEQ ID NO: 88199 - DNA, 6543 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcaggccaagatccagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88200 - DNA, 6534 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88201 - DNA, 6531 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88202 - DNA, 393 bp, Artificial Sequence
  Description of Artificial Sequence: Synthetic coding sequence
tgaacccccaacagaagaagaaagaagcagctgaacgccgccttcctgccccaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctactag

SEQ ID NO: 88203 - DNA, 6384 bp, Artificial Sequence
  Description of Artificial Sequence: Synthetic coding sequence
gaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagctgagccccagcagcctgcagggctacaccccctacgtgagccacgtgggcctgcagcagcacaccggccccgccgaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88204 - DNA, 2778 bp, Artificial Sequence
  Description of Artificial Sequence: Synthetic coding sequence
ggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcaggccaagatccagagccagggcatgctgggccagagcagcgtgcaccagatgacccccagcagcagctacggcctgcagaccagccagggctacaccccctacgtgagccacgtgggcctgcagcagcacaccggccccgccggcaccatggtgccccccagctacagcagccagccctaccagagcacccaccccagcaccaaccccaccctggtggaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagcagcagcagcagcagcagcagcagcagcagcagcagcagcagcagcagcagcagcagcagcagtaccacatcagacagcagcagcagcagcagatcctgagacagcagcagcagcagcagcagcagcagcagcagcagcagcagcagcagcagcagcagcagcagcagcagcagcagcagcaccagcagcagcagcagcagcaggccgcccccccccagccccagccccagagccagccccagttccagagacagggcctgcagcagacccagcagcagcagcagaccgccgccctggtgagacagctgcagcagcagctgagcaacacccagccccagcccagcaccaacatcttcggcagatactag

SEQ ID NO: 88205 - DNA, 756 bp, Artificial Sequence
  Description of Artificial Sequence: Synthetic coding sequence
tgagagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccgaccccaccagacacctgcagcagagacccagcggctacgtgcaccagcaggcccccacctacggccacggcctgaccagcacccagagattcagccaccagaccctgcagcagacccccatgatcagcaccatgacccccatgagcgcccagggcgtgcaggccggcgtgagaagcaccgccatcctgcccgagcagcagcagcagcagtag

SEQ ID NO: 88206 - DNA, 6003 bp, Artificial Sequence
  Description of Artificial Sequence: Synthetic coding sequence
atggccgccttcggcatcctgagctacgagcacagacccctgaagagacccagactgggcccccccgacgtgtacccccaggaccccaagcagaaggaggacgagctgaccgccctgaacgtgaagcagggcttcaacaaccagcccgccgtgagcggcgacgagcacggcagcgccaagaacgtgagcttcaaccccgccaagatcagcagcaacttcagcagcatcatcgccgagaagctgagatgcaacaccctgcccgacaccggcagaagaaagccccaggtgaaccagaaggacaacttctggctggtgaccgccagaagccagagcgccatcaacacctggttcaccgacctggccggcaccaagcccctgacccagctggccaagaaggtgcccatcttcagcaagaaggaggaggtgttcggctacctggccaagtacaccgtgcccgtgatgagagccgcctggctgatcaagatgacctgcgcctactacgccgccatcagcgagaccaaggtgaagaagagacacgtggaccccttcatggagtggacccagatcatcaccaagtacctgtgggagcagctgcagaagatggccgagtactacagacccggccccgccggcagcggcggctgcggcagcaccatcggccccctgccccacgacgtggaggtggccatcagacagtgggactacaccgagaagctggccatgttcatgttccaggacggcatgctggacagacacgagttcctgacctgggtgctggagtgcttcgagaagatcagacccggcgaggacgagctgctgaagctgctgctgcccctgctgctgagatacagcggcgagttcgtgcagagcgcctacctgagcagaagactggcctacttctgcaccagaagactggccctgcagctggacggcgtgagcagccacagcagccacgtgatcagcgcccagagcaccagcaccctgcccaccacccccgccccccagccccccaccagcagcacccccagcacccccttcagcgacctgctgatgtgcccccagcacagacccctggtgttcggcctgagctgcatcctgcagaccatcctgctgtgctgccccagcgccctggtgtggcactacagcctgaccgacagcagaatcaagaccggcagccccctggaccacctgcccatcgcccccagcaacctgcccatgcccgagggcaacagcgccttcacccagcaggtgagagccaagctgagagagatcgagcagcagatcaaggagagaggccaggccgtggaggtgagatggagcttcgacaagtgccaggaggccaccgccggcttcaccatcggcagagtgctgcacaccctggaggtgctggacagccacagcttcgagagaagcgacttcagcaacagcctggacagcctgtgcaacagaatcttcggcctgggccccagcaaggacggccacgagatcagcagcgacgacgacgccgtggtgagcctgctgtgcgagtgggccgtgagctgcaagagaagcggcagacacagagccatggtggtggccaagctgctggagaagagacaggccgagatcgaggccgagagatgcggcgagagcgaggccgccgacgagaagggcagcatcgccagcggcagcctgagcgcccccagcgcccccatcttccaggacgtgctgctgcagttcctggacacccaggcccccatgctgaccgaccccagaagcgagagcgagagagtggagttcttcaacctggtgctgctgttctgcgagctgatcagacacgacgtgttcagccacaacatgtacacctgcaccctgatcagcagaggcgacctggccttcggcgcccccggccccagaccccccagccccttcgacgaccccgccgacgaccccgagcacaaggaggccgagggcagcagcagcagcaagctggaggaccccggcctgagcgagagcatggacatcgaccccagcagcagcgtgctgttcgaggacatggagaagcccgacttcagcctgttcagccccaccatgccctgcgagggcaagggcagccccagccccgagaagcccgacgtggagaaggaggtgaagcccccccccaaggagaagatcgagggcaccctgggcgtgctgtacgaccagcccagacacgtgcagtacgccacccacttccccatcccccaggaggagagctgcagccacgagtgcaaccagagactggtggtgctgttcggcgtgggcaagcagagagacgacgccagacacgccatcaagaagatcaccaaggacatcctgaaggtgctgaacagaaagggcaccgccgagaccgaccagctggcccccatcgtgcccctgaaccccggcgacctgaccttcctgggcggcgaggacggccagaagagaagaagaaacagacccgaggccttccccaccgccgaggacatcttcgccaagttccagcacctgagccactacgaccagcaccaggtgaccgcccaggtgagcagaaacgtgctggagcagatcaccagcttcgccctgggcatgagctaccacctgcccctggtgcagcacgtgcagttcatcttcgacctgatggagtacagcctgagcatcagcggcctgatcgacttcgccatccagctgctgaacgagctgagcgtggtggaggccgagctgctgctgaagagcagcgacctggtgggcagctacaccaccagcctgtgcctgtgcatcgtggccgtgctgagacactaccacgcctgcctgatcctgaaccaggaccagatggcccaggtgttcgagggcctgtgcggcgtggtgaagcacggcatgaacagaagcgacggcagcagcgccgagagatgcatcctggcctacctgtacgacctgtacaccagctgcagccacctgaagaacaagttcggcgagctgttcagcgacttctgcagcaaggtgaagaacaccatctactgcaacgtggagcccagcgagagcaacatgagatgggcccccgagttcatgatcgacaccctggagaaccccgccgcccacaccttcacctacaccggcctgggcaagagcctgagcgagaaccccgccaacagatacagcttcgtgtgcaacgccctgatgcacgtgtgcgtgggccaccacgaccccgacagagtgaacgacatcgccatcctgtgcgccgagctgaccggctactgcaagagcctgagcgccgagtggctgggcgtgctgaaggccctgtgctgcagcagcaacaacggcacctgcggcttcaacgacctgctgtgcaacgtggacgtgagcgacctgagcttccacgacagcctggccaccttcgtggccatcctgatcgccagacagtgcctgctgctggaggacctgatcagatgcgccgccatccccagcctgctgaacgccgcctgcagcgagcaggacagcgagcccggcgccagactgacctgcagaatcctgctgcacctgttcaagaccccccagctgaacccctgccagagcgacggcaacaagcccaccgtgggcatcagaagcagctgcgacagacacctgctggccgccagccagaacagaatcgtggacggcgccgtgttcgccgtgctgaaggccgtgttcgtgctgggcgacgccgagctgaagggcagcggcttcaccgtgaccggcggcaccgaggagctgcccgaggaggagggcggcggcggcagcggcggcagaagacagggcggcagaaacatcagcgtggagaccgccagcctggacgtgtacgccaagtacgtgctgagaagcatctgccagcaggagtgggtgggcgagagatgcctgaagagcctgtgcgaggacagcaacgacctgcaggaccccgtgctgagcagcgcccaggcccagagactgatgcagctgatctgctacccccacagactgctggacaacgaggacggcgagaacccccagagacagagaatcaagagaatcctgcagaacctggaccagtggaccatgagacagagcagcctggagctgcagctgatgatcaagcagacccccaacaacgagatgaacagcctgctggagaacatcgccaaggccaccatcgaggtgttccagcagagcgccgagaccggcagcagcagcggcagcaccgccagcaacatgcccagcagcagcaagaccaagcccgtgctgagcagcctggagagaagcggcgtgtggctggtggcccccctgatcgccaagctgcccaccagcgtgcagggccacgtgctgaaggccgccggcgaggagctggagaagggccagcacctgggcagcagcagcagaaaggagagagacagacagaagcagaagagcatgagcctgctgagccagcagcccttcctgagcctggtgctgacctgcctgaagggccaggacgagcagagagagggcctgctgaccagcctgtacagccaggtgcaccagatcgtgaacaactggagagacgaccagtacctggacgactgcaagcccaagcagctgatgcacgaggccctgaagctgagactgaacctggtgggcggcatgttcgacaccgtgcagagaagcacccagcagaccaccgagtgggccatgctgctgctggagatcatcatcagcggcaccgtggacatgcagagcaacaacgagctgttcaccaccgtgctggacatgctgagcgtgctgatcaacggcaccctggccgccgacatgagcagcatcagccagggcagcatggaggagaacaagagagcctacatgaacctggccaagaagctgcagaaggagctgggcgagagacagagcgacagcctggagaaggtgagacagctgctgcccctgcccaagcagaccagagacgtgatcacctgcgagccccagggcagcctgatcgacaccaagggcaacaagatcgccggcttcgacagcatcttcaagaaggagggcctgcaggtgagcaccaagcagaagatcagcccctgggacctgttcgagggcctgaagcccagcgcccccctgagctggggctggttcggcaccgtgagagtggacagaagagtggccagaggcgaggagcagcagagactgctgctgtaccacacccacctgagacccagacccagagcctactacctggagcccctgcccctgccccccgaggacgaggagccccccgcccccaccctgctggagcccgagaagaaggcccccgagccccccaagaccgacaagcccggcgccgccccccccagcaccgaggagagaaagaagaagagcaccaagggcaagaagagaagccagcccgccaccaagaccgaggactacggcatgggccccggcagaagcggcccctacggcgtgaccgtgccccccgacctgctgcaccaccccaaccccggcagcatcacccacctgaactacagacagggcagcatcggcctgtacacccagaaccagcccctgcccgccggcggccccagagtggacccctacagacccgtgagactgcccatgcagaagctgcccaccagacccacctaccccggcgtgctgcccaccaccatgaccggcgtgatgggcctggagcccagcagctacaagaccagcgtgtacagacagcagcagcccgccgtgccccagggccagagactgagacagcagctgcagcagagccagggcatgctgggccagagcagcgtgcaccagatgacccccagcagcagctacggcctgcagaccagccagggctacaccccctacgtgagccacgtgggcctgcagcagcacaccggccccgccgaccccaccagacacctgcagcagagacccagcggctacgtgcaccagcaggcccccacctacggccacggcctgaccagcacccagagcttccacaccagacactgcagcagacacccctag

SEQ ID NO: 88207 - DNA, 2271 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggaggagcagagcatcatggcccacatgggcatcgacagcggcaccaccaacatcttcgacgaggtggacaagagcgacttcaagaccgacttcggcagcgagttccccatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggtgagccactgcttcagctag

SEQ ID NO: 88208 - DNA, 2166 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggagatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggtgagccactgcttcagctag

SEQ ID NO: 88209 - DNA, 6438 bp, Artificial Sequence
  Description of Artificial Sequence: Synthetic coding sequence
atggccgccttcggcctgctgagctacgagcagagacccctgaagagacccagactgggcccccccgacgtgtacccccaggaccccaagcagaaggaggacgagctgaccgccgtgaacgtgaagcagggcttcaacaaccagcccgccttcaccggcgacgagcacggcagcgccagaaacatcgtgatcaaccccagcaagatcggcgcctacttcagcagcatcctggccgagaagctgaagctgaacaccttccaggacaccggcaagaagaagccccaggtgaacgccaaggacaactactggctggtgaccgccagaagccagagcgccatccacagctggttcagcgacctggccggcaacaagcccctgagcatcctggccaagaaggtgcccatcctgagcaagaaggaggacgtgttcgcctacctggccaagtacagcgtgcccatggtgagagccacctggctgatcaagatgacctgcgcctactacagcgccatcagcgaggccaagatcaagaagagacaggcccccgaccccaacctggagtggacccagatcagcaccagatacctgagagagcagctggccaagatcagcgacttctaccacatggccagcagcaccggcgacggccccgtgcccgtgccccccgaggtggagcaggccatgaagcagtgggagtacaacgagaagctggccttccacatgttccaggagggcatgctggagaagcacgagtacctgacctggatcctggacgtgctggagaagatcagacccatggacgacgacctgctgaagctgctgctgcccctgatgctgcagtacagcgacgagttcgtgcagagcgcctacctgagcagaagactggcctacttctgcgccagaagactgagcctgctgctgagcgacagccccaacctgctggccgcccacagcccccacatgatgatcggccccaacaacagcagcatcggcgcccccagccccggcccccccggccccggcatgagccccgtgcagctggccttcagcgacttcctgagctgcgcccagcacggccccctggtgtacggcctgagctgcatgctgcagaccgtgaccctgtgctgccccagcgccctggtgtggaactacagcaccaacgagaacaagagcgccaaccccggcagccccctggacctgctgcaggtggcccccagcagcctgcccatgcccggcggcaacaccgccttcaaccagcaggtgagagccagaatctacgaggtggagcagcagatcaagcagagaggcagagccgtggaggtgagatggagcttcgacaagtgccaggagagcaccgccggcgtgaccatcagcagagtgctgcacaccctggaggtgctggacagacactgcttcgacagaaccgacagcagcaacagcatggagaccctgtaccacaagatcttctgggccaaccagaacaaggacaaccaggaggtggcccccaacgacgaggccgtggtgaccctgctgtgcgagtgggccgtgagctgcaagagaagcggcaagcacagagccatggccgtggccaagctgctggagaagagacaggccgagatcgaggccgagagatgcggcgagagcgaggtgctggacgagaaggagagcatcagcagcagcagcctggccggcagcagcctgcccgtgttccagaacgtgctgctgagattcctggacacccaggcccccagcctgagcgaccccaacagcgagtgcgagaaggtggagttcgtgaacctggtgctgctgttctgcgagttcatcagacacgacgtgttcagccacgacgcctacatgtgcaccctgatcagcagaggcgacctgagcgtgaccgccagcaccagacccagaagccccgtgggcgagaacgccgacgagcactacagcaaggaccacgacgtgaagatggagatcttcagccccatgcccggcgagagctgcgagaacgccaacaccagcctgggcagaagaatgagcgtgaactgcgagaagctggtgaagagagagaagcccagagagctgatcttccccagcaactacgacctgctgagacacctgcagtacgccacccacttccccatccccctggacgagagcagcagccacgagtgcaaccagagaaccatcctgctgtacggcgtgggcaaggagagagacgaggccagacaccagctgaagaagatcaccaaggacatcctgaagatcctgaacaagaagagcaccaccgagaccggcgtgggcgacgagggccagaaggccagaaagaacaagcaggagaccttccccaccctggagaccgtgttcaccaagctgcagctgctgagctacttcgaccagcaccaggtgaccagccagatcagcaacaacgtgctggagcagatcaccagcttcgccagcggcaccagctaccacctgcccctggcccaccacatccagctgatcttcgacctgatggagcccgccctgaacatcaacggcctgatcgacttcgccatccagctgctgaacgagctgagcgtggtggaggccgagctgctgctgaagagcagcagcctggccggcagctacaccaccggcctgtgcgtgtgcatcgtggccgtgctgagaagataccacagctgcctgatcctgaaccccgaccagaccgcccaggtgttcgagggcctgtgcggcgtggtgaagcacgtggtgaaccccagcgagtgcagcagccccgagagatgcatcctggcctacctgtacgacctgtacgtgagctgcagccacctgagaagcaagttcggcgacctgttcagcagcgcctgcagcaaggtgaagcagaccatctacaacaacgtgatgcccgccaacagcaacctgagatgggaccccgacttcatgatggacttcatcgagaaccccagcgccagaagcatcaactacagcatgctgggcaagatcctgagcgacaacgccgccaacagatacagcttcgtgtgcaacaccctgatgaacgtgtgcatgggccaccaggacgccggcagaatcaacgacatcgccaacttcagcagcgagctgaccgcctgctgcaccgtgctgagcagcgagtggctgggcgtgctgaaggccctgtgctgcagcagcaaccacgtgtggggcttcaacgacgtgctgtgcaccgtggacgtgagcgacctgagcttccacgacagcctggccaccttcatcgccatcctgatcgccagacagtgcttcagcctggaggacgtggtgcagcacgtggccctgcccagcctgctggccgccgcctgcggcgacgccgacgccgagcccggcgccagaatgacctgcagactgctgctgcacctgttcagagccccccaggcctgcttcctgccccaggccaccggcaagcccttccccggcatcagaagcagctgcgacagacacctgctggccgccgcccacaacagcatcgaggtgggcgccgtgttcgccgtgctgaaggccatcatgatgctgggcgacgccaagatcggcaacaacagcgtgagcagcctgaagaacgacgacttcaccatgagaggcctgagatgcgacggcaacgccgacgacatctggaccgccagccagaaccccaagagctgcggcaagagcatcagcatcgagaccgccaacctgagagagtacgccagatacgtgctgagaaccatctgccagcaggagtgggtgggcgagcactgcctgaaggagcccgagagactgtgcaccgacaaggagctgatcctggaccccgtgctgagcaacatgcaggcccagaagctgctgcagctgatctgctacccccacggcatcaaggagtgcaccgagggcgacaacctgcagagacagcacatcaagagaatcctgcagaacctggagcagtggaccctgagacagagctggctggagctgcagctgatgatcaagcagtgcctgaaggaccccggcagcggcagcgtggccgagatgaacaacctgctggacaacatcgccaaggccaccatcgaggtgttccagcagagcgccgacctgaacaacagcagcaacagcggcatgagcctgttcaaccccaacagcatcggcagcgccgacaccagcagcaccagacagaacggcatcaagaccttcctgagcagcagcgagagaagaggcgtgtggctggtggcccccctgatcgccagactgcccaccagcgtgcagggcagagtgctgaaggccgccggcgaggagctggagaagggccagcacctgggcagcagcagcaagaaggagagagacagacagaagcagaagagcatgagcctgctgagccagcagcccttcctgagcctggtgctgacctgcctgaagggccaggacgagcagagagagggcctgctgaccagcctgcagaaccaggtgaaccagatcctgagcaactggagagaggagagataccaggacgacatcaaggccagacagatgatgcacgaggccctgcagctgagactgaacctggtgggcggcatgttcgacaccgtgcagagaagcacccagtggaccaccgactgggccctgctgctgctgcagatcatcaccagcggcaccgtggacatgcacaccaacaacgagctgttcaccaccgtgctggacatgctgggcgtgctgatcaacggcaccctggccagcgacctgagcaacgccagccccggcggcagcgaggagaacaagagagcctacatgaacctggtgaagaagctgaagaaggagctgggcgacaagagaagcgagagcatcgacaaggtgagacagctgctgcccctgcccaagcagacctgcgacgtgatcacctgcgagcccatgggcagcctgatcgacaccaagggcaacaagatcgccggcttcgacagcatcgacaagaagcagggcctgcaggtgagcaccaagcagaaggtgagcccctgggacctgttcgagggccagaagaaccccgcccccctgagctgggcctggttcggcaccgtgagagtggacagaagagtgatcaagtacgaggagcagcaccacctgctgctgtaccacacccaccccatgcccaagcccagaagctactacctgcagcccctgcccctgccccccgaggaggaggaggaggagcccaccagccccgtgagccaggagcccgagagaaagagcgccgagctgagcgaccagggcaagaccaccaccgacgaggagaagaagaccaagggcagaaagagaaagaccaagagcagcagcagagtggacgagtacccccagagcaacatctacagagtgccccccaactacagccccatcagcagccagatgatgcaccacccccagagcaccctgtggggctacaacctggtgggccagccccagcagcccggcttcttcctgcagaaccagagcctgacccccggcggcagcagactggaccccgccggcagcttcgtgcccaccaacaccaagcaggccctgagcaacatgctgcagagaagaagcggcgccatgatgcagccccccagcctgcacgccatcaccagccagcagcagctgatccagatgaagctgctgcagcagcagcagcagcagagactgctgagacaggcccagaccagacccttccagcagggccagcccggcgaccaggccgccctgttcgccgcccaggccagacccagcccccagctgccccagtaccccggcctgcagcaggcccagaccatgccccagggctacaccatgtacggcacccagatgcccctgcagcagaccagccagcagcaggccggcagcgtggtgctgagccccagctacaacagcagagcctaccccgccgcccacagcaaccccgtgctgatggagagactgagacagatccagcagcagcccagcggctacgtgcagcagcaggccagcccctacctgcagcccctgaccggcagccagagactgaaccaccaggccctgcagcagagccccctggtgggcggcggcatcgacgccgtgctgaccagcgcccaccccaacctgcccagcgtgcccctgccccaggaccccatgagacccagacagccccaggtgagacagcagcagagactgctgcagatgcagcagccccagcagccccagccccagcagcccccccagccccagcagagcagccagagccagagccagaccctgggcctgcaggccatgcagccccagcagcccctgttccccagacagggcctgcagcagacccagcagcagcagcagaccgccgccctggtgagacagctgcagaagcagctgagcagcaaccagccccagcagggcgtgaccccctacggccaccccagccacttctag

SEQ ID NO: 88210 - DNA, 6522 bp, Artificial Sequence
  Description of Artificial Sequence: Synthetic coding sequence
atgagcgccagcttcgtgcccaacggcgccagcctggaggactgccactgcaacctgttctgcctggccgacctgaccggcatcaagtggaagaagtacgtgtggcagggccccaccagcgcccccatcctgttccccgtgaccgaggaggaccccatcctgagcagcttcagcagatgcctgaaggccgacgtgctgggcgtgtggagaagagaccagagacccggcagaagagagctgtggatcttctggtggggcgaggaccccgtgctgctgaccctgttcaccatgacctaccagaagaagaagatggagtgcggcagaatggacttccccatgaacgccgtgctgtgcttccaggccgtgcacaacctgctggagagatgcctgatgaacagaaacttcgtgagaatcggcaagtggttcgtgaagccctacgagaaggacgagaagcccatcaacaagagcgagcacctgagctgcagcttcaccttcttcctgcacggcgacagcaacgtgtgcaccagcgtggagatcaaccagcaccagcccgtgtacctgctgagcgaggagcacatcaccctggcccagcagagcaacagccccttccaggtgatcctgtgccccttcggcctgaacggcaccctgaccggccaggccttcaagatgagcgacagcgccaccaagaagctgatcggcgagtggaagcagttctaccccatcagctgctgcctgaaggagatgagcgaggagaagcaggaggacatggactgggaggacgacagcctggccgccgtggaggtgctggtggccggcgtgagaatgatctaccccgcctgcttcgtgctggtgccccagagcgacatccccacccccagccccgtgggcagcacccactgcagcagcagctgcctgggcgtgcaccaggtgcccgccagcaccagagaccccgccatgagcagcgtgaccctgaccccccccaccagccccgaggaggtgcagaccgtggacccccagagcgtgcagaagtgggtgaagttcagcagcgtgagcgacggcttcaacagcgacagcaccagccaccacggcggcaagatccccagaaagctggccaaccacgtggtggacagagtgtggcaggagtgcaacatgaacagagcccagaacaagagaaagtacagcgccagcagcggcggcctgtgcgaggaggccaccgccgccaaggtggccagctgggacttcgtggaggccacccagagaaccaactgcagctgcctgagacacaagaacctgaagagcagaaacgccggccagcagggccaggcccccagcctgggccagcagcagcagatcctgcccaagcacaagaccaacgagaagcaggagaagagcgagaagccccagaagagacccctgacccccttccaccacagagtgagcgtgagcgacgacgtgggcatggacgccgacagcgccagccagagactggtgatcagcgcccccgacagccaggtgagattcagcaacatcagaaccaacgacgtggccaagaccccccagatgcacggcaccgagatggccaacagcccccagcccccccccctgagcccccacccctgcgacgtggtggacgagggcgtgaccaagacccccagcaccccccagagccagcacttctaccagatgcccacccccgaccccctggtgcccagcaagcccatggaggacagaatcgacagcctgagccagagcttccccccccagtaccaggaggccgtggagcccaccgtgtacgtgggcaccgccgtgaacctggaggaggacgaggccaacatcgcctggaagtactacaagttccccaagaagaaggacgtggagttcctgcccccccagctgcccagcgacaagttcaaggacgaccccgtgggccccttcggccaggagagcgtgaccagcgtgaccgagctgatggtgcagtgcaagaagcccctgaaggtgagcgacgagctggtgcagcagtaccagatcaagaaccagtgcctgagcgccatcgccagcgacgccgagcaggagcccaagatcgacccctacgccttcgtggagggcgacgaggagttcctgttccccgacaagaaggacagacagaacagcgagagagaggccggcaagaagcacaaggtggaggacggcaccagcagcgtgaccgtgctgagccacgaggaggacgccatgagcctgttcagccccagcatcaagcaggacgcccccagacccaccagccacgccagaccccccagcaccagcctgatctacgacagcgacctggccgtgagctacaccgacctggacaacctgttcaacagcgacgaggacgagctgacccccggcagcaagaagagcgccaacggcagcgacgacaaggccagctgcaaggagagcaagaccggcaacctggaccccctgagctgcatcagcaccgccgacctgcacaagatgtaccccaccccccccagcctggagcagcacatcatgggcttcagccccatgaacatgaacaacaaggagtacggcagcatggacaccacccccggcggcaccgtgctggagggcaacagcagcagcatcggcgcccagttcaagatcgaggtggacgagggcttctgcagccccaagcccagcgagatcaaggacttcagctacgtgtacaagcccgagaactgccagatcctggtgggctgcagcatgttcgcccccctgaagaccctgcccagccagtacctgccccccatcaagctgcccgaggagtgcatctacagacagagctggaccgtgggcaagctggagctgctgagcagcggccccagcatgcccttcatcaaggagggcgacggcagcaacatggaccaggagtacggcaccgcctacaccccccagacccacaccagcttcggcatgccccccagcagcgccccccccagcaacagcggcgccggcatcctgcccagccccagcacccccagattccccacccccagaacccccagaacccccagaacccccagaggcgccggcggccccgccagcgcccagggcagcgtgaagtacgagaacagcgacctgtacagccccgccagcacccccagcacctgcagacccctgaacagcgtggagcccgccaccgtgcccagcatccccgaggcccacagcctgtacgtgaacctgatcctgagcgagagcgtgatgaacctgttcaaggactgcaacttcgacagctgctgcatctgcgtgtgcaacatgaacatcaagggcgccgacgtgggcgtgtacatccccgaccccacccaggaggcccagtacagatgcacctgcggcttcagcgccgtgatgaacagaaagttcggcaacaacagcggcctgttcctggaggacgagctggacatcatcggcagaaacaccgactgcggcaaggaggccgagaagagattcgaggccctgagagccaccagcgccgagcacgtgaacggcggcctgaaggagagcgagaagctgagcgacgacctgatcctgctgctgcaggaccagtgcaccaacctgttcagccccttcggcgccgccgaccaggaccccttccccaagagcggcgtgatcagcaactgggtgagagtggaggagagagactgctgcaacgactgctacctggccctggagcacggcagacagttcatggacaacatgagcggcggcaaggtggacgaggccctggtgaagagcagctgcctgcacccctggagcaagagaaacgacgtgagcatgcagtgcagccaggacatcctgagaatgctgctgagcctgcagcccgtgctgcaggacgccatccagaagaagagaaccgtgagaccctggggcgtgcagggccccctgacctggcagcagttccacaagatggccggcagaggcagctacggcaccgacgagagccccgagcccctgcccatccccaccttcctgctgggctacgactacgactacctggtgctgagccccttcgccctgccctactgggagagactgatgctggagccctacggcagccagagagacatcgcctacgtggtgctgtgccccgagaacgaggccctgctgaacggcgccaagagcttcttcagagacctgaccgccatctacgagagctgcagactgggccagcacagacccgtgagcagactgctgaccgacggcatcatgagagtgggcagcaccgccagcaagaagctgagcgagaagctggtggccgagtggttcagccaggccgccgacggcaacaacgaggccttcagcaagctgaagctgtacgcccaggtgtgcagatacgacctgggcccctacctggccagcctgcccctggacagcagcctgctgagccagcccaacctggtggcccccaccagccagagcctgatcacccccccccagatgaccaacaccggcaacgccaacacccccagcgccaccctggccagcgccgccagcagcaccatgaccgtgaccagcggcgtggccatcagcaccagcgtggccaccgccaacagcaccctgaccaccgccagcaccagcagcagcagcagcagcaacctgaacagcggcgtgagcagcaacaagctgcccagcttcccccccttcggcagcatgaacagcaacgccgccggcagcatgagcacccaggccaacaccgtgcagagcggccagctgggcggccagcagaccagcgccctgcagaccgccggcatcagcggcgagagcagcagcctgcccacccagccccaccccgacgtgagcgagagcaccatggacagagacaaggtgggcatccccaccgacggcgacagccacgccgtgacctacccccccgccatcgtggtgtacatcatcgaccccttcacctacgagaacaccgacgagagcaccaacagcagcagcgtgtggaccctgggcctgctgagatgcttcctggagatggtgcagaccctgcccccccacatcaagagcaccgtgagcgtgcagatcatcccctgccagtacctgctgcagcccgtgaagcacgaggacagagagatctacccccagcacctgaagagcctggccttcagcgccttcacccagtgcagaagacccctgcccaccagcaccaacgtgaagaccctgaccggcttcggccccggcctggccatggagaccgccctgagaagccccgacagacccgagtgcatcagactgtacgccccccccttcatcctggcccccgtgaaggacaagcagaccgagctgggcgagaccttcggcgaggccggccagaagtacaacgtgctgttcgtgggctactgcctgagccacgaccagagatggatcctggccagctgcaccgacctgtacggcgagctgctggagacctgcatcatcaacatcgacgtgcccaacagagccagaagaaagaagagcagcgccagaaagttcggcctgcagaagctgtgggagtggtgcctgggcctggtgcagatgagcagcctgccctggagagtggtgatcggcagactgggcagaatcggccacggcgagctgaaggactggagctgcctgctgagcagaagaaacctgcagagcctgagcaagagactgaaggacatgtgcagaatgtgcggcatcagcgccgccgacagccccagcatcctgagcgcctgcctggtggccatggagccccagggcagcttcgtgatcatgcccgacagcgtgagcaccggcagcgtgttcggcagaagcaccaccctgaacatgcagaccagccagctgaacaccccccaggacaccagctgcacccacatcctggtgttccccaccagcgccagcgtgcaggtggccagcgccacctacaccaccgagaacctggacctggccttcaaccccaacaacgacggcgccgacggcatgggcatcttcgacctgctggacaccggcgacgacctggaccccgacatcatcaacatcctgcccgccagccccaccggcagccccgtgcacagccccggcagccactacccccacggcggcgacgccggcaagggccagagcaccgacagactgctgagcaccgagccccacgaggaggtgcccaacatcctgcagcagcccctggccctgggctacttcgtgagcaccgccaaggccggccccctgcccgactggttctggagcgcctgcccccaggcccagtaccagtgccccctgttcctgaaggccagcctgcacctgcacgtgcccagcgtgcagagcgacgagctgctgcacagcaagcacagccaccccctggacagcaaccagaccagcgacgtgctgagattcgtgctggagcagtacaacgccctgagctggctgacctgcgaccccgccacccaggacagaagaagctgcctgcccatccacttcgtggtgctgaaccagctgtacaacttcatcatgaacatgctgtag

SEQ ID NO: 88211 - DNA, 6525 bp, Artificial Sequence
  Description of Artificial Sequence: Synthetic coding sequence
atgagcgccagcttcgtgcccaacggcgccagcctggaggactgccactgcaacctgttctgcctggccgacctgaccggcatcaagtggaagaagtacgtgtggcagggccccaccagcgcccccatcctgttccccgtgaccgaggaggaccccatcctgagcagcttcagcagatgcctgaaggccgacgtgctgggcgtgtggagaagagaccagagacccggcagaagagagctgtggatcttctggtggggcgaggaccccagcttcgccgacctgatccaccacgacctgagcgaggaggaggacggcgtgtgggagaacggcctgagctacgagtgcagaaccctgctgttcaaggccgtgcacaacctgctggagagatgcctgatgaacagaaacttcgtgagaatcggcaagtggttcgtgaagccctacgagaaggacgagaagcccatcaacaagagcgagcacctgagctgcagcttcaccttcttcctgcacggcgacagcaacgtgtgcaccagcgtggagatcaaccagcaccagcccgtgtacctgctgagcgaggagcacatcaccctggcccagcagagcaacagccccttccaggtgatcctgtgccccttcggcctgaacggcaccctgaccggccaggccttcaagatgagcgacagcgccaccaagaagctgatcggcgagtggaagcagttctaccccatcagctgctgcctgaaggagatgagcgaggagaagcaggaggacatggactgggaggacgacagcctggccgccgtggaggtgctggtggccggcgtgagaatgatctaccccgcctgcttcgtgctggtgccccagagcgacatccccacccccagccccgtgggcagcacccactgcagcagcagctgcctgggcgtgcaccaggtgcccgccagcaccagagaccccgccatgagcagcgtgaccctgaccccccccaccagccccgaggaggtgcagaccgtggacccccagagcgtgcagaagtgggtgaagttcagcagcgtgagcgacggcttcaacagcgacagcaccagccaccacggcggcaagatccccagaaagctggccaaccacgtggtggacagagtgtggcaggagtgcaacatgaacagagcccagaacaagagaaagtacagcgccagcagcggcggcctgtgcgaggaggccaccgccgccaaggtggccagctgggacttcgtggaggccacccagagaaccaactgcagctgcctgagacacaagaacctgaagagcagaaacgccggccagcagggccaggcccccagcctgggccagcagcagcagatcctgcccaagcacaagaccaacgagaagcaggagaagagcgagaagccccagaagagacccctgacccccttccaccacagagtgagcgtgagcgacgacgtgggcatggacgccgacagcgccagccagagactggtgatcagcgcccccgacagccaggtgagattcagcaacatcagaaccaacgacgtggccaagaccccccagatgcacggcaccgagatggccaacagcccccagcccccccccctgagcccccacccctgcgacgtggtggacgagggcgtgaccaagacccccagcaccccccagagccagcacttctaccagatgcccacccccgaccccctggtgcccagcaagcccatggaggacagaatcgacagcctgagccagagcttccccccccagtaccaggaggccgtggagcccaccgtgtacgtgggcaccgccgtgaacctggaggaggacgaggccaacatcgcctggaagtactacaagttccccaagaagaaggacgtggagttcctgcccccccagctgcccagcgacaagttcaaggacgaccccgtgggccccttcggccaggagagcgtgaccagcgtgaccgagctgatggtgcagtgcaagaagcccctgaaggtgagcgacgagctggtgcagcagtaccagatcaagaaccagtgcctgagcgccatcgccagcgacgccgagcaggagcccaagatcgacccctacgccttcgtggagggcgacgaggagttcctgttccccgacaagaaggacagacagaacagcgagagagaggccggcaagaagcacaaggtggaggacggcaccagcagcgtgaccgtgctgagccacgaggaggacgccatgagcctgttcagccccagcatcaagcaggacgcccccagacccaccagccacgccagaccccccagcaccagcctgatctacgacagcgacctggccgtgagctacaccgacctggacaacctgttcaacagcgacgaggacgagctgacccccggcagcaagaagagcgccaacggcagcgacgacaaggccagctgcaaggagagcaagaccggcaacctggaccccctgagctgcatcagcaccgccgacctgcacaagatgtaccccaccccccccagcctggagcagcacatcatgggcttcagccccatgaacatgaacaacaaggagtacggcagcatggacaccacccccggcggcaccgtgctggagggcaacagcagcagcatcggcgcccagttcaagatcgaggtggacgagggcttctgcagccccaagcccagcgagatcaaggacttcagctacgtgtacaagcccgagaactgccagatcctggtgggctgcagcatgttcgcccccctgaagaccctgcccagccagtacctgccccccatcaagctgcccgaggagtgcatctacagacagagctggaccgtgggcaagctggagctgctgagcagcggccccagcatgcccttcatcaaggagggcgacggcagcaacatggaccaggagtacggcaccgcctacaccccccagacccacaccagcttcggcatgccccccagcagcgccccccccagcaacagcggcgccggcatcctgcccagccccagcacccccagattccccacccccagaacccccagaacccccagaacccccagaggcgccggcggccccgccagcgcccagggcagcgtgaagtacgagaacagcgacctgtacagccccgccagcacccccagcacctgcagacccctgaacagcgtggagcccgccaccgtgcccagcatccccgaggcccacagcctgtacgtgaacctgatcctgagcgagagcgtgatgaacctgttcaaggactgcaacttcgacagctgctgcatctgcgtgtgcaacatgaacatcaagggcgccgacgtgggcgtgtacatccccgaccccacccaggaggcccagtacagatgcacctgcggcttcagcgccgtgatgaacagaaagttcggcaacaacagcggcctgttcctggaggacgagctggacatcatcggcagaaacaccgactgcggcaaggaggccgagaagagattcgaggccctgagagccaccagcgccgagcacgtgaacggcggcctgaaggagagcgagaagctgagcgacgacctgatcctgctgctgcaggaccagtgcaccaacctgttcagccccttcggcgccgccgaccaggaccccttccccaagagcggcgtgatcagcaactgggtgagagtggaggagagagactgctgcaacgactgctacctggccctggagcacggcagacagttcatggacaacatgagcggcggcaaggtggacgaggccctggtgaagagcagctgcctgcacccctggagcaagagaaacgacgtgagcatgcagtgcagccaggacatcctgagaatgctgctgagcctgcagcccgtgctgcaggacgccatccagaagaagagaaccgtgagaccctggggcgtgcagggccccctgacctggcagcagttccacaagatggccggcagaggcagctacggcaccgacgagagccccgagcccctgcccatccccaccttcctgctgggctacgactacgactacctggtgctgagccccttcgccctgccctactgggagagactgatgctggagccctacggcagccagagagacatcgcctacgtggtgctgtgccccgagaacgaggccctgctgaacggcgccaagagcttcttcagagacctgaccgccatctacgagagctgcagactgggccagcacagacccgtgagcagactgctgaccgacggcatcatgagagtgggcagcaccgccagcaagaagctgagcgagaagctggtggccgagtggttcagccaggccgccgacggcaacaacgaggccttcagcaagctgaagctgtacgcccaggtgtgcagatacgacctgggcccctacctggccagcctgcccctggacagcagcctgctgagccagcccaacctggtggcccccaccagccagagcctgatcacccccccccagatgaccaacaccggcaacgccaacacccccagcgccaccctggccagcgccgccagcagcaccatgaccgtgaccagcggcgtggccatcagcaccagcgtggccaccgccaacagcaccctgaccaccgccagcaccagcagcagcagcagcagcaacctgaacagcggcgtgagcagcaacaagctgcccagcttcccccccttcggcagcatgaacagcaacgccgccggcagcatgagcacccaggccaacaccgtgcagagcggccagctgggcggccagcagaccagcgccctgcagaccgccggcatcagcggcgagagcagcagcctgcccacccagccccaccccgacgtgagcgagagcaccatggacagagacaaggtgggcatccccaccgacggcgacagccacgccgtgacctacccccccgccatcgtggtgtacatcatcgaccccttcacctacgagaacaccgacgagagcaccaacagcagcagcgtgtggaccctgggcctgctgagatgcttcctggagatggtgcagaccctgcccccccacatcaagagcaccgtgagcgtgcagatcatcccctgccagtacctgctgcagcccgtgaagcacgaggacagagagatctacccccagcacctgaagagcctggccttcagcgccttcacccagtgcagaagacccctgcccaccagcaccaacgtgaagaccctgaccggcttcggccccggcctggccatggagaccgccctgagaagccccgacagacccgagtgcatcagactgtacgccccccccttcatcctggcccccgtgaaggacaagcagaccgagctgggcgagaccttcggcgaggccggccagaagtacaacgtgctgttcgtgggctactgcctgagccacgaccagagatggatcctggccagctgcaccgacctgtacggcgagctgctggagacctgcatcatcaacatcgacgtgcccaacagagccagaagaaagaagagcagcgccagaaagttcggcctgcagaagctgtgggagtggtgcctgggcctggtgcagatgagcagcctgccctggagagtggtgatcggcagactgggcagaatcggccacggcgagctgaaggactggagctgcctgctgagcagaagaaacctgcagagcctgagcaagagactgaaggacatgtgcagaatgtgcggcatcagcgccgccgacagccccagcatcctgagcgcctgcctggtggccatggagccccagggcagcttcgtgatcatgcccgacagcgtgagcaccggcagcgtgttcggcagaagcaccaccctgaacatgcagaccagccagctgaacaccccccaggacaccagctgcacccacatcctggtgttccccaccagcgccagcgtgcaggtggccagcgccacctacaccaccgagaacctggacctggccttcaaccccaacaacgacggcgccgacggcatgggcatcttcgacctgctggacaccggcgacgacctggaccccgacatcatcaacatcctgcccgccagccccaccggcagccccgtgcacagccccggcagccactacccccacggcggcgacgccggcaagggccagagcaccgacagactgctgagcaccgagccccacgaggaggtgcccaacatcctgcagcagcccctggccctgggctacttcgtgagcaccgccaaggccggccccctgcccgactggttctggagcgcctgcccccaggcccagtaccagtgccccctgttcctgaaggccagcctgcacctgcacgtgcccagcgtgcagagcgacgagctgctgcacagcaagcacagccaccccctggacagcaaccagaccagcgacgtgctgagattcgtgctggagcagtacaacgccctgagctggctgacctgcgaccccgccacccaggacagaagaagctgcctgcccatccacttcgtggtgctgaaccagctgtacaacttcatcatgaacatgctgtag

SEQ ID NO: 88212 - DNA, 6633 bp, Artificial Sequence
  Description of Artificial Sequence: Synthetic coding sequence
atgaccgccgccgccaactgggtggccaacggcgccagcctggaggactgccacagcaacctgttcagcctggccgagctgaccggcatcaagtggagaagatacaacttcggcggccacggcgactgcggccccatcatcagcgcccccgcccaggacgaccccatcctgctgagcttcatcagatgcctgcaggccaacctgctgtgcgtgtggagaagagacgtgaagcccgactgcaaggagctgtggatcttctggtggggcgacgagcccaacctggtgggcgtgatccaccacgagctgcaggtggtggaggagggcctgtgggagaacggcctgagctacgagtgcagaaccctgctgttcaaggccatccacaacctgctggagagatgcctgatggacaagaacttcgtgagaatcggcaagtggttcgtgagaccctacgagaaggacgagaagcccgtgaacaagagcgagcacctgagctgcgccttcaccttcttcctgcacggcgagagcaacgtgtgcaccagcgtggagatcgcccagcaccagcccatctacctgatcaacgaggagcacatccacatggcccagagcagccccgcccccttccaggtgctggtgagcccctacggcctgaacggcaccctgaccggccaggcctacaagatgagcgaccccgccaccagaaagctgatcgaggagtggcagtacttctaccccatggtgctgaagaagaaggaggagagcaaggaggaggacgagctgggctacgacgacgacttccccgtggccgtggaggtgatcgtgggcggcgtgagaatggtgtaccccagcgccttcgtgctgatcagccagaacgacatccccgtgccccagagcgtggccagcgccggcggccacatcgccgtgggccagcagggcctgggcagcgtgaaggaccccagcaactgcggcatgcccctgaccccccccaccagccccgagcaggccatcctgggcgagagcggcggcatgcagagcgccgccagccacctggtgagccaggacggcggcatgatcaccatgcacagccccaagagaagcggcaagatcccccccaagctgcacaaccacatggtgcacagagtgtggaaggagtgcatcctgaacagaacccagagcaagagaagccagatgagcacccccaccctggaggaggagcccgccagcaaccccgccacctgggacttcgtggaccccacccagagagtgagctgcagctgcagcagacacaagctgctgaagagatgcgccgtgggccccaacagaccccccaccgtgagccagcccggcttcagcgccggccccagcagcagcagcagcctgcccccccccgccagcagcaagcacaagaccgccgagagacaggagaagggcgacaagctgcagaagagacccctgatccccttccaccacagacccagcgtggccgaggagctgtgcatggagcaggacacccccggccagaagctgggcctggccggcatcgacagcagcctggaggtgagcagcagcagaaagtacgacaagcagatggccgtgcccagcagaaacaccagcaagcagatgaacctgaaccccatggacagcccccacagccccatcagccccctgccccccaccctgagcccccagcccagaggccaggagaccgagagcctggacccccccagcgtgcccgtgaaccccgccctgtacggcaacggcctggagctgcagcagctgagcaccctggacgacagaaccgtgctggtgggccagagactgcccctgatggccgaggtgagcgagaccgccctgtactgcggcatcagacccagcaaccccgagagcagcgagaagtggtggcacagctacagactgccccccagcgacgacgccgagttcagaccccccgagctgcagggcgagagatgcgacgccaagatggaggtgaacagcgagagcaccgccctgcagagactgctggcccagcccaacaagagattcaagatctggcaggacaagcagccccagctgcagcccctgcacttcctggaccccctgcccctgagccagcagcccggcgacagcctgggcgaggtgaacgacccctacaccttcgaggacggcgacatcaagtacatcttcaccgccaacaagaagtgcaagcagggcaccgagaaggacagcctgaagaagaacaagagcgaggacggcttcggcaccaaggacgtgaccacccccggccacagcacccccgtgcccgacggcaagaacgccatgagcatcttcagcagcgccaccaagaccgacgtgagacaggacaacgccgccggcagagccggcagcagcagcctgacccaggtgaccgacctggcccccagcctgcacgacctggacaacatcttcgacaacagcgacgacgacgagctgggcgccgtgagccccgccctgagaagcagcaagatgcccgccgtgggcaccgaggacagacccctgggcaaggacggcagagccgccgtgccctacccccccaccgtggccgacctgcagagaatgttccccaccccccccagcctggagcagcaccccgccttcagccccgtgatgaactacaaggacggcatcagcagcgagaccgtgaccgccctgggcatgatggagagccccatggtgagcatggtgagcacccagctgaccgagttcaagatggaggtggaggacggcctgggcagccccaagcccgaggagatcaaggacttcagctacgtgcacaaggtgcccagcttccagcccttcgtgggcagcagcatgttcgcccccctgaagatgctgcccagccactgcctgctgcccctgaagatccccgacgcctgcctgttcagacccagctgggccatcccccccaagatcgagcagctgcccatgccccccgccgccaccttcatcagagacggctacaacaacgtgcccagcgtgggcagcctggccgaccccgactacctgaacaccccccagatgaacacccccgtgaccctgaacagcgccgcccccgccagcaacagcggcgccggcgtgctgcccagccccgccacccccagattcagcgtgcccacccccagaacccccagaacccccagaacccccagaggcggcggcaccgccagcggccagggcagcgtgaagtacgacagcaccgaccagggcagccccgccagcacccccagcaccaccagacccctgaacagcgtggagcccgccaccatgcagcccatccccgaggcccacagcctgtacgtgaccctgatcctgagcgacagcgtgatgaacatcttcaaggacagaaacttcgacagctgctgcatctgcgcctgcaacatgaacatcaagggcgccgacgtgggcctgtacatccccgacagcagcaacgaggaccagtacagatgcacctgcggcttcagcgccatcatgaacagaaagctgggctacaacagcggcctgttcctggaggacgagctggacatcttcggcaagaacagcgacatcggccaggccgccgagagaagactgatgatgtgccagagcaccttcctgccccaggtggagggcaccaagaagccccaggagccccccatcagcctgctgctgctgctgcagaaccagcacacccagcccttcgccagcctgaacttcctggactacatcagcagcaacaacagacagaccctgccctgcgtgagctggagctacgacagagtgcaggccgacaacaacgactactggaccgagtgcttcaacgccctggagcagggcagacagtacgtggacaaccccaccggcggcaaggtggacgaggccctggtgagaagcgccaccgtgcacagctggccccacagcaacgtgctggacatcagcatgctgagcagccaggacgtggtgagaatgctgctgagcctgcagcccttcctgcaggacgccatccagaagaagagaaccggcagaacctgggagaacatccagcacgtgcagggccccctgacctggcagcagttccacaagatggccggcagaggcacctacggcagcgaggagagccccgagcccctgcccatccccaccctgctggtgggctacgacaaggacttcctgaccatcagccccttcagcctgcccttctgggagagactgctgctggacccctacggcggccacagagacgtggcctacatcgtggtgtgccccgagaacgaggccctgctggagggcgccaagaccttcttcagagacctgagcgccgtgtacgagatgtgcagactgggccagcacaagcccatctgcaaggtgctgagagacggcatcatgagagtgggcaagaccgtggcccagaagctgaccgacgagctggtgagcgagtggttcaaccagccctggagcggcgaggagaacgacaaccacagcagactgaagctgtacgcccaggtgtgcagacaccacctggccccctacctggccaccctgcagctggacagcagcctgctgatcccccccaagtaccagaccccccccgccgccgcccagggccaggccacccccggcaacgccggccccctggcccccaacggcagcgccgccccccccgccggcagcgccttcaaccccaccagcaacagcagcagcaccaaccccgccgccagcagcagcgccagcggcagcagcgtgccccccgtgagcagcagcgccagcgcccccggcatcagccagatcagcaccaccagcagcagcggcttcagcggcagcgtgggcggccagaaccccagcaccggcggcatcagcgccgacagaacccagggcaacatcggctgcggcggcgacaccgaccccggccagagcagcagccagcccagccaggacggccaggagagcgtgaccgagagagagagaatcggcatccccaccgagcccgacagcgccgacagccacgcccacccccccgccgtggtgatctacatggtggaccccttcacctacgccgccgaggaggacagcaccagcggcaacttctggctgctgagcctgatgagatgctacaccgagatgctggacaacctgcccgagcacatgagaaacagcttcatcctgcagatcgtgccctgccagtacatgctgcagaccatgaaggacgagcaggtgttctacatccagtacctgaagagcatggccttcagcgtgtactgccagtgcagaagacccctgcccacccagatccacatcaagagcctgaccggcttcggccccgccgccagcatcgagatgaccctgaagaaccccgagagacccagccccatccagctgtacagcccccccttcatcctggcccccatcaaggacaagcagaccgagctgggcgagaccttcggcgaggccagccagaagtacaacgtgctgttcgtgggctactgcctgagccacgaccagagatggctgctggccagctgcaccgacctgcacggcgagctgctggagacctgcgtggtgaacatcgccctgcccaacagaagcagaagaagcaaggtgagcgccagaaagatcggcctgcagaagctgtgggagtggtgcatcggcatcgtgcagatgaccagcctgccctggagagtggtgatcggcagactgggcagactgggccacggcgagctgaaggactggagcatcctgctgggcgagtgcagcctgcagaccatcagcaagaagctgaaggacgtgtgcagaatgtgcggcatcagcgccgccgacagccccagcatcctgagcgcctgcctggtggccatggagccccagggcagcttcgtggtgatgcccgacgccgtgaccatgggcagcgtgttcggcagaagcaccgccctgaacatgcagagcagccagctgaacaccccccaggacgccagctgcacccacatcctggtgttccccaccagcagcaccatccaggtggcccccgccaactaccccaacgaggacggcttcagccccaacaacgacgacatgttcgtggacctgcccttccccgacgacatggacaacgacatcggcatcctgatgaccggcaacctgcacagcagccccaacagcagccccgtgcccagccccggcagccccagcggcatcggcgtgggcagccacttccagcacagcagaagccagggcgagagactgctgagcagagaggcccccgaggagctgaagcagcagcccctggccctgggctacttcgtgagcaccgccaaggccgagaacctgccccagtggttctggagcagctgcccccaggcccagaaccagtgccccctgttcctgaaggccagcctgcaccaccacatcagcgtggcccagaccgacgagctgctgcccgccagaaacagccagagagtgccccaccccctggacagcaagaccaccagcgacgtgctgagattcgtgctggagcagtacaacgccctgagctggctgacctgcaaccccgccacccaggacagaaccagctgcctgcccgtgcacttcgtggtgctgacccagctgtacaacgccatcatgaacatcctgtag

SEQ ID NO: 88213 - DNA, 4365 bp, Artificial Sequence
  Description of Artificial Sequence: Synthetic coding sequence
atggcccccgtgcagctggagaaccaccagctggtgccccccggcggcggcggcggcggcagcggcggcccccccagcgcccccgccccccccccccccggcgccgccgtggccgccgccgccgccgccgccgccagccccggctacagactgagcaccctgatcgagttcctgctgcacagagcctacagcgagctgatggtgctgaccgacctgctgcccagaaagagcgacgtggagagaaagatcgagatcgtgcagttcgccagcagaaccagacagctgttcgtgagactgctggccctggtgaagtgggccaacaacgccggcaaggtggagaagtgcgccatgatcagcagcttcctggaccagcaggccatcctgttcgtggacaccgccgacagactggccagcctggccagagacgccctggtgcacgccagactgcccagcttcgccatcccctacgccatcgacgtgctgaccaccggcagctaccccagactgcccacctgcatcagagacaagatcatcccccccgaccccatcaccaagatcgagaagcaggccaccctgcaccagctgaaccagatcctgagacacagactggtgaccaccgacctgcccccccagctggccaacctgaccgtggccaacggcagagtgaagttcagagtggagggcgagttcgaggccaccctgaccgtgatgggcgacgaccccgacgtgccctggagactgctgaagctggagatcctggtggaggacaaggagaccggcgacggcagagccctggtgcacagcatgcagatcagcttcatccaccagctggtgcagagcagactgttcgccgacgagaagcccctgcaggacatgtacaactgcctgcacagcttctgcctgagcctgcagctggaggtgctgcacagccagaccctgatgctgatcagagagagatggggcgacctggtgcaggtggagagataccacgccggcaagtgcctgagcctgagcgtgtggaaccagcaggtgctgggcagaaagaccggcaccgccagcgtgcacaaggtgaccatcaagatcgacgagaacgacgtgagcaagcccctgcagatcttccacgacccccccctgcccgccagcgacagcaagctggtggagagagccatgaagatcgaccacctgagcatcgagaagctgctgatcgacagcgtgcacgccagagcccaccagaagctgcaggagctgaaggccatcctgagaggcttcaacgccaacgagaacagcagcatcgagaccgccctgcccgccctggtggtgcccatcctggagccctgcggcaacagcgagtgcctgcacatcttcgtggacctgcacagcggcatgttccagctgatgctgtacggcctggaccaggccaccctggacgacatggagaagagcgtgaacgacgacatgaagagaatcatcccctggatccagcagctgaagttctggctgggccagcagagatgcaagcagagcatcaagcacctgcccaccatcagcagcgagaccctgcagctgagcaactacagcacccaccccatcggcaacctgagcaagaacaagctgttcatcaagctgaccagactgccccagtactacatcgtggtggagatgctggaggtgcccaacaagcccacccagctgagctacaagtactacttcatgagcgtgaacgccgccgacagagaggacagccccgccatggccctgctgctgcagcagttcaaggagaacatccaggacctggtgttcagaaccaagaccggcaagcagaccagaaccaacgccaagagaaagctgagcgacgacccctgccccgtggagagcaagaagaccaagagagccggcgagatgtgcgccttcaacaaggtgctggcccacttcgtggccatgtgcgacaccaacatgcccttcgtgggcctgagactggagctgagcaacctggagatcccccaccagggcgtgcaggtggagggcgacggcttcagccacgccatcagactgctgaagatccccccctgcaagggcatcaccgaggagacccagaaggccctggacagaagcctgctggactgcaccttcagactgcagggcagaaacaacagaacctgggtggccgagctggtgttcgccaactgccccctgaacggcaccagcaccagagagcagggccccagcagacacgtgtacctgacctacgagaacctgctgagcgagcccgtgggcggcagaaaggtggtggagatgttcctgaacgactggaacagcatcgccagactgtacgagtgcgtgctggagttcgccagaagcctgcccgacatccccgcccacctgaacatcttcagcgaggtgagagtgtacaactacagaaagctgatcctgtgctacggcaccaccaagggcagcagcatcagcatccagtggaacagcatccaccagaagttccacatcagcctgggcaccgtgggccccaacagcggctgcagcaactgccacaacaccatcctgcaccagctgcaggagatgttcaacaagacccccaacgtggtgcagctgctgcaggtgctgttcgacacccaggcccccctgaacgccatcaacaagctgcccaccgtgcccatgctgggcctgacccagagaaccaacaccgcctaccagtgcttcagcatcctgccccagagcagcacccacatcagactggccttcagaaacatgtactgcatcgacatctactgcagaagcagaggcgtggtggccatcagagacggcgcctacagcctgttcgacaacagcaagctggtggagggcttctaccccgcccccggcctgaagaccttcctgaacatgttcgtggacagcaaccaggacgccagaagaagaagcgtgaacgaggacgacaacccccccagccccatcggcggcgacatgatggacagcctgatcagccagctgcagccccccccccagcagcagcccttccccaagcagcccggcaccagcggcgcctaccccctgaccagcccccccaccagctaccacagcaccgtgaaccagagccccagcatgatgcacacccagagccccggcaacctgcacgccgccagcagccccagcggcgccctgagagcccccagccccgccagcttcgtgcccacccccccccccagcagccacggcatcagcatcggccccggcgccagcttcgccagcccccacggcaccctggaccccagcagcccctacaccatggtgagccccagcggcagagccggcaactggcccggcagcccccaggtgagcggccccagccccgccgccagaatgcccggcatgagccccgccaaccccagcctgcacagccccgtgcccgacgccagccacagccccagagccggcaccagcagccagaccatgcccaccaacatgcccccccccagaaagctgccccagagaagctgggccgccagcatccccaccatcctgacccacagcgccctgaacatcctgctgctgcccagccccacccccggcctggtgcccggcctggccggcagctacctgtgcagccccctggagagattcctgggcagcgtgatcatgagaagacacctgcagagaatcatccagcaggagaccctgcagctgatcaacagcaacgagcccggcgtgatcatgttcaagaccgacgccctgaagtgcagagtggccctgagccccaagaccaaccagaccctgcagctgaaggtgacccccgagaacgccggccagtggaagcccgacgagctgcaggtgctggagaagttcttcgagaccagagtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcgagtgcaccatcttcgccgccgtgagagacctgatggccaacctgaccctgccccccggcggcagaccctag

SEQ ID NO: 88214 - DNA, 468 bp, Artificial Sequence
  Description of Artificial Sequence: Synthetic coding sequence
gtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcagcatcaagggcaccggctgccccagcgacttcctgtag

SEQ ID NO: 88215 - DNA, 996 bp, Artificial Sequence
  Description of Artificial Sequence: Synthetic coding sequence
cccagcggcagagccggcaactggcccggcagcccccaggtgagcggccccagccccgccgccagaatgcccggcatgagccccgccaaccccagcctgcacagccccgtgcccgacgccagccacagccccagagccggcaccagcagccagaccatgcccaccaacatgcccccccccagaaagctgccccagagaagctgggccgccagcatccccaccatcctgacccacagcgccctgaacatcctgctgctgcccagccccacccccggcctggtgcccggcctggccggcagctacctgtgcagccccctggagagattcctgggcagcgtgatcatgagaagacacctgcagagaatcatccagcaggagaccctgcagctgatcaacagcaacgagcccggcgtgatcatgttcaagaccgacgccctgaagtgcagagtggccctgagccccaagaccaaccagaccctgcagctgaaggtgacccccgagaacgccggccagtggaagcccgacgagctgcaggtgctggagaagttcttcgagaccagagtggccggcccccccttcaaggccaacaccctgatcgccttcaccaagctgctgggcgcccccacccacatcctgagagactgcgtgcacatcatgaagctggagctgttccccgaccaggccacccagctgaagtggaacgtgcagttctgcctgaccatcccccccagcgccccccccatcgccccccccggcacccccgccgtggtgctgaagagcaagatgctgttcttcctgcagctgacccagaagaccagcgtgcccccccaggagcccgtgagcatcatcgtgcccatcatctacgacatggccagcggcaccacccagcaggccgacatccccagacagcagaacagcagcgtggccgcccccatgatggtgagcaacatcctgaagagattcgccgagatgaacccccccagacagggcacctag

SEQ ID NO: 88216 - DNA, 2367 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcagatgatcaccgaggccctggcccagggcggcatgcacatcagagccagattcccccccaccaccgccgtgagcgccatccccagcagcagcatccccctgggcagacagcccatggcccaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88217 - DNA, 2247 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88218 - DNA, 2034 bp, Artificial Sequence
  Description of Artificial Sequence: Synthetic coding sequence
atggacgtgagcggccaggagaccgactggagaagcaccgccttcagacagaagctggtgagccagatcgaggacgccatgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88219 - DNA, 2169 bp, Artificial Sequence
  Description of Artificial Sequence: Synthetic coding sequence
atgagaaaggccggcgtggcccacagcaagagcagcaaggacatggagagccacgtgttcctgaaggccaagaccagagacgagtacctgagcctggtggccagactgatcatccacttcagagacatccacaacaagaagagccaggccagcgtgagcgaccccatgaacgccctgcagagcctgaccggcggccccgccgccggcgccgccggcatcggcatgccccccagaggccccggccagagcctgggcggcatgggcagcctgggcgccatgggccagcccatgagcctgagcggccagcccccccccggcaccagcggcatggccccccacagcatggccgtggtgagcaccgccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88220 - DNA, 1914 bp, Artificial Sequence
  Description of Artificial Sequence: Synthetic coding sequence
atggagagccacgtgttcctgaaggccaagaccagagacgagtacctgagcctggtggccagactgatcatccacttcagagacatccacaacaagaagagccaggccagcgtgagcgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaatcgcccagctgcagctgcagcagcagcagcagcagcagcagcagcagcagcagcagcagcagcaggccctgcaggcccagccccccatccagcagccccccatgcagcagccccagcccccccccagccaggccctgccccagcagctgcagcagatgcaccacacccagcaccaccagccccccccccagccccagcagccccccgtggcccagaaccagcccagccagctgcccccccagagccagacccagcccctggtgagccaggcccaggccctgcccggccagatgctgtacacccagccccccctgaagttcgtgagagcccccatggtggtgcagcagccccccgtgcagccccaggtgcagcagcagcagaccgccgtgcagaccgcccaggccgcccagatggtggcccccggcgtgcaggtgagccagagcagcctgcccatgctgagcagccccagccccggccagcaggtgcagaccccccagagcatgcccccccccccccagcccagcccccagcccggccagcccagcagccagcccaacagcaacgtgagcagcggccccgcccccagccccagcagcttcctgcccagccccagcccccagcccagccagagccccgtgaccgccagaaccccccagaacttcagcgtgcccagccccggccccctgaacacccccgtgaaccccagcagcgtgatgagccccgccggcagcagccaggccgaggagcagcagtacctggacaagctgaagcagctgagcaagtacatcgagcccctgagaagaatgatcaacaagatcgacaagaacgaggacagaaagaaggacctgagcaagatgaagagcctgctggacatcctgaccgaccccagcaagagatgccccctgaagaccctgcagaagtgcgagatcgccctggagaagctgaagaacgacatggccgtgcccacccccccccccccccccgtgccccccaccaagcagcagtacctgtgccagcccctgctggacgccgtgctggccaacatcagaagccccgtgttcaaccacagcctgtacagaaccttcgtgcccgccatgaccgccatccacggcccccccatcaccgcccccgtggtgtgcaccagaaagagaagactggaggacgacgagagacagagcatccccagcgtgctgcagggcgaggtggccagactggaccccaagttcctggtgaacctggaccccagccactgcagcaacaacggcaccgtgcacctgatctgcaagctggacgacaaggacctgcccagcgtgccccccctggagctgagcgtgcccgccgactaccccgcccagagccccctgtggatcgacagacagtggcagtacgacgccaaccccttcctgcagagcgtgcacagatgcatgaccagcagactgctgcagctgcccgacaagcacagcgtgaccgccctgctgaacacctgggcccagagcgtgcaccaggcctgcctgagcgccgcctag

SEQ ID NO: 88221 - DNA, 2169 bp, Artificial Sequence; identical to SEQ ID NO: 88219
  Description of Artificial Sequence: Synthetic coding sequence
